United States Patent 9,567,581 (SELECTIVE REACTIVATION OF GENES ON THE INACTIVE X CHROMOSOME) - sequence listing, part 49

SEQ ID NO: 5138 - DNA, 500054 bp, human
gccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtggtaggtgttgatttttgccttctcctttgatgagcgagtctcctggcgaagtctgaggttttcgcctttgttaagaggagctgaagctgtcgtggggggcgccccggactccctcccacttgctctcagccacctctggccccggccgcgctgactcctaggtcggatgccggggtggggggaggtgcgggaagagggagggatgcggacccgaaagcgtcgctttgcgctccaagtctaaagagttgcatttggctcacatcgaattcggtgccgcccgagggctgaaccgcacgacctcccaggagcttttctctcggagcggcttgccggtctggcctccttgagccccggatgccgcccgcccgaaatgtctcaactttccaggtgcccaacgcccgcggcgggccatgggggaaaggcaacggccaggtgcggccagcagccctctgcttccttggtggccaccgcccccgctgccgccacctccatccctgcgctgcgcggcgcgcacacctttccttctgccgactcagcccaagttccctgcactcccgggtggagcagcggctttgggggccaccactcaggggaccttggttcgaggccgacttcggcgcttggctttcaagactgagggttttcggagttggccccccaaatccgcagctctgatgtcaatgcacatttaattaccggatggacccccttcggcctcccactgggaggcagccgtagttttttgtaagggacctccagctcagattcaaaggttgagtcagctcttcacaaaataccctaaacttgtcgctgagacattttgaaagatggtagaaaggtgactggggacctggaaagttgttaactctcttagagatgtgcgtgcgcgtgtgcataaatactgatatacatatctattaacttttcaaaaacttcacctactacaaacattatcacagtttatttgtcataatacttaaacgtatcagattccccccgcagtctaaggaattagatggggagggggcgcagtggtaaccgcttaaaattgcattcttggttattgccttttaaaatgtatttagaatgatctgtagtacctaccaatagtgcgaaatcttttgcaatgttaaactactagcggccgttggttatgaatgctgtgtatttttacaaggatttcccctgttgatgtgatattttaggcaatttccttctttaaaaaagggtcatatgcttagccaacagcttcattatgccaatcatgcctcctttagttgcaaatccaagatagtcagaacttaaatacattttattttacagcaattccggataaatccttgaagcgcaaattatgctgtatcagtattaatctataaggcgttttggataccacggttttatcagctctgtagaaatacattgttacattaaaaaatgctgttatttgaaagtaaaaattactataaaattattgctcaattagatattatgcttctgcacacagcctttactctgcttcactaatttattttgcagacaactgataaccatagcactctatttgcatacaatttgcctaatatgtggtgtgggttacatcgttaatttaacagacattgttataattaatttcatgggtatagttcaaatgttaaacatatacaaggtattaggtttttagaaacatgttttttatattaattccggtttaatcttatgcatatgcaattgcatatttaaagggaatggactcttttatgtttgatttctttaaaaaaaatgataggctccctcacccctgtgggaggctttctttttcttatcttaaggaaaatgcaaaacctttttttcctccagatccctaactgagacacatcagttaagaagcatagacttggacacttcgtgaatattatgtgaaatactgattaattagtgtaacgcatctgcataaataagcctgtcctttccctctgtacatgatccaggaaaatttctccttcttactgctcgtgagtggcacacttcgtgatgcatctctgtttataaacatttgtaatgtggttgtgcttttgtgttttgtatagctccacagagaaaaggaacataaatgtgacaatagtggatgaactaaaaagcttgacattgtcttgagtggaaattggtacctttcccacttctctttggaagtccagagcatgccagttacgtgttcattatatgtttacttccattccttgggagtaaatagctacttaaagtgatggcctccactccccacgcccccaagcccccaggagggccaagaaaggaaaaaagaccagcaaagttaacgatcttatttaccttgaatttattcttaacattcacttatggaacagtaagctctgagctgtctctactgcaaccctagatgtctgacaataaatggatcaggacagcttaaaaacaaactcattttcctagacataatgaagaaagactttacatacacaggcatatgtgttatttgcaaacacttgactgtagtaaacaaaaagtgtgtgcccatttataaacacacacatttgttagggcaaatgcaaatggaaaggatggggtactaatgatgctgcagtgtgcatgttatgtgcagtgttttggaatgctcacatgcctaatggaacataccactggatttcacaaactgcaagaataacttaatgggtcatgctctggactcgattaaagggccaaagctcaagttctttaagattcttggatgaatgagcaatgttcacctgagtctgaatttaatataaaccattctgtgaaagaaaaagatggcacagatgtctgtctgtgtgcatgaaagacatcacttgctcttaaagaaaaagataaattaaaaaaaaatcaaatttcttcatttaaatcattccatagacttgtttttggtaaccaagtaaatgaatacttgaggtgactgaagatcaggtaatgatgtcattaatccccatttaagagggaaaaaaagcaaattcagagggcctacaaaatgtacagcctttcagttctgtaagcacctcccacccagtattgattaggtattgctttgtgacaagccaaggttctttgtggggatgcttaccttttcttcattggaaggaaggaaaggaaagaaaagaaagaaaatacagaaagggacacattcttaaaaaaaagaaaagaaaagaaaagaaaaccaccgtgatagcaaaatcagaacgttcaaaagcctagttaaaatcgtagttaagtgactgtgacagtggctggcttctcaccgcaagggacagcatcaattgtttgtagtttttatgtgatgtctcacaaatagcctaattagaggcaagcttgcaaacgggcagttatacaggaagagacttaaactcactaaactgttatataaatagaaagttcaaaggtctgtgtggggctgtcaaggctgagaaggggccatgtgccggccaggcctctcctcctccggtaaaggcagcccccagggcctgccccagcagtccgaactgcactttccccagttttcttcgaccttgcgagggcggggcagtgccggagaaggggcggggggctgctttctagacaaaagtgaactgtttcagctccagccgggcatggcccatgcactgcagcaacccggctgcctcctcctgttctgtgcgcacaggtcttccgaggcctcgttagctacaatcctccagaagagcggaacaggactgtttatggatgggaaggtgtgggagatggggggaacacaacctttgccaacttggagatactagggctgtggtggggtggggggaggggaagtcctgttttgaataaggcctagagattcccagcatttcttgttctctacctccatccatttatctttcccgttttccctctgtggtctcttaaaagggagactgcctatggtctgttttctttgctagtacagtatgcattctcccgtgtgtttgagcattcattcaacaaaccattttaggttgtgtttcttaagggaatgtgtgggtaggagaaatttaagttggtgaaattcactagtaaggtctcctccgcaactccccaaaccctccaaagaataaaagctatctcagtacatcttaagaggcacatctattggacacggaagaaaattatctcatggtagaaatcagtttaatgatacatgaattgttttgctaatgattcagtcaagcatttaacaactttaaaatatacaaatcaaggtagaaaatgactgcctggaaaatgagtccatcattatagacatgaatgagattccatacatttaagcatcctgtagatggatacaaattatattgtatttaaacatgctaattattgttgaatagaaatggctttaatgtactaacctttaacatgtaataaatgcccatgattcttagctaagattattttgccatgcaaaatttgcacttatttaacataatttcaaaattgtagaagtccaatgaaatggccttctctggaacaatttagagctgtggccttaagagcttgtaactgtaggtcatacctcaaagcggaaaactgccatatacttgattagcctgtcacgtagacaaaacaatttttgctgcagtgactgcatttttcacttgtaattttgtttttctttttctgattgctgttggataaagagagatttcaaaaacttgcttactgataaatggaaagaaatgttactgattaaagaactcaagaccaaacttgaagaaacctttttgagtgtgtgtgtctgtgtgtgtgtgtgtgtgtgtgtgtgtgtgttacctgtggtagaactcaacattatcattgctactataatttgagtgtttactctgtgccacaagcttggactaaattctgtaaagactcaatttcgtttaatccttccaacaactttctgagataggacctgttatgatccctgttttacagatgaagcaatgaaatcacacaggtactcactcagtgatgcaatccaggtttcagcatagatggagctgactccagagcctgcatcatcaacaactgacgttttgtctgagcctttccaacatgtggaatgctcttccacatgctatctcatttgatcattgtgagttagaatgttcaggggttcttgccattttattgaatggcaaattcattcattttttgtgtggatccgaatatttatttagccgtcactgaaacaaatggattggattgtgtatattgtacttgtggaagaaatctgtggaattaccatgtaatttgaccagccatggaactctgctttttccttttaattagaaagagaacagtctatatactgatacaatctcttagcatgtcatttatggatgcccccttcatgaaaatgtgagaatggaaaattatatatatatatataaaggagacaaatctcaagtccttgagaattgttcatttaaatctgaatgctcaaattttgaagatttgatacttgaacataaagaagaccatggtatattttttggctcatttggagcctcaaaactggaggtgggaagttggtaacatttctttccaaagctttctaatcttaccatatgtattaattgattggaccctcacaataaccttaaagatttgttaggattgatattttagcttcattttgtagataataaaacggaagttcagagaggttaagttacttgcctgaatttgcacagtaggtgaatagtcttaggatatgtgtttgttgctcttttcgctgcatcaccactggtgcattaagttgttaatatttaaatatccacgttgcttcctagagaatggtgtgtcaccctctggcatcatttagcacagtgtttttccatcagaggtactcaataaacatctgttgattgatgttacagtcacattcgactcaaagactgttccatgcaaatgcaggtctctttcaaggatagttacttactaaatcctagtgataatactgtccctctgcctgtgtgattgtatattagttatttgtaattcttttcatgtctcttagccagtctgatctttttgcagaaaataaagagaataaccaatggatacagaagaagattaataggaaaaggcaaaaatagtatccatgtaattggcatgtttttaagaaacagaatttctatgaattccaagatatgtttagcccaaaagaaaaacaagaggaaagaatatcttttaaggtacagcattataggaattaacggactggtattgtgtctcaatctgcattgagaacattaataaagaatgtgtaacaaaaatctgaggaaaatatgagtggtcggagggttgggattcctccagctttccttgagtttcagtctttatgacttgtatttcatcatgagaaggctgtttttctacttaactgtagcagatccacaccataaattatcatgactgttaaacaaaggtccagccctgggttcttctaatgtaaaacttttatgttacactttaatgaaattttatatgcatgttcaaagcaaggcacactttacaccgtagagagggtgatgcactgaattgttgaatttattttgaagtaaatcttttagatgaccttagcgtctaacatctacctacttactgagctgaaaaaaagttatctgagagctgaaaaaaatgacatgatttaagcagagctgacaatagcactatagctagaatgtgattttgattatggattgcttactttatgggatgctgtttttcaaacatacctgtgtattttgcttcatttgaaaaataaaatcagctaatgtttcaaagtaatcttcgatttggttcttcagtaggtacgttctcttatatgaaggtgtaaaagccacactttgaggattaagctaaggaaacaagctttgttttcattacaaaatcaaaatcactcatctgtttatttttccaatgcttcgtttgttggagaaataaaagacattacttccatcctatggagaacagtttgttttgttagatttccaaataatagttctctgcatcatctaccatcttcaatgaaaaccagatctcagtagcagatactggttcacttggtgacctttattaaaccattttcctggagtcagtttttgtgttttgtaggcaacgtatctcctggaaataaatagctttgaaatggtttcttttttgtataagtaaaaaataatatgctacttgttttgtagtggtgctgaaattgaaatctcagctttaacaatcattggaagaagttgcttgctaaaattgtgatgtcttcttggtgtttgggtttctagtatggtttgatcaaaccaaccaagcagatggaatgtgttgttataaggtcattttaacctgtagactacggcaatatgtacatgacaacctgactatctgttgaacaatgaaaaatgcaattacgtaggctttatttcccccttcaggatgtcagccaacaaattttttaatgaattaattttccaaaggactgattgttttcatgccaggtcggcacaaccacagtgactaaattagactcagtgtgatggatgtttctgatgaagtgccgtggagaggtctcatcaatttgctattatttatttgctgccaaagtgcttggctttggtgtgtagacgttaatcaggtcgtagaagctagagttttaaggctggagggcccctttggatcatgtgatccaaactcctcattgtacagataaggagactgaggcccaggatgggaaaatgacttgcccaaggacatccagtcagtaattggcaaagccgggtcaggagcccttgtaccctggttcagtgtttgtcatctctcaagaactgtttgtattgcctacctactctgtgcccaacactctgctagtcagtcatttttagggagagatgaaaggaccgtagaagatgacctctggcctcacagaatttacattggaaagtataattagaattagggaaatactatgacatggactgtaagtaaaacaggaattctgggagagagagagaatgcaagctaagtaggcaaaacagtcctggtcaaggcccatgaaactcttttattactattagtgcacttcagagtgaaatggaaatccagaaatttttattgtttaggggacccggagcattgaatactcaacataagacaattgactttggaccctgaattatctggtttgacagtagctcacattcatcacataattgcctgagtcctcttttgctgtgtgaatggagtattctcattaacacagaccaacatttgctgagggacaaccacaaaagtctcccaagaagagctttggaaacatttgtgcaaacattcttcaaagaaataccaaatgaaaatgtgttttttttctgaaataattgaaacaagtgtttgtaaattggtacaattgctagcaaaatggccatttttcaaaagaagggtatactgtagctcttgagatgttcacaaatacattgtttcttttgctctttctccttttctaaaaatataattaactgttttgtttgttaggtgtgtaccaacattttaccattagaatttcttttttcctaaaaagggagttggtgccttcgtactgtgtgaattgtgttgacatctgtgtttacgattagctgtttggccaccaagtaattctttgcctggctatgtcattgttcaaatctcaactctatctctgggaagctgctagtgagcagcaggacctcctgcttcctccgtccctcaaactcccatactcctacccagtctgttcagatgcctctcctctgtgctttcataccttcctgagctgacttccacctgggctggatcctgctttctcccttccccaactcttcccatgcaactttgttgttgtgaaagatgagaatgtgtcttttatttttgtgttcccagtccctggcccagaataataacctaatgctgccagttcagagtgcagcatcattcatttattcagttcattcaggcactatgctagttcttcaaaatattaaatctagctgagaagacctaaaaacggtattaatagtaataatttaagctaataattacaggtaacatttcctatgttacaggttctgatttgtgttatccgatttctctattaacagagcaggaaactgggacagaagggttcagcgacttgcccaaggccatactggtagtatgttgctgagcttgaattaatccacaggccatgtgaatccttagcttctctgctaatctataaggataccctaggatagatgctatactagtggcaagccctgcttgtgcttgggctctatagtagactgggctaatgaggactttaccactcatccttagtatttacaaattgggtctaagttcattatcaaatatgaggcatgactttccagatatctactccaacaagagacacacaagtctgttcctctttggtgtaagtggcagattctgatcttgggaggaaggtatactggttcaaaaacctgaacctaattcaaacttgacaagaatgtgagctcattaagggtggagagttttgttggttttattcactgctgacactgcaatgcttagaacagtgtgtggtgcacagtaggtgctcagttattttttggtgaataggtagatggaatgatagacaaaaacctgcttaatactttgtgtgattaaatttgtgaagagatagctcaagaggtgtaagaatgaggaccaagagaagtgctaaaatcacaatgagcagacaggtgggtacaggtaggtgtgttgccttgccttctgtacatacttttctgaaataggatgcttatagaaatgttataaattaaatgttctttatgtgcatcttacttgccaggaataccgtagggaagtctttgttgatgagcaaaatctctcccaaacagccctaaacttatcagatttgtgtacagcattttgagattttagatttttgtgtacagcattttcttgtcatgaggtatacctacatttaatatctgcaacagtgctttaagggtaattgggcagccttaaaaaaaaaaggtgtagtaacttgttaccatccctgaattgtagctttcatctagtacaaaggggggataacagacttcaacatttgctgagtatttttctccgcgcttttgtaacgttgtctcctcttagctagatgcccgtttgcttaatagttcccgctttggaggctaacctgggatttgaattttcctaacatatatttttacattgaacacattttctatttatgcctctggaggattcaaattacaatttcatcccaaggatgtgcagaaaagtttccacacgtgctgattttaaagaaatctataagataatttggtagggaaagaggattagcatttacagagcattatggcatatactttacaaacatcacctcattgaacaaggaccctaaaaaataagggttttcacccccattttacagacaagaaagatgagaatcagaggggtacacccctaactttctcaaagtcacatgattagccaacagcagagccccaagtccaactcaggtttcttgggcccaaagaccacatcccttctgctataacctgccttcacagagttgaagatgagctgataatagagtttgttgggtaccttcaatgtactaaaagtaatgtggaaaaacacccctgaacattattttattattttcaaattgcaaaattaaaggtgtcaggatgcaggtcaggaagacagacagaaacatgagatgacaaagaaatttaggaaattttagtgggagtgaaacacccagccagttaaatgaagcagactttaagctacatattaggaggacagactgtagataattaatgggtctttaataaattgggtctcataatcagaaatgaaacttatctgaatattaattacagatccagaaaaaatgcaagagccatgatggacctttttaaaaaaaataacagttaaatgttaactatatctcttttgctacaattaggcattttggccatttagttttgaagttctgtaacagtttaaacttcaacagtgcaaatatattcagactgtaagtggtaaaacttcctgtcaagaatgatgaagactgttttcattgtattctgattagcatcatacttagaaactacagtgaaatgccaatgagcactctaatgccattgaaaaaggacacccacgacacacgtctgccatacatactttggtaaacaattgcagtgactcatataccttgaacaaaaaatagaaatttgatccaacctatttcaaaaggcttgaaagttaaagcgaattctaaatgtagattagtagcaaatgatgacagccaagccagcattacctcagttgattaatttataaggatattggtcaatgattttacccaacagctacgcatagtagaatcctaatgggatctgtctgttaaaattacataaagtagggcatttgatttatttcatagtttctcagagctcaattttaacttcatacaaataatgcattagtcacccaggataaatgacatgctgaatacagttgtgattttgtctgcttctcataatcagatttagcaaaggattacatctgtctttgtagtttattcctatcctaaacatttgtaggtagagtgggatcttttctcttgtttcatatctcgttagatgacatcggaccatccagccctttccctgcctctgggtttctggagtgtgtaaggaagattcactgatttaggggtagtactaagaactaccacatctacagtgaggcacatagaagggtttaaagacgttgctactctaaatatatcattaggagtatatcactatctatttatatattgctgaacgattttatttcatttttaagatttggttacattcttaaacctggagtacatattattataaagcaaattcagtaaaataacactaaaatcattcaaatgcgctaaagcaggtgaaaatgtggggatcaccaaactttgcctacgtgcctatactccaaaccatcatctccctcacccttgaccctggggttgggagagtcttttctttgtgctgtgaatgctgcagtagctgctccagggatgtacctctctgagccttacagtgtcaacccaaatgtgatttcaatgccaagacctggctgacttttacactctgatcaccattatttctgtcttttagtagcttcattgccttaatggaggacggaaaggtgagtttgcccaactgaaaaactttgaaatctgttcggcctacacttgcacaccaaaattagaagaagggggaggttttaaattcgtggctggctggaaatatgtgggtttatatttttaagatgtaaaaaatatgattaggagaaagttctcagaacttcatggacatcatgtaactcttagaaagtaaggtaaattataaaatatgggataagttttcttaaattgaacataatcataaaaattcaaggcaaagcaacatattctgcaaaatttatgagatttgagggtgggggaagagtttgcaaagcttgacaacctccagtgcatctgacctggcacattcctgttggtaatgagaaccttatggggtgctgggcctcggttttcttaggcagggcctgctccccaagggtatcataaatgatacgcgagtcaggaacttcatggctcatggtatttctcagggatattttagttaagctgtcccacccagctacagtggcagaagttgggaagagggcccactcataaatctttattgaactttaattaattaattaattatttgccattgttcataggaatttgaaagggaaagacatattgaataaccatgcctatctgactttatagaaatggtccaggttcttggggttaatgtgacttttattatttgataggcacgcatttgtttaacaatgacaataaccggaaaaccacagaagtataaataccagtaatgaaaagttcaatgcaaagaggaaaaaaaagaagaagaaaaagtgcaatgccaaagttagggctatttcttctggtgttttcttatgttttgtctttccttttctttccttttattcccacatgccgtgaaagtttggagttggccacaatctcatttgtgaatttgggccttccactgtaggatgtgtagggtggtcagtcatgaaatgtgtatttgtaaatacgtgtttgttcaaagcagtcttagcacccggatttcctgaacatagttctgatatggctttattctcaaaggacttctagcagtgatgctacattttggtgttgaccgttggaggcaaggaaatgtccaagttgaattggtctatgtgatgttgatcctttaactatgagtgtttactgccttccctgggaacttggagcttagccgactttaacagccatagaagacaagcctgatgttacttctaaatacacaaccctcagttctctatcacctaccctcctctttcactatcttttaaattcctgacatttattcatataaacagttcagtagttactgttttatttggttccttgaataggtctgacagcatttggaaaaagacagcttatgatgtgggcatcatggtcttatttcactgtcatccttttaattgtattacttacatctgataaattttcagattattttctaccttttattactgatctaggatacttatggcagtgttttgaaaggtgagaaacacaacactgctttctgaattttttctaaagactatggtgcattttatgagataaatgtttaaaaggttgttatgaatgagacagcctacactgaatgactgaggagactggacagaatgaaaccttattttaaaggaaaaataagccatttttaccttccgtaagtttactttgaaaggtaataaacaaattgtttcctcactggaaaaaagggaggaaataacatattcgggaggcagaggcctttaatatcttgcaggctgtttgactgtattctgaatttcatgtccaaaactgtcgttgctaatgtagacttatgaaccatcatttaaaaaaatccaaggaggcatcttgcatttaaattgtagaattattagaccttaattttcaatgaaatgaaaagacactagcaattctagctgttttgctttagctaataaagccatacttgtttctatttccagtgtcttatttccaggaagactgaattttcataaataggcaatggataagcaagccttcttagctttagtactgatactttgtatccctccattatttattaactggacaattaaggccctctgtgagatacattttttttcataatgatagtctcccatttaaaaatagagttgtaaaaatcataaaagctataacgatataaaaagaaatgtgatcaatttttatgaatcagtgtgaactaatttcagtggtgtgcaggcaaaatggtgaatgcagctatggctcagttctcgtgcaatgtatgatgtgtaaagaagaaaggagaatctcccattggttctttgcaatggttgctcctgattcatgtcccagcagtggtataggatcttagaacttcagatctgtaaaggtccttaagggggatgagagtgaggccaaccccttgttcagtctccccacaagtaatcatccagcttctgctagccaaaaaacaaaaacaaaaacataatgagaatgaaactgcctcctatggtagcaaatttcttcttttttggataggtcagaacaaattccattgtatgtgggcaaagaagccttctttgaacttccagcccttggttgcagttctgccctggagaccacacaaaatagtctaagctcttcagttcacgtcagccctcccaaggtcaaaggacagcttgcctatctgtgttcgctgtgttctcattttttagggcaaaacgtcccaagccaagcttggagagacttcaagaaactctgtctagatatgcaggtgggaggtgactgggccctaaaggctctaactctatttttaggttacatagagcagggagaggcgtctttatctcctgcatataaacttttttgagggaacatgggctgagaagcagatattcaacatccttttcccaggaaaacacccctccggatatcctctctaattgccacaatatgagaaccccaaaagatcaaaaggctaacaggaacgtttccaggaggaatcaaataactaatgttgaagcctgatgcttcctgtgaaaccatacatctctcactgtcaccatattggcatatacttggcagatgacaatggccctcagagttgagcaactactgcacgtcagacactcatctgaacactttccatacataaactattaatacttccagtaaccttgagaagtagtaggcaagcttattgccatttttatgatggggaaattgaggcccaaagaggttgagtcacttgcttaagatcacataagtaagtagtagagctgggatttgaaccctggcactgtaacactgaactgtgatacagcttctcagagataagtcttgagatgttgctcaacgttggccccctctgaacaagctactacttggaagttatgaaaagccactcttctggctgtgaccatcgtttcatcctgtaagggggagattgggtcctagtattattcattccactctaatactacatcattgaatagctacattctctttgcagtctatttggtagccgagcaccagctttgtgatgagtgaaatcttaagtatagtgcctcctgaagagaggaataggcattcattcattcgttcattcaacaaatatattctgggtgtctaccattagccaggcactggggatatcatagtgatatttgtataaatggcccctggagtcagaccattaaatacttaaagtagaacaagcagtgggaaaaagtccaatgtttttctaagatgccctagatcatatctgaaaatccttctggtggcagagattgtggcactttaagatgacaaaaacagatacccattgcccaatcctacccagccttctcttcagtaccactgccctcgttgcttcatgctggagatttatgtgaatgagatcagcataggagatggaattggtcaaaaccacagcaaatccaatttcaatgaaagggcttgagtcatctgtcatataaggaaatgcatggcacagggcatctggctttctttgtggctgccaggatgccaagcggacccaacactcccttgaatgattttttgtgtctagtactcatttttttcacttgttgtacaagaggcatcttaagtcaaaatctaacccttagtacattgtaccacattgttgattactgcaacctttcagtcattattcaacaaatcatttcttgtactgcactattgattagttattataaaaccctgaattcaactgtacagtattggttctttttgccaaagggactctaaattagaaaataattttgatggctgggcgtggtggctcacgcctgtaatcccagcactttgggaggccgaggcaggcggatcacgaggtcaggagatcgagaccatcctggctaacacggtgaaaccccgtttctactaaaaatacaaaaaaaaaaaatgagccaggcatggtggcgggcgcctgtagtcccagctactcaggaggctgaggcaggagaatgttgtgaacctgggaggcggggcttgcagtgagccaagatcgcgccactgcactccagcctgggcgacagtgcatgactccgtctcaaaaaaaaaaaaaaaaagaaaataattttgtcaaatactattgtcacagctattaatggggcatcccaagatgaatagtttcttgctaccaaataccttttataaatattgcgtttagaattgagtctagagattcatcttgacttggggggaaaggtctattaaaaggactttatattccattttgctttggtctggtcttggcacgggagtgtggattttgctaaaaaaaccaaacagagccagctgttttcttccagagagccaccttgactatcagtgtgggtgtcagataacagcctttgtggtgagaagtttattgtatttacttgggcggtggtctctagtatttgcagtgcttcattggcatagtgtctcacttctgcaagagaagttatccacgaccatgggtcatttactgtctgtcaggcgagacatttataaaccaatgtcctttgtgttctgccctgagcaatgacccctcatgggactgagctttgatggagaaaggaaaaagtggtgtgttgtgtttggtcactttccgcttgagtggcagttacctggtaaaatttaaggtggaggagtatgcatgtcttgtgtttaagcaaagactggatgacccttattaggaatgttgcagaaggaattccagcattagataaaggttgaactagatgacctttgaggttgtttcagctgctgagtttttatgatgctttaaaatcccttaggagaaaagctgcagtgtagaccattggctgtgaatcccaagcttgaaattgttggaaaatgatgctcaaatcaaatcacattaaattcactttaaagtttagaaatatatgacttaacaatattttgtctgttgttggttggggtaaaggggagaataggaggaagattattgcaacataaaatacaacaaaccatgaaaacagcatcatacatcaaaattaaaatttttttctcaaaaaattaaaaggattgggaatgactgacctatatattgccttatttttctttttgtctcatttgtgagctcaacaactccagcgtattaattactgttgcctcctattgtcattttaatggcaccttatataaatagaggcagtgaagctagttgctactctcccaacacaccccattttttgcatttctgacgtagtgcagggacccttctccatttggttattggcctgcttgttacagaagtcagttaactattcttcaggtcagaagtgagatgttagcattctcacaatgaagaatatatggtattctccctcttatctactcactttctgtgtgtttttaaaataaaacctaagcatcttctttgttcatagcataatggaataaatattacagtctttgaacacattcttcgtgaaatcacttgcagcaatttctagtgtttggtttgtactagacatctcccactcacgtagacatgaaaataatacgaagcggaagaaactacaaatgaaaaaagaaaaccagaaagagtgtttacaaattcagagaagaatctaaactattcttgtgcttatgcattaagggcacatactatgcatgtgacatcatttaatgacattagaatgtgccattcggagacccgaggaaataagttaataagaatgtttacctgtgcatatatacagtgtgtatatatacatacatatgtacgtatacatacacactgtatatacaaacatatatataagctagttgtagagtctaggcttttgtgaaacttaaactcttaagatatgtggtcctaataccccataccacctctccccactccatatatacaaataacctttcttactctgttagcctttttgtctggttgaaggctgttgtgtctaaacatattatgacattttgttttaaacatttttttagaataaaataattaatgctagctgccctgaagatttgtgcatttaaaagtaaaataaaagtatataaatctagtttacatctgagatgtttcaaagagggactttaactatctaacaatttaaaaacttgcaaaatcccttaatgtccaagatggacacacccagctgtattctgggcctgctgcttgtctagaactattttcaaatgcttttggattcagtgaaacccgaaatgcatattgcctcaagccctttttccctctttaactttgagacccctgtgtatttggaaggaaatgaaatacatgtgtttctgatttatttacactcatcaaaatgttttgtaagagcatttgatgttctagaagcttttgtgaatttttgaaaataaacttttgcaaaccttcatcaccactctcactgccgctttccatgaaaaagtcatatttagctgagggtaaacaaattgaaatgcccaccagggttgagttcaattctttgtagcttaggcagagtgtcctgggggctccaggtggtaggcacccggctcccacgtttttgtgctggcgtaactgggctcagcaggttgcaatactcttctggttcttcttaacactggcccagctgttctttcttttggatgcaatagaaagaatttccaaatagatttaaactgaacagagaattgactcctgtaaccagaactttcactgaactctgtagaagaaaggcctttatccttatttgttatgtgaaataaaatgtcttaagtgggaataacttccatatctcacagtgccttttacttcagactttagagctgtgttaataattttaatcactatacctacagttcctttttctaaaaaaaatattaaggaatctgatatacagtaatcagaaacagttttgatcaatctctttcattgtggctggtggctctagccttttttgtaaagtaatttgtttatgcttacaattacaaagtgctctaatagccttattctataatgacccagacagtgcctctgagaagaagtctttgtgtggaagtcaaacagtttagtggagcataaagacggcagacattgccaaggccaggaaagccatttatcagtgcatggcctactatgcactgaaaatgaacttggatagaagctaccttaagtctacttccttctcacaggggtttggcttgagggaagcaggctttcagggttgcagtcatatcagtgcatcagtgggtcaccaggtaccatttgtgtggaggctctgataatgtcactgtcaccattcttgcaccctgtgacaacacagaggactggccaattacaaacccaggaaagctcctagtaattattcaaattcatggtacattcaggtataacttacaaactgaatgtaccacattcaggttccacaggtacctgaaaagcacgtgcatgcacacacacacacacacacacacacacacacacacactcactgagacttttgcctggatcttgcaaaaaagttaccctaaaaaataatatgtctacctttggtggtaactaacactgcagcacatttcgtaggaggtagtttttgttatcaagatatacttcccctctatctcataaaccttaagaaggtattagaaacaaattacattgcatagtttatatatccatatctccaaggatttctatatgtcaataaaatgccaatcatcagatttgtcctgatgtgaaagtcagggacaaaatgaccacctagcttctcagttgaggctacatggaattacgtatgaatatttcagataagatcagatctgatcataaactcttatttttgtagcatgcaagtgtgtggataatgtgtaaaaaggaagacataagtcaaatgtgtcacatctgagactctcttgcactgagattgaaaaggcattgcgtccatgaaacagcccttgtgccgtccaaaagcactgctcctttctcctcagttgcatcaaatttctgtggaactcataccattgccagattagggcaatcaacaggggcagagaacttcaaatgaaacttccgccacagtgcaagcatttgtcaccatattgtcggtgagccaaaatctttcccctttgtgctgatggctaaacaagaatactctcacaatctcccctgttgttctttttctaagtgtgccctgaaaaagttctgatgcaaaatagtcaaatcacggctgttacttgcttgccacctgtcctgacgacaagaggaaacatgggttgcacctactggacctaaagtcttcacttcttctccaaggattgcaggtgtacagctcactatatttaactatgcgggctgtcccagagggggcttgtgcatgcatttgcatggggcagaatgatcagctcttgcctccagtccatctggtgatagggacagtttcacattatatgtgtattttcgggaacattttgtattaagaggtgagagtggactttctgggcatggaattgtttgtttatggaaacaggcatacattgtgtctacaaagcaatagggaaaaggctttgcgggaaaacttcagtcccttcctgcttagggaacatgctgtgggaaccttttaagtttttctattcactattttactgttctaggtctgcattgagtgggagttaaattttaaatgctcatcgggtctttgcaaagccttttagtatacaattgctggtacagttgcttatacaattgtacagttgcacaacgattacttatgattgatgtgtatttagattggctttggctaggcaagagtggtatcacaaaaccctgctccagttttgaaaaaaaactactttattaatatattcctatcttgttgatattgtcatatttatacgttcatttcttgcaactaaagccttctggcacatccatttataaactattccaataacttagtataaagatctgctctacgtgatcacacatgtgggcatgcaaacactaataaaaggagaaactgaggcaaggaaatcatgcaaatttcctgaggtcaaattttgtattgtgatagtactgagaatacgtccttgaaacaggaattcgactccagtgactaaaacacttgctctctgtagcatctttgtgaaatgcaggggtgagatatatgcatatatatcatcttcattaagaggaaagtgagatatttatggtagctgctaatgttaatatcaattttcaacattaataataaaatgagcagaatgaagccaatagatccaggtcctgtatatgattaaatttatttattttcatttttaagtgaaaatgttaaatcaattgcatgatttcctttgaatttgtaataatgacattataaaacatatacatgtacatataccccattcatgtaattaaacagattcatcaaacatattgttgaaaaatcttggaaatgtgtgggacagaggattaattaactcagaagcatgtaaactctaaaaagtttgttaatctattttcattatacatatgctctccatgtatgatttgtgacagcttaaggacagatggccgagtaatttacaactctgacttcaattatataccgtgttgttcaaatgaaaatagctctcttgcagcatagatagagatgttagcaaccatttataagaagtgtttggaaattaggatgaaagacaaagcctgctttgtttgatttcatgcaaaaaaatttagaatgcctgttcataaaataatttccaaatattagtctttagttcttgacagtttcaaaattgtgcaagtgtaaaatggaattttaactgcttttcttttctctttcatgtagttcatagcagatatttcaacactgtcgctgctccagaaaatccttggatccagttcctccagattgagaaaggaatgacatactctttagggtaatcgtgtaggcagggatgaggagaatggttgaagagagaattctgtgttttgacttggaaaggcacccactccacccttgtattttcaaagtggctcttagatgtcgggcagtatgattctcattcaaagcctggaacaccaaagaagaaactctgcatcttgccacttaaacttactgttagcacttcggtactgatgtacagctttggttgaagcctctctctctctctctttctctctctctctctctctctctctctgtgtgtgtgtgtgtgtgtgtgtgtgtgtgtgtggtttgaaaattgtatcccccttcagactataacctagtcttttaatgtgcatgagaagggtaaaagtaaatatatgcccctatagagaaaaggaggtaatttatttattgcttttccatttttaatttgcccattctaaacaatgttccagaaggatttgtatgacttaatactttccagaaaatattctgtttttgtaggctaatggttcagtttacttctcatttcttcattgcctttcagataagtacttccacaggaacttagcattaaaatttgccttttcaaatgtaccatatggaattcccaaaggaaataatttttaaagtaccagtctcactcaatttggctgtagagctgagttctcttcctctcacaacccccttccccaatttaaaacattttcataaactcagaaacagaggagctaacaagaatctctggatccattaacattcagtcatgtagaatttctcagaatattcccatcttaaagaggatgtggagacaacatttgaatggatgacattatgtgtgtttcagaagccaggtgtaaagagcacttttccatacattttatatctgagttaccaatgcctcatcttccagagagcaggcagtaggcggcatgtgtgtcctgggacactgagcttgccttcctttactaagggctgtaactgccacatcaccatttggagtcatgacttgtaaagtactcagtcttatttgttgacaactgttgtgggcacctctcccttttaagtgttctaaaggaacaagttttgagaaattaggtcagttgaattttctaatatttttggaatgtaaattaactgtacaaaaagcttcaactgcagttgtaattgtagcttgttaaaaatgaaaaacagagatgtcagaattctattaggaaaaaataattatagtaatattttcctgctatattgaccctgctaattgtataaaagaaagtacattcaaaatttaacttatgtgtacgtgtgtgtgtgtgcatgtgcaggagagagagagaggtgttagagccaccagtttgctgaagtaataactttccttttcttcttttctataaccaagcataatatataaagagagctttgacataacatttaaagtctaaactccagccaatgtcaatattatatagcaaatattgactttaatcaaaaaggtctgactgatgttacagcttataagaacaaacaaaattgtaacacttatcattaaattaccactatagaaatatgtagatgataatctcagcccagtgaatgagctgattctcaatagataatggtcccattagtcagatattatcatttagcttatctatattacttagaaatagtttatatttaaataaccagaatagaagacttcataaatacacattaggttgtgggctatagatttcaacactatctatctatagataaagctataaatagatgaatattgaatatagtaatttaacacttaagtaattttatagtatcattaaaaggaatcacacttgagccattaattgtaaggatttgaaatgttagaaaaaacagttgtgaaattcacagagaaagacaggaagaacattctaaacatcatctattttggagatggaaaacaacatttgatttcatgtatatataatgtatcccatagtagggactcagtgtcagtaggctgagataacatacgagaaatctgaaagttctgactgctctgtgtgcttaggacctccacagggtaccagactttaccaacttcaggacttccactagtctgagtagccagggcacaccagtcacagctcagagagacacatccttaggtttgctgaaaacacctgtttctgagagcaatcatagtataatagctttgactcaataaagtgatcttccgtgagcaagaagatcagttggcagaaaaggaaaaggaaatgtggcacaaaaaacttggcactccactataagaaataactttacctttgttaattcatttagtcggtggattcttattttatttaatgagttataatccattactatcatcatttatttatttattgctaaaatttgaggtaattttagattcacacatagttgcaagaaagaatatacagaagtcctgtgtacttttatccagttttccacagtggtaatatcttgcgaaactatagtacaatacaatcttgttttttttttttttttttttttgatgcacaaattttcccagacttgaccagtgggagctgtttctagctggctcctatgtccttttgattatgaatcacttccttaatttctggaacaaaatacttcaggttcacctggtactttctctgcttcagccctggattcatctctcttagaagcctaatttcctttattggaaaatggtacttatagaacaagatatagaacaaaatggtacttatagaaaaggggataggtatacctttactaccggagtgccattatttctaggccatctcagcaaatagagctaggaaatatatacacgtacatgcacatacacatacatgaacacacatctatctctatttctatatctgttcatctgtatatacagcatattaaaatatcatgatgttataatgatctcaccaattccaataaaacaccacattccagtctttccccttttcttaccggtaactcccttctctaaaattgagaaatttagctcacatgatccacaatatacttagttatttagtcaatccaaatgtgctaacccctagcactgtgaaaaatcagttcaggtaagagtcatcaatggatcataaaagcagtgggtgaaagtttgaggagtaatgaaatatttacataatttctaagtatttccctacaaaatatttattaattgcaaggggaagaagtagcaaattggcagtggagaaacctggcagacaccaccttaagcaagtgaccaaagtgagcatcatcaggaatgagacatggagacctcctgtgcctcctgatgaaatgcactgaggggaacacaagatcacttttgtggcatttctgccaatagtacataatctggatttaactatgaggaaacatcagacaataaacccaaattgaggcacattctacaaaataagtgccccttttcttaaaaaaatgtcaagatagtgaaaaatagaactggagaagtgctccagggtaaaggaggctacagaaacatgaaaactaaatgcaaggcatgaatttagattggatcttggaccctttctttctttctttttttctataaagtatattattgagacagttggtgaaatctaaataaagtttgtaggttagataacagtagaatatcaacatcaatttcctgattttgataatcatattgtggttatgtaggagaatgttctttttttaggcgatacacaatgttgggtttacaggtagggggctatcatgactgccaattaacactacgtgaaagatatataggctattttaatgttcttacagcttttctggaagtctgaattttttttcaaaataaaaatgtttcaaaaaaacaaatgagaaatgttcccccgccacctcatcctcattctatgcattgacctttgtcatttcctggaccagtaattgggtcccttctaagtcacctgaaaccatcttgtttgcttgccctaactctagtactggctcagatgagcctgcctctgtacctctgtatcccatttctcctgttgatttctttcttctcctgacatcagaaaaccatttgaaggacagtatacacattatcctttccttgactctttttagcagctctccaatgaccatttgcctttagctgacccaagaaagtgatgcgctgctaaccataggtagtgtcctgtaattgcagatttcaactgttttcatatgcttagagtagcctaaggcaagtaacaatctgtgctaggagaagagcaaagactactgtaattcactttactttttaaatttacctctggaaaagaaagaacaagagagccaataaaacttgagggatttgttaatttgttaatttggtatttgatttgcccttacagctgtacctcaccttttagatatttttctactttgggaaaactttagcacactagtcaattatatattattttaacttctcgaggtgagcttctcatttaaagggaaactgagatcaattcttttgtaaaatcagtcatcacttcctactcttgttaaaggaatttttttctgtgttgatatgtcttcagttgtgaagtgcacatatatgttatagaaattctcatggcgttcctggtgttcagccttagacctttgacaaactcctggtaacatggtctcttgaaaggcagagtggaaattggggctaggcatgatgttatggcaatcatctggctcaggaaagcttctggaactagggagagaagtgccttcccatttacattttggattcactccagttcacattttggattcatttcagttcattaatttttttcataagcactataatactttaaaataataaatatttctaaaagaaacaatccgttctcaactcacttaaaccaatgtattcaaaaagccatatgaatgttattttcattcagaaaattacacatctgggtatggaatttgcttcaacttcaccatgttgagtataagtggtccctatttttttttaataaagggcttttctgtagttatctgagaacattcatacaaatttctttcaggtcattaaagtaaaaattttgatttaatgcggataagttattttaaagattttccttaagaaacatcttctgttttcctactgtgctcataaagttgataatcataacttaagttatattgatacaaattttgtcccagattccagatctgaaatatcatcaatcataaagatttataaacaagccagtaaaaataagcccatctgttttctactccaagggtgctaatggaggtgcacaccagtgtgatgtccaggacattttgtctgcctccttagttaatgagaaaatctgtggtagcccagtgctggctttggtaggttgagggagtggactgccatgcatgaccccatgacccttcccattccattgaagtttttcttcacccatgatgacatgaggcagtgtgttatcattaaaggaacactgagagcatctatcaggcaccttttttgttcctatgcaatggggcctttatgtacaaaaacaaagtataggtcaacacagctacagcaactggctaatcagtaaatgagtagattgtgcttgtgttgacatttctgttgtcaacctagtcatttgtttgtttaaatgatggttgttaacatatcaaaactaagcttgagaaagtgataaattggatgcgtgtttgtccaatggtttctgatgcaacatgatattttagcaaaaaccttctgatgtgcgcagattctccgatgaggttcaaggagtaaataaattattctgagggtaggagtactcccaccacatggcaacctgctttgaggcttctagcaccctcatcaccagctttccaaaccaaagaatgaggcttctggaaaacccacccatattttactaagtatcaccagatggttgtaacgattattaaaacaaaattggaaatggttttcctctgttgttgggaatgaagtgacataagtggctctcttggaatggctaaaatgataagcagcaagtgggtagtcaggagtttctggaggtgccctgttgcccatttgaatcttagcttaaccatgtaatcctgcgactttgggcaagtcccttcccctcttggtgccctggtttccttatctgtaaaaaagggtggttgtgcttatcagacaggttaatatgtgaaggggctgagaagagtgcctggcatgtggcaatacctgtgcctacttcatggggaagtcaggagcattagatgacttcatgtgtgtcaattatccaggatggtgtctgactcatattgagcacccaagaaatgttatatcgctactgttatcattattgtcattctcaggtcatctgtgggcagatttgccagccttttccattgaagagcagatactcaatatatggtagctattgttaatattatataatattatgcctggcacataagtgctaaaaaatgtcagtgtcactactatttaaaattgttatcacatcatgaaaatgtccaggaatcttccatttggttgaattaaaacattttccaagttaggtgacttggcaagtgttgccttggggtgatttttgcagactgttcataactccagtctttcattcccatcccatgccttcctcttttgatatgaattaattctatgcgttgagatttcctaagtctggtggcaattcttgtaaatttgctccttttttttttcttgcttgcaatgtcttatatagttaagctgcaattccccacatcaccagcaggtgctgaggactaacacaaaatatgtttcattctcgaattttttaagattgggaagcttggaatttagggaaaaaatagtgttatacttaggaaatgagaatattggaaattatataaaataagttggactacaacaagtatatcctataggtatggtaccctgactattcttgagagagaattgaaagcttaagaccatcctgtttttgtctgtttaatcatttacatttagcacatgtttgggtggctctgccaggtgttcagctgagtgctgtgggaccaatgatgaggaaaaaatggaaaacagacattaactttgccctggctttttctcttttttaggcatacagacaggaaaaatggccagtgaattgttcattaagaaaaatataacttctgtttattaaaatggactttattaaaatatatcagaaaaatgaaagcaaaaaatatatggtaaaagtatgaacataacattcaaatgcatcttgggatgatgaggtagaggcaaacacaagtcttccccatcccccatctgacacagtcttcacaaagcactgtatttgccaggaggactgaatattcgccttcacaaaagaaggcaatgaaatttagtactgatccaaataaaatgaaatcccatgttccagaattctgaatatttattttaggtacaaggtaaagggcaggttggaaaaatgtggcttgtttatcatcatttcatagaagatacagtaggaaaacattcagcattatggaacacgagatttcatcttcaggaaagttgccccgagttctactgaggcaagaggaattcaaatatgcattcatttgtgcatgactatttattataggtaatgcatgaagtagaaggaggagcatgggacctctctgagcctcagtgtcttcatctgtgtaatggggttgttgtgaggccctagggcatagtgtaggtgaaaacgtttgtagactattaagcagcatacaaatgtggaagatggttaaggggttaacgttttcccaaatattgaatttatgtttgtaaatgtatacagcatctatctgtctatatgttaagttggaagtatttgtatttttattaccaggaatcagatatttgactattttaacagctacacaagtcagctggatttcctcagcttttatttttatgtatttgtttattttagaatatttgtatatacatatgagaagaataagtattgatagaagattaattatcttttttttaaaaaaaaagcaaaatattgaactagctccttcctgtcttatttgttcaagtgttgttaacattctttaatgggggtttttaatcagttcatcatcatcaccaaaagtacatcactgaaatctagatttagtaagccctactaagacagaacatacaaattgatatttgtatgttttcttgattcccattttgtgcaaggctaacttaagatgccagtgactcacaaaacatattgtttaaacatgttcagattgctaacagaccgtactgttatgccttttagattccaataaaccatatgaaaatgctaattattgagtctacattaatttgtataaattatgcaaattgagtagcaattaagtattactgtagttgaggtggattccatgccattttttaacttaatgttggactgacacagactccattcactaaaacaaattgttttattgttgagtgtttacaaagcaattgctgatggtaattggttgtagatgacactattgtgcatttcagtaagatttatttaaccatatgcaccacaaccaaaacacacaaacacaggaagaatggtcaaggaatgactttatgacagttcattcagaaaaaacagtttctgtccatgaaaataggcattctttaagaaagttattttagaaacagacaaataagataaaggaaatcacttggagagatgtagttaaagaacaattgaaagaagtagcatttagcaagaagtcaaggcatcacattcagtgttttaagcaggatattgggaagtaattataatttgagctgcttccacagtatatggatgagaaattcagccctgatttgttcaaactaattgtgtatacttttgccatggtgcacaatgattctatccaaattacttagacataaacaaatattgtaaccaaattgtgagcctggatgtgtgtgtatgtgtgtgtgtgtgtgtatgtatttaacagtcggtcaaacagtgtcttcatactttatcaaacattaattagctaagttatgaagtgttggcatcttgggagcagcttagccaatttttagtgatgtttcatagaaggctaattctggaagagatcatctcaatccattatgtggaaaccaggaatttgcagtcacgctctatcaccactgaacagaactcaaggtcaattatcttctgtctctgggattcagagtggcttttgcaaatgtaaaggttatgcacattgatgcaataattatgaaaggaaaacaaatctttcctttcaccaaaaagtgttgtgttaaagcgtgcataaattatgattcacaaatatagtaatggctttaaggttgaaatatggtatccaggtgattagtagattgtgttaacctttgattattatttttttttttgagacggagtcttgctctgttgcccaggctggagtgcagtggtgcgaccttggcttaatgcaagctgtgactcccgggttcacgacattctcctgcctcagcctcccgagtagctgggactacaggcacccaccaccaagcccggctaattttttgtatttttagtagagatggggttgcaccgtgttagccaggatggtcttgatctcctgacctcgtgatccgcctgcatcggcctcccaaagtgctgggattacaggcatgagccactgcacctggcccgataatttgttttatgttagtttctctaatcggcggtggatttggagaatctagattgatgacaagtgatcttcctgaaaattgaaccaaaataaagagaatatgttatgaaatttctgccagggtcatatttatgccattattctaataagaactttaataaggcaaatctagaaattggttttactggcttcataaatttgtctttcatagtctccaactcaattttcatttgctttgacttaaaatatatcagcattctgaaaattttgaagagtgaatcattaaattcaatatttattacttaatatcttaataataaatgttaaatctcttaatggactgtatttcaaatacagctcactaagtcctctcgttttcttttaaaaaccatacttcaatgtaattcccattgccacttttgccagacatcctatttccctggcaaatctattgaggaaaaatgaagttttaaagcaaggtctgtgcttggaaaatctaattcactctaactcactaggtcacttagaaccaaatgattcaaatagaattctacctatagcaaaacaatggaagctgtacatagggatgtgagtgaaagccttgctgcttttctcagatagggtgattggatgcaacagtggcccagcacttagccacaagtctgaagacccctgcctaggaccagcttcatggctctcggcaagctgtcaaactctgtgcctgagtgtcctcatctgtgactaccatgaagatcaaatgatacacataggtgaaagttctttggaatatgaaaaggatgtaaaaatgacaagaattcagacttagttaatagagcaaggcatttaaaagttggcatcacatgtttattttggctcaaactgtggcactgcatagtctgcatttgaattccagaactatccatgttgagctatgcaaccatggacatgtcacatagttttgtaggccccaattcccacagctgtgaaatcgtgaaaataacactatccacctcataaggttgttgtaaaggttgaataaagtaatgtctggcacaaaaaaagactcttaataaaggttagatgttactactgggatacattgtattaatgatgacagaaagaaaaaccactattcttattttgcaagtaatagaagatgtctgactaagctttatttctttttgtattcattatcttccttccagaagttttgatcctcaaaactttattgaattgtcctgagtatcccacatttgtccatgtagttttgtttcatttctaaatcacatatccaatcttgttacctgcttgctcaatagaataggatggctcctcaaatgacaccctgagctgtcgtataaggaaatgataaaaggtgtggctttgtggtcagagagacatggatttgaatgctaactcttctccttactcatcatgtggcctgggtaaagttacttaaattctccatgcctcaatttcatcatttggaaaatggaggaaatcatagcacctaagtcatagggtacttgactgtgaggtaatttacacaaggacttggcgaataatagtcactcaatatgagagctgctaccaccatcattgtggttattatgatgtgattattatgattattaaaaattaaatccaaactcttgaggctgacatttagaagccctctataatgcgatctacctttattcttttcattccttacaaaacagttttttttggtattagtatggcccaaatattgcatgaggcatacttatattagctaatcattcactatgtgtctgaaattcaaatttaactgggcgtcctgtgttttcattgactaaatctgtccaccctactcacacatctatacctcccaccagtacctccaccttacttcctgccaggggacagaaagacttccagaaaggcagagtttcctaaatttacccatttctgaagtctctactcaaggcggcattcaggccctgtgccgggcattgtaacaagaaatattttttattatttttctttatttatttttattaacatttgttaattcttacttcccaaatatgtagtgtatagaagattggtgggcctactcactttccccatggctatagccttagttaccccaatcactatcctgctctgcagccccctaactgtcatggtggttctctgccctggcttcatcgtagctagtggcaacagattttatgatggtgtgactcagcattggcatgttgtacaaagctcctctaggcaatgccgatgtgcagccagggtgctgaataattgctaggcttctgcttcaggctgttccttctgcctagagtgcccccctcattcccattcccacattttttctttaagaattcgcactttgggagaccaaggcaggcggatcaccaggtcaagagattgagaccatctggccaacatggtgaaaccccgtatctactaaaaatacaaaaattagccgggcatggtggtgcgcccctgctactcgggaggctgaggcaagagaatcgcttgaacccaggaggtggaggttgcagtgggccaaagattgtaccactacactccagcctggtgacaagagcaagactctgtctcaaaaaaaaaaaaaagaattcgaccatccatttagaccctaaaccatatcactttattcatcttccccagactcaacactatctgccttccatcagcaggcaatcttgtgcctggttgtgggtcctgcaagattgggaagcctggagggctgggggtgcctggttggattcagtgtcccttgccccagttcccagcacagtcccctcagcattgctgacaagccattgatagctgcccaattgaaatgactgcgatatagaggcccaaactttctatgaagctaatagagacagaaactcattataacttttctaagtacttgtttatgaagaaacctatgcagatatctagtaatcattttatcccaaattgagataactgtcaactacctgtgttgaaactttaataaagagaataataaatatcttcatagaaaacattaactattatcaagctttgatttttagttttacgttgctatcctaagtccggtaaggttatttcaaaacccatagaggagacattgaagtggcttaattatttaattagcagtagtgaactttgggaattttggtctctgtatgtgactcctagacacccattgtgatatctgcatttttgcttaaaatagattaataagccaataggtttttttttagaaaatcttttcccatttcagtgaacagtgaaatctgaatctatagcttgcaactgaaactatttttccccaaagccattgagggcttttactcagtctgttgtaaacaatttattggtaaagtcttagaatatttgcattttaattaaagaaaattttaattaaattctaaactttgctcagaaaaggcaagtttgggcagctaatgcatggtaagatgcctattcagagatgacttaaacttcaggaattctgtgtttggtgccatttaaatagcaaaggaatgtgtgtctttcttgcttaaaaatatttcccagctgcctttggggaccctccccaggagcatacaagaggtttggaaaagctacagactggttagatgttgagatgttttagacagacagagatggatacaacaaatctgattgtcgtagaggtggggaaagggttggtgaaagatgttgcttaggagagaggtacatattaataggtacaaacatttactaaacaccttctatgtgctgggcaccaagttaccctgaattcaaagatgagttttgccaagatgatttacgtggtccaggtataagttgatgagagagcctgctctgtgatgggagctgtgggaatggaaaggaaaggaggagaaatttgtttctaaattttgattttttaagttttttttttttctttctagctaatgcttatataattggagcctctcggatcctgccgttatgctctagggcatatagtttgcagtgtatgtttttgtttatttccaggaccttttaccgagatccattcactgtcaatcccctggctgcatgtgttacttttcctccctgctgcttagctcagggcttcccatagagctgcttcgttttgggaggtcaggataatgatgctgcccctttgttctgtcctcctgaaatgaagcgctgatagcagaaggtaaaaggcagtgggttagggagaagcagaaatggccccatcagtcgcatcaagattaaacgattctcccatctaatggtaggaaatgaggcgttttctgcgagccaaaccctgatagctgtgtccttgtggtgccgcacaggacgtgcgggggtgtaggtactttgtaatgaagcaagttaagaaatagactcagacgtgggccatccttcccctcccctcaagggcagacttcagtgtcattagaccaaccttctacgtagtatcaaaacctcttattcagaaacactgacgggtatttgactgaattcaagaaaatgtactgtttctaatcttgtaactgtttattaaggaataaaatcaagcaaaattatgaggacatgtattggatgtttccctgtgtgtaaggcattgtgcctaatacagttgttctcaggtataggtgagcattagagtcactggactggtagaagcgtgcagattgctgggcctcaccctagagtctctgcttcagtgtgtctggcgtgggacttgagaagctccctttctgacaagcttctaggtgaaggccatgctgccggtccctggaccgcacttgaagtatgaggctgaaggtcaacttacgaggtccatgctttcaaaactttaatgtacacagaaatcgttcaggaattttgtagaaatacagattatgcctcagaatatctggcgaagcactgactaaatttacctgaaagtttaagcaaagcctattgatttatttgcctgaaaattttgatttatcaaaaacagtatttaaaaagaaaataagcctttgatcacaaatagctactgtttcttaaatccttactatgtgcaaggtcttgtgccaagtgctttgcatgtcttgtcttatttagtcattacactaaccttattaaagtgaagacaatccccgttttacagatgagaaaactgagggctcagagagattactcaagtcagacagctaagtaaatgacagattccagatctgaacctaggtgtggctgattttgaagccccgtgacttttatactacactgtttctcttaatagctacccaagatagtttccactctgaagacattaatttgatatttaaactgtctaccctactgtcagttatgttccttgctgatccttctttgacttgtcctctgctgagcagagtatttatggctagacccagataagcagacaggctctgctaaccagaaattaaaaaaaattttttttcattaagcatgtgatgggttatagagttgtaatttttcttacattttgggcaagctttaaatgtagtatgccctatgagagttacaggaagacaaagtaatctaattcattaagcacttattatgtaccttgtgctttaatatcttttttatcttgtaactctcttaaccatcctgaaggtaggaattaccctccccattttatggatgatattagagaagtttactaacttgtttagcatcatacagctaaacagagacttgaattgtgattggaagctggctacgttagatttctcagccatgctattttcgttagatcatagtgcctctcggtttcctcatctgtaaaatgaggagactgatactcattatacaggcaaataataatgtctgacattgattaggtgttcagcacatggtagctatttattatttttatgagaatcaacaagaactggaagcaacatagatccacaacattgtacaccctcatttctctttctcttgctattctctcctctttctgttgtcctctcccctcttccctttccccacccaacattctctaagattgaactatcttttttttttaaaaaaataaaacattgaactagctccttcctgtcttatttgttcaagtgttaacattctttaatgggggtttttagtcagttccatcatcatcaccaaaagcacaccattgaaatctagatttagtaagccctactaagccctacttaggctgcagtttggacacagggattttcaggtcagtagtgttcaccttgaccctcacaattacaaagaggagtgccattagattcccattaattaagggtaaatgctacctgtcactttgaaagttttggtcttagagtatgtctgtatctctgctttagaaagacacgatttaagttgctagatacaagatgtcatttcttgtcttttctcttagccctaaacatcagcttgctttaattagaaataacagtaaggcatctgctgaaagtatgtgcacttccattaatctagggttactcaagagaatggcaaaggggtttctatattacatttgctaataaagagtataaacagtatttcaagatgaggactaaaatgaaatacctaaaaccttaccaggtccagctggttcatatttacattgccagaaggagggattagagaagcactgcaaaagcacaacaccttctgcattcttaaaattaaagggacaaattgttatctgaaatgagctgcaggccagagggggaaagataaccatatcagcaggaacaaaggttgtggctgaccagctaaaaagtgaccttttttttttttttttcatgttctcagaatctaaaaatggaatcccattaaaatgcattaaaaataggaaaaaaatataatataaaaagccagtatagtcgcagatgctaaatttacacttcccacaacagggattgtgccttagtgtcattcccatcaacccatcaactgagcttccccctaagcagacaccacttcctgggagtaaatgaagcatttttgggagctgctctcccagttggtctcaggccactagggtcccattcagttagttattacttcaggacacttactggttccctagtggcctcaaataaatgattgcagctcctaaaaatcctgacttccagaagtagcttgtgcatgaggagaatgtgcaaaactcacgcaatgagataattctgaggcttccagaatcctgttacatccagtataaagctgtgaagcagccacagttggtgtctttcgttagtaaaaatcatggacatccttcaggaaagcaaaactaccctctcactgctagtttccttcttcatagccaagacgcgagaaaaaataaatgtctaaaaattagagatctttcagctacgccagatgcctttgaaaagaaacaactcagtcattcaaacagcctgattttatgaggtgacattttagattatgatatgacattgcagatttgacatgattgtgctaattgtgagaaaatatgctactttgatcaaactagaatgaaggaaataaaaaggcactgtggctcaacttgtaataaagagcagctcatcctcacagctttgtgattgttgctatagttatctattcaacatgggatgcacaatacagttaacgtttcattaccagtagcctgttgcgtgcttattgttaaaaggaatttaacatacaagtttttgtatgttttgttcgcctaattctgattcctcgtgctgactggcatgagacagggagctggattgtattaaactggttttattgtgatgtgactatgatggatgtgacaagggcctctattattcgctggggagtgtggccattaatgaagccattagctgagctaaggcaagtgaagaaaatagggaaattaccactattctgaagccattaagttgtaatccaccactttctctccttactcaaaaaggcatcttctttttaaggcctccctgactgtcctttaaagattcattaattcattaactttccaaggagatgggggtggatagcatagttgaaattttaatcagttcagtgtatcatattattaacattatggcagtgtctgtgctcattgctggaccacatcaggttaattttaaacaaaccacattacagcagatgtctttctgttctatgcataacagaagagcttccatttgtagagtactttagatttcaccatgctcttttatgtttggttgatacccagggcaggcactatgtacctctgttatacagatgagtgaactgaggcttagtgaggctaaaataacctgagggatgaagatcagccagccactagataggcagaagtgggtttcacccttaaattctcactgaacctttgtattaggaatcatgcttttcccatgtatagtctctgctggaaaaaagaaagcctctggtgagcacaaatcttttgaaaatgaataacttgtgtttattctgtattaaatgtttaaaaatatttatttagctaatcagggatttgcatcttttaaaaacaatggcggtgtgctctgtgcaagtcatatatgtgatatactaccctgtgggtggtttcagtttacttataaaacgtttagctcagtcaagttgggtgatgtctactacttggcaaagcagagtgttcttaaagacacaagctttggctctacagcccttagcgaaccaacatttcccaagcagaagttaggacagttttttcttgaaagggatagtgaggtcaattctatgctcaatccttgccatgctaagaaaatttgggacccagaaccagtgccttagcacatccccaaattgatgcctcttctaacctatttgtgtagatatgttgcacatataattgttgctacctattgcaaggtccaaatgggtaaaggatacacattttgatcttctatactaggatattcttgagacctcctaaaagggagcatgaagaactgaggcttggctggctgctgggcagaccactttgcttagcagccatccatgcagacaggtgcccacaggctgaagggctgtcaggggaaggcagtcacagcaaggaaggaagtgggataggaactgaaacaaagattatttctcctcatatatttatgagttcctctaggtgggctagagcctagagcgaggagaaactcggtatgtattgttaaacagaatggattaaaaggaaggggactgtggcttaagaattcattgagcagtctatcttttgggtcatccccgtcttcatcacaagtaagtccacacctggaaatggaacttttccctccaaaccatagagttgatcaccagggggagagctgtaatgaaatctgtttctgaaaccagttggccttactgcttctgtgtgagttggtgttagcaaatggttgcatgaaaccttcctgatgacttaccatcctctagagggcagagccaggactggatccgggcctcctaaattgtagaccctggtattcaaaagggggtccatggaacagcagcatcgacctctcttggtataacttgttggaaatgcccaatgtcaggtgccagccaaacttcctgaatctgagtctgcattgtcaaaagatccccagggaatgcatatgcacaataaagactaaagagccctgctgataggcttggttcattgaaatgtgaatcttatgtgcaatgactaaagattgtgttcttttgccttacttttacaaaagaagaagggaactgatcttgattggaccccctaccctgtgccagtaactgaatgtgcctggcatcctatatttctgcttgttcaaccttcacaactaccctgggagataagcactgtcttcctaatcttatagacaaggaattctaagctgaaaaacaaagtgacttgcccaaggccacagggtaattgtcaaggctggggtttgaaccctagtttgtgtgatttcaaagccttccgcatgacagcatgctgtagtagaaagcacagagagaaaatctggagatgtaattgcctagttcctcggggaacatctctagaggattgattttattattgttgtttaacaaccctaattatttgagtatattttttgtagtggcttacagcatctcttgataaacatgcaagaattgatatttggcagtattatgaaaaataacattggtctgtaacagtgttttaagtttagatacttttgtttaatgatctgcacgtcttactttcaactttttattaacagggttaaagtaagtgaacaactcttctgctcctaccatccatatcacttatttatttttgtccctccatgttctgtgaaggcagaagtcttttaagcctcaacagctaattacctcccctgggagaaagctgggaagacaagaaacatcgaaaaggtcaactcagtttaagctggtgatttgccacaatgtgaggtgaggtggtcactttcgaacttggagtgaatggtcactaagcggggaccttgccaggcagcaagataaggaacctcccagggccacccatttgcctcaggccttgtgttttatttcatagcctgctcgaattcattatatggttacatttttcccaaacaaaatactcaccgcttaaatataatccagtcctttccaagttgaaataattttgggatttgccatttgaattacccacaagacatctttcctatatacccatgactgtttcttaaaagaatcccagctgggaaatgatttgctgccccaaggaaacaagcaggtttacatatccccatccccaccctgctttcactctctctctctctctctgtctctgatttcttcaacttttccactagggccaactgagaatcctcccaatgtgtgagtgtgcacacatgtgtctcagtttgcctctgtcttagggattggggctgctgtaaagcagccttataatgggcagattttcctacatgttgattgttaatgagattaatattttctcccttgttatgtagggcaattctgtattcacaagctgtcatctttttctttcttactgtggggctttctcaactgtcatgccatcaggctcatgagcctttcatgagaaagacatgggcctcttatgagtccactgagctctgtccacatgaacagccagtccagtcactggcaggatctgttggtactgtgttacgatcaccacagtcatgagtaaatttgagaggagatgctgtgaggctatgcaaatatcccattgtttcttagagcttcacccactaattttagcatccattgatgaaagttgcctgcaggaattattactatggtgttctaatgatgattttctatttccctccttccatcaacctttactaatttcttctgtgaagaatcccttcttctatttatgcattattcaatttgtttttttataagttgggaatcatggatatttattttattctatgagttataatcaaatactgttgttatttattttgttgctgaaattgttctagctgtagctaggggttttctacccccttcatttctggttgaggaacaggctggagaggggaatgccttgcccaagatcatgcctttggagacagcaccagggttagaacacagatctctttttgaactcacagttcaggcctgtctccattatactgtgccactttatgaaacactgagaagtatctaggtacactgtctcactttgctgtgctttttgtttatcttttgattaatacagttttgattgtccttcagagttgggtacaggaggaaattttgggtgtcagcctgctgtgttggaaagcctttttgtcacagacaaataacttcactagcttgatctactgtagagtggaatttaaaataagctggatgccttttgtatcccttttaggttgttatccgataataagacagcataggtagggtgatcatgcacactggtttgtcttgagtagtcctacttagtgtctgtttttcaggtgtaatcatcagtatagtaccttttccccctcaaaagtgtgcatattttgatgatcagttatatagtcaccccagtccactggttttcaaacttttgctccacatcagagttacctggagggcttaaataaattaaaaaaaaaagagtcacctcgagggcttgttaaactacagacagctggatcccaccccccaaatttgtgattcactgggtctggggtggggcttgagaatgagcgtttctaacacgctctaaggtgctgcaggtgctgcgtgattaatgtgttgattaacatcaataaatttcttaatattgtaatattttacaccttgacatgatgctatggaatagatttatattaaaaactgcttactttttctacctagtaaattatgtttatagagatgtagtgactgacacaaaggtaagatagtagtaatagcactgctaattatattgctgtacataaaaaatgacatcactattatccagcactgttaatagtcctaaatggagttggatatagtaaccttttatttgaatataccctctaaatcttgctgaatctttttcttccctacagattttaaattttgcatagactccatagtttttatttgaagagaaatggaactggtaggggagccagcataattttccactctttatggcactgactttgggattgacacctgcgcaggtagaggacctttttatctgataggctaagggcataaactgacctcatgacttactctttcatataaaggagacacaaaagatgcatgtgtgcatgcacacacactaccaactgtgatgatgacaacaaatttcctttgtttgctttttcttggtaactttttggtgactgtcatatgctttctttctgcatcacttccccatcgtagtagaggattatgtatgaagaacacaatgtaagaactgaatttgagacccagtgtgtatcattgtatcatgctctgtttccacattgatatttccctgacatttcattaatattgtttcattaatactgcttcaatagtattataagcacagctcattttcttctttgtctatgctggagagaatctcttggatgggtacatcaatggttctaattatgtaatcaatagtaaaccaagtcttgaggccctgtgcctcagtgtttccttctctgcaggccagtatatttagtgtttttgtagtattgggtttagatgtatgatactgctttgtatttgctgtggccatatgcaaaaaagatattactactttagcactgattgggtctcagttatttgtgtgttatcatgcatgtatttaattgagcagctactacatgcaaggagctgtgagaaatgaacatgaggccaagatattgaccttgccctcaaggaatttacagtcttgtcagagagataatccatacccacaaacaccgtaaaaagtagacagaattaagaagtatgagagctacacagagaacatgacgggaattcaaagaaagtactactcctttctttcagtgaagggtccagagtggctctgaggttcattttgaacatgacgggaattcaaagaaagtactacacctttcttgcagtgaagggtccagagtggctctgaggttcattttgaacatgacgggaattcaaagaaagtactacacctttcttgcagtgaagggtccagagtggctctgaggttcattttgtacatgaagagatgagaaaggacaatctaagtggaagatacaggagaaacacggaaacaaacaaaagaatatccagggaactgtttgcagatccctttgtctggttgcatgacacagaatgtagcagaaagccatgaactagctgaaagtaagaaggatttggctggctgcagacaggcagtaccaaaatgtaagggcatactaattcactgtgggccagttactatgctagggatcgtatataccttctctcatttcatcctcaaaatttctctgaggaagggagtgcttttattctttccttgtattaaggcctatgaatatatttcaggagaagagcttccaaaatacttccaataaatatgtgggatggttaagcaatggcacaacaaatttagttgccgtgacctaggtctgtccaaaggcccctgtacaattcagaagctctaaagagagaaatatcaacttcccaagtgtccaggtttaataacatttgaacaaagaaaaagtccttcctaggagacctccatttcacctggaggtatttcctttctattagttctacctgtctatctacgtgtgtaccaagaagagggtcactttttccccttcatcctgcacctatcactctccactgctcataccgctaagctctttcatcatccgacattgacttgtaatttaacagaggccatgtgctaagcaggacattgcagtattggctggccagtttgactcagctgtcttcccactgcaagtcaattgtttttgcctaaaattatttcagcaagctttgtgctgtatctgtgtcacacttttggccagtttgttaatgtaagtgctccttggtagtaggagtaagatcaattcctgctttacctacctatggcccttggacaataccctctacccagtgggtttcaccaacagacactttgtggtgggcatattggcaaaaatgtttgactcccaaccactacttcccaaggttttgccatgcatagagctctccttatttgcacactggggctttctgtaactgcaatgtccatccatgtctaaggatgcagccaaataaagaagctgcttcccttttattttattttattttattatttttttgagacagagttttactctgttgctcaggctggagtgcagtggtgcaatcttggctcactgcagcctccgcctcccgagttcaagcgattctcctgcctcagcctcctgagtagctggaattacaggcatgtgccaccacaccaggctaatttttgtatttttactagagatagggtttcaccatgttggctaggctggtctcgaactcctgacctcaagtgatccacccacctcagcctcccaaagtgctgggattacaggcgtcagccaccgcacctggtctgcctcccatttactttaaaacatctgttttcgtcttccagtgtaggcatggtcataaggtgggaatacctttaatagttaaaatggattctgaacaattggctcatgaaattaaaagaagataaaaatacaatctttttggtatgtgtgccgtaatatatactggctagatacatctttaatcatttttaaagtattgaaatatcatccgtcatgaaaataactctgcattgctataaaatatttactttttatgatgtttttgttttagttaaaaagattcataggctaaaaggaactttaaaggtcatcagatttgttctcataatctaggaatcggccattctaggcgagtgaaaatgtagtttgcttctaacagtgtcctgaaaaataatttttcaaccttgaggtggggctatgtcaactatttccgcatcccattccttgcttggaaatagcagagactcaacaaatattcactgaaaaagcgaatgagccttaaaggaaatgcatttaattgggtagaaagcaaattctgaacacatatttgtagagtgaatgcgtggaagaaggaatggacagacaagacactaggaaattttcggatatagctaacctgattttctcatgttacagatgaaatcagtttcttcttattcagtttgcacagtgtaagtgagtttcctcaactagtcatcataccctctctatttgaaggaagttattaattcttccctcagtcccgtctcttctggctgagtaatcatagcctcgtttacctttcctcataggttcatctttccaagcctgtgagagtctctgtggctctctgatccccaaatacatcataatcctctctccgttttagagcctaggcctagatatgccaatgtgagatttacagagggattagtgagcattttgtatctaaacctggatgatgacaatcacagacttcattagtgcataaagaaaaccataagacaataggggttttgtgggatttgtggtgagtttttttcaaaattatgtttgaccactctttgctcttctttcccccagttgctatttctggaactcacagttgtgattagacagcatcagaaaaggaggctgctacctttcactcttggttattaaaaacaatatgtctaatagtttattatacattttcaaatagcttcctctaaaaactggagaaagatttctcccgccccatacaattctgtggctcagagattgtcttttagctagaaatattgatttgctgttgtttagcccccagtggattgcttcttatctctaagactggatttttgttagaatgagagttgacagaattcagatttagtcaagtgaggtgtgtcagagttggtaaaatgttaaagtttgagaacaaattggatattaactcaggaaattttgtgtgaattttgtcaaaagaagtgatttcaagaatcagggcctttgtggtgtatatttgcagagaataattatttaattgcagaagataattatttaaatgcctgagtctccttttgggggaggagaactgatttccacagatttgtttatacagattcagtcctaaggcaaacctgaaatgaaaaatcagtccaaatttttaacagagaattgcatcagatttggtacattcctatactggatgataattaatttttcttctttgtacttttttgaaatttctaattttgttttacagtggccctgcattacttttatacatgctcatatagcaagtaaaaaaagacacaagcatgtatcaaatatgacccctattttatcaaataaaaaaatcatatacaaatgctcccccatcaagctatgattttttgaccttacagtggtttgaaagtgataagcattcagtagaaaccatacttcaaattagtaattgaaatgcattttcagcttacaatattttcaacttatgatgggtttatcgaggggcatctgcgaatacgtatgtgcaggaaaaaaactagaaggaaatataccaaaatgtattgcgttaatggttattatcagtgcttgataagattacaggctgctttcatgtatttttcattcttctctatattgttacagtttaaagaacatgtatatgtgaatcagggtttcttaattttggcaccactgacatttgcagccaagtaactctttgttgtgaggggccatcctgattatcgtcctgagtttccctgacctagatacacactagataacagaaacacctattcctccataggtgtgacaaccaaaaatgtctttggacattgcctaatgtctcttgggagggggaaaaatcagccctgtttgagaaccactgatataaattaaacaagtgtttctttagtaagaaactttcaagccatatagaaataaaactaaggcttaaataactacaaataaggtaagcaacaacatggctcccctacactactctcttctctttccattctcagaagaatgaaagtgtgggataatggcctggttgaagtttacagagttgtcaggcgatgaatgattttgataagccaccaattccctccccataaaataaatagactacataaaacaatatgggcatagagatttcttatatgtttaggcacacaattagcacttaatgtatgtttaataataagcaatgaaccccttaccaaattagtagtagaacttatggtccttctctactctaaactctcctccagatgctgggaagtgaaaaaaaaaaaaaaaaaaaaaaaaaaagaagaaagaaagaaaggaaaagagattgggcaaaagttgagttgttttctgcctgtgatccttggtatcacaactttaaaagttttgttctggagaccctgtgtattgcaaaggtcccattcaagaagaggacttcctctcttttggagagcacctgtgcagtaaagggttaacctagcaagcttggggtgttccaaccctgcatattccaaaaacagggccaatcaagggcttctgggagataacttctaggtccttggaatattctgcctgatgagagggtctttgtatacctggggagttgagccacaccagatagtttatgctaacaatgtgggttatggtagtgtccttgggccactgtgtatcagtttgacctctggaggggctggagactgagtaactaaaatcaggcacgtgggtgctccatgactactgactagtcctcaataaaaatctggacaccaatactccggagagctttcctggttggaaatattttgtacatattgtcacacatcattgcttggggaattaagcactgtctttactactctcctgggagaggaaaactagaagcttgtactcggtctctcatggaccccaccatgtgtacctttttcctttgctgattttaatctgtattctttcactgtaataaaccataaccatgagtatagcagtttctgtgacttgagtccttgtggcaaaacatacttgagggtggtcttgggaacccctgacacagccacatgtcctttaactcacagagagtgatggggaaggtcagggttgaagcgtggtatgaaaaccccaaagccttgcccagtgtgtgtcaactctgacttgatgtacagcttgaactggctattttgtcctctagtaggcagggtcttcacaagccaggtgaatgttggaacccaaggacctgactggggggaaagctgcacttcatacctggggttctatccacctggggaggatattggtcagtatccccttccctgagaatcagacacatgtgtgcatttgccagggtttcccttgccaggcaagcatagcagaggtatggcctttaattgcctttggttctcaaagtgttctgagcagtatacctgaaccactatgcttgttggtctgctcactttgctgttttgttttttgagtagagggaataggtttaatattacaaaacaagtcttggcttgacagcacagatagatgcctttgcatgaatgaaaaagtcaaatctgggagaatggagaatggaagaccttagagctttagatttttctctaacatgttttattcaaagcctgtttacctctggatatggaaatcggggacatcctttacttaaagcctctgcagtgataacagcctaagttagggccccagctccattctaggtatttgttgcttggtaggaagaaaatcaaaacagtaagaaatgagtggttttacccatagtagcttgatcctggtggtaagacagggaattgcaccaaagatctgacaaatggtggggatttaaaaaatgctcaggatggttctcccctctgtgtcagaacacattatttgaggctaaaaggagaggagactcttctttatgtactttttaaattgaactgtaactaatacacaataaaatatacgggtattcagttcagtgagttttgacatttgcttacatccaggtaactgctacccaaaacaagacacagaccaactctgtccaatagcaatataatacaagccacatctacaattttaagtttttttgcagccacattagaaaaggtaaaaagatacaggtgagattaattttaacactatattttcaatccagtgtatttgagtcatcatcatttcaacacataattaacatagaaattataattaaaattcacattttctttgtaacaagtctttgttacaagcatattttatagttacaacacatttcattcagatgccaatattaaaaaaattgtggtagaaaacacataacaaatgtactgtggccttctctgaaaggggtataaagtgctcaggctgtgaatgagtacaggcttctggaacagagagctgtccttgggtttcacttcccagtgactttgaatcctgaatccctgtggtcagaaggcagactcctagaacttgatctgaagactgaaactgtagctgagcctctatctgtgtcctcaactcattctttgctgtttgtttatttcttccgtgtccccagaccctaacttccttccactaatattactgagaatttgccaatgaaggacaatctacagagtgctcccaagagaaaggcattgtaatccctggaagaacttataagtcagtggaagacacttccagacacctttaaaaactatgacatagccctccgactagaggtagcctatggttagaggaagcttcctcaggttagaggaaggtacaacatggaagtatggctaggagttgaggatgcaaagaggagggtctaagaatgaatagagtgtgggttaactgtcagatggccagctctactatttataggctgtgtcaccttgagccaattgcttcatctctctcggcttctttgccattatctgcaaaacagggataatacacatatttaccagagctgtcaaatattaaacaaaaaagaatattaaacatttgttgcaatgactggctcatttgctcactcattcattcaacagatattttaaaacatcaaccatatgccaggtgctgggctagttgctgcggatacagcaataaagtgaggtaggcgtggtctgtattctcttaaagtttgacatccagttgaggagttaaattaacaatatttattatcatggggagaggcagacatgagaaaggccatggtgcatggtgcagctgaagaaaagtgagaggtttaaatcaagtttacctgtgcctggagggagacagggctggaggttagcagagggtgataaaactgaaggagttagatcgggtcccccatcacagtctcaatcctgctgaaaaaagtttggaaatcttcaataagttttccaatatttgggattattcaagtattttaataaaactagaatagactattgtttctcgtggggataatggaagacactccagtttaatttgcatttgccatgtcttaccatcctgatttcagactctttaagattagggagcatgctatccctgaatcttccacccaaactgcttttgcagtgtagcttagacttagattcttcttgactctctgcatatgttggccagaaccgggtctggcacagaatgaatgttcaatagatgtgtgttgaatggctggatgggagaatggatggatgcccaagacgctggcagagtcagtctggctattccaggctcctcccacaggtcaacccctgcagagaagaggcatctttccattcaacagaaggggccctggcctagaagttaagatgtctgggtcttagccctgtctctgccattcatttgctttgtgatcttgggcaagtcacttaactcctctgggcctgttgcccaacctgcaaaacgaatgggctttgacctctgggatcgcttctgtgtttcacatttcatgatcatctggctcccaaggttcattttctccagtctcctggcccctgacactcacatgttgtgtaagctgctcactagcctatattgtgtggaactgaactcaagccaattaaaaacagagtacattaacaagagtttcagtgaagatgtctgatcccattgttgttgcaaaggattagtgaaggggctgcgagaggattatggtctctgttgaaacctgtgtttaattattcgttcctttctctgtattttcatcatacacccactgagtacttgaccattgctgtgcatgaagaagaggaagaattaatcctcatctgacctctatttaaatgatacattttagttttgacatagagtgattccaagttctgccctgataaggccagtttccgccacctttttgatctgtaacacgttctgcttcctggtttgagcattggacttggatttgtcaagacatgtccctcagcaatatcagcatttcttttttgggacagttactgattaagctcacagcactggggagaaagaactgaacagctagaaagatgacagccaatgactataggtttcccatcccatttttgtcatctctcacaaaactaaaatcaccataagaaatctttctgcatatgtaagagtctgtattttcagccttggaatattcattcagtttttatgcatctgattatgcacataccaataaccctctaatttatggatgcttgctattaggttttgtttaaatgagttccttccaaaaggaaccagccttctgttctaaagagacacgtaaaccacacgaggtgaattttcctacaactgatttcaaatgtggagttttcagggtgtaatttagatgtagctgtggtggtttatggccacagaaactgtaggtgtgtgtgtaggaggctacatggtacttacgaatgactggaagccagagagcagagggagagagccagcggtggagattttagctcagtttcacatctctaccccaaggcattagatgccgctaattcttcaaaagccgaagatttgttttacagaagaaattctgatttgattaagatattgcttccagacctaatgttcctttagcaaatcatgcctacatccatgattagaaaaaaactgcatgttatctaagcatagaaaagcctcatgatttgaaagtattctacagaagtaacatttagtgtaattacagtacatttagattaattatagccgtggttccgggcgccaccatacttaaggttatatcagcatttttgtttttaaccctgcgtggagtaagtttatcctctggctgcatatttttttactccagaaaatatttgagttccacataatgtgagaccaaaattgaatggccttttctacttttaggctaactttaaaaagatataatttcagagaggctattctctttaagattgctgtttttctgtagaatctcaaaataggcagagattaattttgaaaaaaatgaaaatggtcatgatgcttagataagaagttgacttgctataaatggcttgtgtttccctttgaaaggctttatcgcattggccataaagtaaaacctggttgacatttaactgccatgtctgtccagaacttacctatctgatctgagtgtgtggctccattcaaattgggcccttagggaggcaccatcttattccaacagttctacctgaccaggcaggtaacagtttgaaatttcatctttgtgaatggtctttggaatctgtggctggttcttttttaatatcatttattataaactccagattttcatttcttgatggtagtggtgattgtgatttttttgaaacaaccagaaagcaatttggagcaagatttggtgagtaaggaggctgataaggttgaatataggttttactaaaaaatgagctgtggctctaagataatgagcctaattttcatgcatggttcataactgtagctgaaggtaattccctcagagcagttctaaacatggttgaagaatgcatgtctccttgagggtagtgtatagtttcctcatagtgttgcttctaagagtcagcatttatttaaatgttaaatgtctggtagtttctcttatgaagagtctcattgtcttatagttatacatcatgtaaataaagggagatttctttaaattctaagtattggactgtaatgaagctaaaaattgttatcacttacggcctattttgctgttgctataatagaataccagagactgggtaatctataaagaacagagatttatttgttacagttctggagactgggatgtccaagatcaaggagctgcatctggcagagccttcttgctgtgtcctgccatagcagaaggtggaagaacgtggttcctaactgtagctgaaggtaaatccctcagagaaagaatgcatgaaaaagagagagaaagagagagagcaaggtgggagcaaggagagtgctgaactcttgaagatatcacctctcaacactcttgcattagagattaaatttctaactttgggggagacattcaaactacaacaacctgtcacgtataataaaggcatttcctaaatctattatctttatacaaatgcatggaaacattctcaaaaatatttgttaatgctagctaatagttggcattttattgagcacttaccattagtcaggcagtgtgtttcccgtgctttaactggtttacctatgactttttgagaaccttagagacccatcctttcaaatggtgccaattatattcacagagaggttaaataacttgtccaaggtacacagcttgtaaaatgctgagctgggatgaaaagtcaggccagtctaactcagggtctgcacattttgccacacctgatgcttcaatacatttgataaacacatgcatcctgagtagagccacagattactgcttcccagcattctagctgttctcttggttgatcaaggcaaaaggaaggactgttcagccatttattacagagcaagttgtatcaaatgaacaaaagaatcaaggcaaaagcagtgaatttctccagccctcacttggttttatttgtcttttccttttctattttgccctgctaggttatattttaccttttcacggtggagttgtgcgggcgagtggctcttatcaggaacaaatgatgccataaatccgggctaaaatcaatgaggttatgagctctaagagtgagatgcagttctgtgggcccaagtgttttcccttcttaacatgctgcacctttgaagccagaagccagaggcttgggtgttgttctattcgcagctagttctgtcatttacagacatatatatagctgctctgtcactgagctgggttcccaatacccatcttcccattttaaacaagaggaacgtcaagaagaaataatagagagtacgtatgctctcatgcctgtctccaaacatataagaaaagagacagaaaaggaagcgccaaacaaaaccaccttttggtaataacactgtaatgtaaaaattatagcctggaattcttgcaaatggcttcatcttcctctcttggagagactggcaccatctctttagccttactcagctaaagggaactgatttaccagtgccaaatgcattaatttagtaagaaagagaaaaatagcaatggatgccattcaattttctgatgactggttatggccattttatgaagtactgaattcgcttagaggaaacccatgaacagacaccaggcatcctaggtagtggctgtgagcgagaaacatgccactcaaatactgtgtcttccattctcagctgttggtgcccttagtgtgtgagatagtggtaataggagtgaccattgagatttccactccaaaaagacaggttcaatcctgtaagagaagctagtttggcaactggagttggcctgttctagttgactagttgggaaaatggacttcttttctactccctcatcacacagatttcttggcttggggaagggccattactagggtcacaacattttaaaaatatcactaatcaagatgaataatattttaatgtggtatttgtgaaaaatcaagacgcatgcagaaaaatccacaatgaataaacaatctgatttttttttaaactttaagttctgggatacatgtggagaacgttacaggattattacgtaggtatacatgtgccatggtggtggtttgctgcacccatcaactcgtcatctccattatgtatttctcctaatgctatcccttctctagcccctcaccccgtgacaggccctggtgtgtgatgttcccctccctgtgtccatgtgttctcattgttcaacacccacttatgagtgagaacatgcagtgtttggttttctgttcctgtgttagtttgctgagaatgatggtttccagcgtcatccatgtccctgcaaaggacatgaactcatccttttttttatggctgcatagtattccatgatgtatatgtgccacattttctttatccagtctatcattgatgggcatttgggttggttccaagtctttgctattgtgaataatggtgcagtaaacatacatgtgcatatgtctttatagtagaatgatttataatcctttgggtatatacctagtaatgggattgctgggtcaaatggtatttctagttctagatccttgaggaattgccacactgtcttccacaatggttgaactaatttacactcccaccaacagtgtaaaagcattcctatttctccacatcctctccagcatctgttgtttcctgactttttaatgattgccattctaactggtatgagatggtatctcattgtggtttttatttgcatttctctaatgaccagtgatggtgagcttttttttcatatgtttgttggctgcaaaaatgtctttttttgagaagtgtctgttcatatccttcacccagtttttgatggggttgtttgtttttttcttcaaactatactacaaggctacagtaaccaaaacagcatggtactggtaccaaaacagatatatagaccaacagaacagaactgaggcctcagaaataatgccacacatctacaagcatctgatctttgacaaacctgacaaaaacaagcaatggggaaaggattccctgttggaaaaactggctagccatatgcagaaaactgaaactggaccccttccttacaccttattcaaaaattaactcaagatggattaaagacttaaacgtaagacctaaaatcataaaaaccctagaagaaaacctaggcaatactattcaggacatagacatgggcaaagacttgatgactaaaacgccaaaagcaacagcaacaaaagccaaaattgacaaatgggatctaattaaactgaagagcttctgcacagcaaaagaaactatcatcagagtgaacaggcaacctacagaatgggagaaaatttttgcaatctattcatctaacaaacagctaatatccagaatgtataaggaacttaaacaaatttgtatggaaatatctgatttttaaacaaagacaggatctgtaacagtgccattctgagccatattgaagcctgaggcaaaaggaaaaaataagacatttcgatttttaacagtattgcattaaaatttcatttatcttgatgacagtttttttctggggggggcacctcctgttctcctcaaagtccagctctaatgctttctctctggggttttacctgatttttctctgtacccctcgccacttcagtgtgaatgtatttcacctctggtcatccatcaatactttctgcagatctccttatggtttctgccatggtagaccatattttttatgtatttgaagtatttgcgttttttgtaagacaatggcttccttgaggatgaagtctatgtcttttgctttttgtatccataatgccagccagacattttgtaggtaataataaacatatttgttgattgttaaaaaccaaaacatgagtgaatgaatgagttaaatgaataaatgaacataacatttgagatttcttttagcattttattagtggatttacatttcaacaattttcctaaatataaccttgggtcaattttgacccttaatttgggaaatcaaagtctcctggaaagaactggctctagggtattttctcttataaccatcaggcagggagtcttgtttgctaaatgggtaatgataaagtcatcttcatgaacctatccaagcattgaactcattttcattacatagaaaactcaagagcaattcagcatcaaattagtcagtcttaggacagagatgatattttgctgagtgtcagctttcagttgatgcttcatcaagcctatctggctttattctagggtgtggtccttatccgggtccctgcctcagaatcaggagtggggtgggcttctctttccagatgccaatccttacctgtacctcgtctcactcctactgagccaggatctctaggggttgacttctttggtcctagaaggaatgcggtggaatacactgcagcccttagtaatctaacctaaatggtctgtgtggccaagctgtttggaagcctactttacttttttgagggctacattttcttacccatttttatgacagtgattcagtggtgagtttcttttagctgaaatggttcaaccaaggggaaataatcttttttactaaaagaaaaaaaaaacagaaccagagtggggcaagttatacaatattcatgatcacttcaaattagagaagtaaaagtcaatgttgaagtggccccttgcatgtggagctattatgattaggattcacggtctgtgaaatctaatcctagttgcaggacactatgaaattattgaacttacatatgggaaaatgttaatgaaagtggtgagttcccacccactaacgttgttgcttgttttagaatttaagacaacagttatgccagcaaatgacagctttgttctgtctacctgatgtcaaatgactggtctgactgatttctttttaaaccacatttaatcaattgtcaagtcgctttggcatcacacagacacagcctgtgctgtgctgggagctgtgtattgatttagtgttaagaagccatggctgaatggtgagtaaaagtcatgcaacaccagaatataaaccatggaaagaatggagactcataatcacagacactgctgctcagctttcccaagttcttcagaaaagtacaacctctagtgtctcccctgggccccttgttttctgcaagcaactctccaaaagattctaaacctcactcatagctacgggtaacaagccaccaaagggcctcagttttgtcttctcatgtaagcagtcattaaaacaatctgtctaaccatgctttcttcctttgcttccccaagccctctggaaaccaaggctagagacataggtcagcttaactattccaaacaaaaccccaaacaaacctgaagacaactgagttcaggctgaaggtgatttcattgttattcccaagaataatagatgtctcccttcctctctcttcctctctttattccttcccctatctcttttcctttcttgacctcctgaaaggggcctgccaaactggaggccctgaactaggtactgggggctcagtggggaacttgatgcctggttgcatggagtttacatttcagtcagggtctgcagacatgaaaaaagccacaaagaaaggcacaatccagtttcagattgcaataactcatcagaagaaagtaaaacaggttcctgtaatgcagttacagaagaggaagaggccgactttagccttggttgtctgagaaggccctgtttgagccgaggcctgcaggatgagaggaagctggtcaagtgtggatcttggggaagcatttcaaggagacagcagtgcaattacaaaaggccctgaggcagggacatgcctggcttgttcacagaataaaacgagccttgttaaggatggtaactttatagaggatgaggttagggatgtaggcaaggatcagacctgtgggtacttcaaagggccagataagcaattggaatttcattctacctgcaatgggaagcgtttggaggagtttaagcatgggcagggggatctgatttacattttaaaggggcacattggctgctatgtggggaacaaaatgtaggaaggcaaagaaggcagtggaggccagctgggaggctgtcattgcagtggtgtgcaccaaggcagtggccatggaaggagagagaggttggaggtggagtccacagaagttactgatggatcctgtgtgtgtgtgtgcatgctgggggtgatggaggtgaatgaaagggaggagtccagtataccttctcaatttttgtgttgagcggccaagaggatagtggtgccatttgctatgctttatgcttatataactcggacagtccattgagatggtttttcacaaaggactaatctttgccaagtaagttttatctctggtgagacaacagtaaaataaaactatttgcagtactcaaatggttgtcttttactagcagattcacacattcatgtgtaggatttctaacatctggggactgattttcagcctgggttatcttccagactgtgagctacttgagggtaaataagacaccatatcttatttctcctggtacttctagtgtcagtgtcagtgaccagcacatgccaggtgttttataaatgcttgttgaaaggaagagaggaaagacaactgaccctctccagaacttgactatcttttgtttctaatgcttatcatgacaatgaagaggacacaaaaaggaaaataaaataagggcatctctgcagattaggaagaaaatttcaatatatcctgaagggaaaaaatatgatagaacaaaacaacagacatgctgtagatcacttcttccctcactgttgaaatattcaataaatctatagcagcacttacctaactgtctggtagtatcttagtatttaggactaaatttcaactcagttgatcctttgaattcaatcccagataagttttaaatatatatgttgttcatgtctgagacacttaggatgacaggtatattatcattaggctatattcagtaactaataaagaaattattaagaaagggaagtacaaaatgcctatgtaattgtagaggagctgcctcattcatttgatgcaatagagtcagtgagctgtctggaagaaaaactattttcctccaaagcatttggtagttccctcttgatttgaaaaaaaaaaaaaaaaatcaacgttactctgcatgccattttggaggcgttttgacatggccgaaacctgcctttccttttttcaccccagcctctgctctgccattttacaccattttccattcttaattgcttactcttctgtgcctttagtcttgctcttccagtggccaggaagatatctccctcactttctctacttcaagtagcctaattatccttcagtgctcagctcagatgcagtctccccaaagcagccttcctggacttccccaggctgaattcataccttcctccatgtttcctctgctttgtattatgtgcagcttttatggatgcctcctacaactacattgtatttatcttccacagttcctaggtagcacattccacacagtaatactcaatagaggtttattgagtgcttaagtggaattgctttaatgtcatggtcctgtttcttattgtcttcctctgcatcagaaggaggacatgtagaattggctgctctttgctttttacagcaggtcaaaataaatgcaagctctgacacattacatggaattgaaattaagaagaaagagtatgatgcttgttatcagtggaatcatgggcatggtaggagaaaattatgctagtgacaggactgctagtctcaacctaggaaactggcagtagttggctttgtgactgcagccaaagattataccatattatattagttgaatggttgaatatatatctgttcttgaaggaatagtatgtaattaatctctagtttttaaaatatatttatgataagaactctgtttcccctgtattttatttttcttaggttgttaaaaaaaactactgacatctttcaaacactttactcaatattcccccaaaagcatcagcagcaaaagtttatgaatatttttattagagatgatttggattttattcctgcaacacagagctagaaaaattttaaggtcattagccataagagttttaaatacattgtcattcgagtatgttagttttagcttcatagttctctgttatctttagcttttcccatttttaagttaataatgataaaaataaatttcatacttattagcttttttcatcctaaggtgtttaacaaaccttaggggtacaaatataatgtgtagcaatccatatgcttgctcataggtttatggccctaagagcatcatttgatcacaattatttttgtttcattgacattccacacaatcaactgaagaattgggtcctaagttactggaaaagtacaagtagaaactcttgtctagccagttaacgtgtctttgaatatctttatttctattcttccttcctttcaacaaccctttgttacataacagctatggttgggttcagagcccaagactaggggtataaagatcaacaaggttgttaaaagttcatatatatatatataaaatatacatgcatatctatgagttaggttaaaggtatatataaatatgtgcgtgtatagttagaagtataaatgagaagtacattgtcagatgtgtatacatatccttagtaattttaatttcctaattgtttactctctgccaggcactgtgccaaatagtttatgtgcatcatctcatttaacacttgcaacaactctgtgaggtatcattatcgtatggtgcaaataagaaaaccaagactcagaaatattattattatctattttgcccaagtctgtcagctaacagttgtcacagtcagggttgaaacccaagtgtgtctgacttccaagctcattctctttccctatgtttttaagtgtctctggttgaatcagatgctgatttcttcccagaagtctagattcagaattaaaggaacaaaagaatgaaagtattaaaatggttgcttgaatatcaaaactggatggtcatgaataccaaagatctatttgttttattatatatatatatgctctggcaatcctgcattggagtagagagtcagttctcagacaatagttctctatttgaatcagagcaatgaaatgcagcaattcagtgacagttgcatcccccttaggttccccaactgaagaccaccttctggctggattactttatggtgtggtccttttggtacttcagtagctaagaaagtgttttcagattaataagatgttgaaacaccagatgagccatcaaggggtgtgcaaggtctctatccttaagaatctccatgttgagaaaactgttcatcctagatagctgaaccgttcacctcttgggatctttgacaattctgtgatttttgcaagacatgcacacttatcaagttaatttcaccttaagccaaaatctcctttgtagctctttataaccaaagtgccagcaaatcaacaaggtgtctctgaccacccttggactggattagactctctattaggcacttgtggtactttttgcttcatagtatttcttactcttagagttcagtgattatttgtgtaatgcctgtctgccatgctggactatgaactccagttggacagagactgtatttgtaatgctcagtactccaccttacctgcggtgcttaaccttgtggctggcaaatagcaggaagtcaatatatatttattgatggaaaaataaatgactgaaatttaatagaagactgaacacatacaaccatgcagcggatttagtgttgatttatgctacagtgattctcattcttaatatttaagcacacccctagttcaatacctctttcatgacctaacagctctaggggttttatgtgatggagggcaattctgtttgcttggtgattacaagaggacagatacaatatttactagccttagcaattcctgagcaaatgtggtccctggagaagggaacatagtaataaagcagggaaacctagccgttatcttgaagcaaagccacacaggcatcaaggctgcagctcgcattcctgtggtctggagctctggagttttcaagggttatttatggtgacactgatgagacacttcatttaaatactgtaactgctgaagtatcccagaatgaaaaactcagcttacggtggagtcaataccttgttatttcttttaactctctgatataccattgtttcaaggatttacactaaaatacttgagtcttgagtcctaaaatgacccaagagagataaactgaccatggctgcctcctgtacataggatttggtttcttaaaatgaagctcactcttatctttactcagcccattgttctttaattggtcaaatgacgctataaatgaaggactttgatagcaaaaaataaatgttttatacattgctagaaaaagctttaggagaaaattttagcaaaagaacagattctttcttgtttctatagaaaccagtagtgatcaggaggagcgaggtgttcttttaagcatacacattagtaaggccagctcagcagtctccagcatactggagagctggagtcagagacccactagctgggggagtgcctctgtctgagtccttttgatatcattgggagttggggacatcttgctggaaatacctggttcctcataagctgagtagggttgcagtccacagtcactcagcatcatagagccagaaaggtttttaaaggaatctcctgtcaaaaggggaggaaaaagataaacataggaaagctttaatatcagatgtcaacaggcctttaaacatgctctttaccactgagcaataaataccctggttgagtcctgaccagatcacttataaactgtccaaagtacgcattcgaatcattggattgtatgacaatttgtttcccttttggtttgtctacttccataaaatctttaaaaaatgaaatttgaattaaatgtatcttttaaagttaaatttctagagctgttagattcctgacaagtgaatgttggacaagacttacaatcaaattccaaagcaaatacttttctaaagcctaatcagtactacagctttcaatgatttctctagtcttttaaatgaagtttaggtcaaatgtaatgacaggatgaagcagatgcattttgcttcaacctgacatgccccagaaggtaagagaaatatctggtaactgacaaaagagttttctgtttgcttgacatttactttgtatgtaaataatccagtatattggcatgtcaatatattagttagtggtggcccaaaacatgatgcgaatttagatagtatttctttctgctcacaaatatacactcttgatcaacaagagaacatttattgcaatcttgccttgcagttggcagagcagaatgaatcgttttgaaatataaacttcctcagatctaaaatatatcacaggaaaacacaagacataaggggagtggattatgaaataaaaggagcatatttcgtaatctataggttataatcattaaagattgccattagtaagatgctgggccaaatgtgtaagactacatttggtaagcaggtatgaaaagctcatgatttccttgaaactgttctttggaagcaacactgcattgtggaatggtaagaagtggccccttactggctgtgtgaccttgggtaagtcactttccctctctgacttcagtttcctcatctgcaaaatggtagtagtaaaaatgatggtgatggtgataatgatcatgatgatgaggaggaggaggaggaggaacagaagtaggaataggaggaagaggatttctctatctagggttgtaaaatttagataagaaaatctagaaaactctgcatatagaagatgtacaatgtgagtcatattcctttctactttccctaagaacaaaccatgttagtacttaacatttcgcttttaccaagcttttagcggtcgtttctttgctattcaatgagaactgaagttttgctgaaatatgggaaaagtaaccaaacatctctaaaaaacaaaacaaagcaaaacaaacaaaaatacaaggagtaagaaatatgccatattttctagacacattttatttcagttttttcccctgggtgtagagttagggtgcaaaatctatcaaattcttctattaattttaaattaagaaatgtggagatttgctatgttagaaccaaagctttcctgattctctgaggataactgtgtgtgtgtttgacctctagagctgaagtcacggtgttagccccttgtgacattagtgttcagaagctctttctatgcatggataaatcttggttgtctagcacaggttgtgaaacataataggggctcattaaatatttgtttaatgaataaatgaaattattatgcaataaaattaaaaatgtaatgtttaccaaactactctcagtacatttgtttcagtgattttttcatacaatcatacatgatatcagaccacatgtaatatatataaaaaggatagctgtcagtaaaatggaaagaatccttgtctccatctcactggcttgattgatatatactcatatccaatatttcctatagacaggctaccataattaatttgattattctttcacataattttgatggatcaagatgcagacgatttataatttctaccaatccaaagtgtacagtgtatgtttattttggtctgtaatctccaaacagtcattgtcatcatcatcaagcctactttgaaccgtacaagctacatagtgtcacatctacatggttatagaccctcagtatgcttaagatgaaatttcatatcacccaataagaaatcttcattatttattaagaatgagtcaggaagagaaagcagttgtgatttcttggcttatttctctgacaacctcttcaatttgaaccaagcaatcattactcattttttaatacacaccacacacataggtggatcaagatttgaagtctcataacatttagtaaagtagaaatacgcatcttcgtagaagaaatgtggaatgtgtacttgtattcttccttttcatttcaaagatagtgctgcttacaacactgatgatctgggcatgcagatgtgactgaaagggtctgtgtaatgacaatccttctacctgagacacaggacgttctccctttgcatagggcctggtgctttgtattggtttcctggagctgctgaaacaaaacaccacaaattggtgtggcttagaacaatagaaatgttttgtttcccagttctagaggctataacttcaaaatcaaggtgttgggagggctatgcttcctccaaaggtcccaggaaagacgtgttccatgcctctttcctagcttctggtaaccgcatccgttccttggattgttgatccatcgctccaatcctccacctttacatggccatcttcttcctgtgtcttcccatcctcttgcctctatgtgtgcctatctgtctgtccaaatgtcccctttttataaggatactagtcatattggattagggctgaccctaagaccctcatcttaacttgatcaccgctgaaagatccctatttccaaattaggttacattctgatgtgctgaaggttaagacttaaacatatttttttggagggggtggaaacaattcaattcataacaaattttcatactaaagtttgttctttgcaactgcacctctggcacttgtggtatagatgaagcattagctcaaaaaacccaactgtattctttggagctgcttttctgggcaagcctgtggactacttaattgttatcaaagttctaccattaggccgcttgacttgaagccatgcttctgtggattcttaaagatgacacttctgccctcctgcctatgattactgtgcatgattagctgcagcattgctttccaaatgttccagaacttggcatttccagtaatttagcttggactggtctctactctgcaccacccgctacccccaactgcagctcatctgggttcgtaagtttgggtctgaaagatatcaagaaaatttaaactttggggcacattttcagtgggaaaacagatggaaaagctgtatgggagtgtaaagtaaaagattgtattgatcaaagagaggaattctcaaagtcttgtagctaaacttattcctgtgggaaaagctgctaacccaaatcctcctagacaaataatgccaattaaaaaaaggcactgagttcactggcttaaaagcagtcattctcaagatagtattatcattttaaagcttctaaaagctttctgggaagcctgagtcggttcattgtcctaaggacagatggacacctgataaagtatttatggcccaatctaactaaggatcagcacagggtcaaagggccagtgataataggactaatatctctagatccacctacatataggaagcactttctaaaagttatgagaaaaaagattattcagcctgaggcattagcaactattttgattaaatattggtagggagcttaaaggtcatcatcaagtaagtgaaaagacacatcacagaatgagaaaaatatttgtaaaccatagatctgataacatactagcatccagaaaagacaaaaaaaaaaaactgttacaaaataattcaattaaaaattggcaaagcatctgaatagatatttattcaaagtagatacacaaatgctaataaatacatgaaaagacactgaatatcttagtcatcagggaaatgcaaatattaataaaaaccatgagacaccacttcacacccactagaatcactatgcccaagaagatacacagcaacaagtgttggcgaggatgtcgcgaaattaacaccctttgcttgtggaaatgtattaaataaaattatgcagacactgtggaaaacaatttgggaattccgcaaaaagctaaatatcgaattttcatgtgacccaacaattacgcttctaagtatacatggaataatatttaagacatatgtccacataaaaacttgtactggagtgttcatggcaacattacttgtcacagccaaaagtgggaatgactcaaatatccatcgactgatgaatggacaaactaaatgtggtctatctatacaaagaatattactcaaccacaaaaggaaggaagtactgatgtgtgtcacaatttgcactgcaatttggatgaacattgaaaacattatgctaagtgaaagaaaaaacagacataaaaggttacatattatatgattcaacttatataaaatacacataataggcaaattcatagagtggttgtcaggggctgctgggaggggagaatgtagagtgactgctaataggtacagggtttatttttgaagtaataaaaatgttctggaattagatagtggtgtttgttgcacatctgtgaatatgaaaggactacagaattatcgactttgaaatggtaaattgtattatctatgaattatatctcaggaaagtttttagaaaaacagtttcactaactagctttaacattcactgatgattctttgaaacagcaactagatatattgtttacaacttagaccaacaatttttatttcagaaagagtattttatcattggcatttagaattgctgctgcatggtgatgataaatagcagacagacttaaaaattgttagggaaattatgttagaaaacattaatcactctagttttgtaagaattcacccagcttccagaaaaagatacacaggctggtttcagtggtggatcaaccagcaatgacagtcaaaactttgtagtttgctggcttttcagttgtaaggtcagccatggactccatgaagcctctgggaccctgatccccagcacatccactagagggggagcaagggagacagaagaaacatgcaatgagtggtcttggggtggctaaaagcctgggggaagtgctatatggagtggataggaatttgaacttctagaccaacgtatagtttccggatattgtgagtgtctgtggaatgcgataatcgatactaacctcttggtctttaaaatggtgataaagacttttttttttgtcctcaagaatcacatggaaagcaccttaaaattagaatctgtttgcattggacatcagggatcttttaaaattacattttaagaaaaaaacatgtggaggaaggttaaatttgatgtgaacaatccttgaaaaccaactgcagacatttaaggttaacgtgtcttattcccacaacataggcaactttagtgttttttgcagtcatggaaacaagtttgggttaaatgatatagagatttgaagctttactctttgaagtgaagctaaaagatagaacaaatggaatatttcttgtatttggggagaaagaaaaatcatgattccacagtaaagttagtattagcggtcatgttccgatgtgacaatccaaactagaaatgtggggcaaatttctatttctgagactccaaattaaaaatcttggagctggattttttcacccttagcatcgtgtactctgccttgataaggaggagacaaaggataagccaacaatcttttaagataataaatatagagagatagttgagatttaacccaatctatatgtctcacagcaacatcaggggttttgatgacctgaatcatccaaagaaagaataaatattgctcagtaaggatttaataacaactaaattttttttattgtctgagtcatggaaatcagtaatccttgtctatagtgtactgatggctcatgaaaacattaattctcaacaatatatagtcaattcccaccaatcctaaaagcagattatctaatatgtagattatttctggcccttctgccctagtgacaaagggaaaagtcgggcctttgtgaatggatgtgattgaatagctctataagggttggtgtcgacaaggccaaagttagtggattcttcattatgattcatggcctcttgtagtcagaaacacccagcaaactgagccataaccacagctctgggtttggttgctttgatcttagtcaatgacctggaaatctttcttaataataggagcacacagattcattctgtagcacagcaaattgtttattcttgtttgggtcaaattgtttagggaaggggttgtgactgaggatcttacttctggaggcaaggaatggtgggctgaatttatggtactctttcctgccctgcccttgtgcttcatgaagatgatggcacaacagctgtggccttagtctttacccaactgctaatatctaataatagttactaccatttactgggtactggactgtgacttttacttaccttgtcgtttaactctcaagaaaaagctaagaagtacacattattgtttccatttcagggatgatgaaactgagagtctgagaagtctgtaagtatagtatcagtaactgctttcattggaatattgtgcagattcataaatacatacatagtgctggggtgtgtgtgtgtgtgtgtgtgtgtgtgtgtgtgtgtgtgtgtgagagagagactgagcactggacactgtgcctgggacaagagaagcactaagtaaatgagagtcacatttttttttgtccgacatagcactgactattttgccaatgcctacctagcagattcaataggtaatggttgaattgaattaaaatctcactaaatatttttcaagttggctttccttctgtaattagctttcttacaatttgagtggtaattggttgatggaaagaataattaataataaaggttgtttatttgtggggtgagcatttatcactgttctcattttcactcttttccatcagcatttaattcacgaaaaggagtataagttaactatagagaaattatattactgaatattgaatggcaattacaatacataatatgttttccttttaattagcaaatagactgttcattatgttttagataattgttacatatcacttcattttatttctttatcatttgtggcaggtgattacgtttccacagggtataatttttaatcacattattttgaaatttgattgcaagattatgcagtacagaattcagtgtattcaaatcaccctgaatctctcacattctttgcttctggaaaatttgcccttctttcttcttccctgaatatgtatgataagcaagaattcaaaattaatgaagcccagtactggtgtaaatctctctaaattgctcatatttagagatctttgaacttgaactcagaaacttcaacttgtgtcccattgcaatagccatctcttttaaaatcagtctttttttgctaataaatgcaaataatgtgtaagtgcaaataataaattatataataaaatagaatagaatatataattatctgatattataatattatatatataataaatacaaataataacatttctgactcctcaaggagctaaatagcatgtggtgtgttgtttctagctttcttctctcctgtctttgagtaattgggctgatcatgcccgttgttgcctgctatgggattgacactgcaagtttagctatgacaagaattcagtagcagtgtacaggttgcttgaacacagacagacctccctgcttctgttttggtaatgtttataatgaaggaaagatcataggcagcagcacctattacaattattgttatattcaggcattggcagatatggcacccagatgctttgctgcagtttgtcttaataactggattatctgatttcctacaagttctgcaatgacaaagtggcagcctttgggggaaagtttcatagaatgagcactgttttaggcaaggcagccaacttggtttaaaatcagatcctatcagaggaatgagcagagtctacaattataggtcatacaaagattgtgaagatattaaacgtgaagcaaaactctttaatttccttatttaattttgttctgaggagtttaaataatactgcttaatgctatcaggatgatgtcagtacttcgaggaaataactttcctatttagacttggtcatgcagtctgtttaacagctatttcctttataatggcatgttgcatttcccagcattccttagggcatgcaaggagaacggcatggtcttcttgaataattaatatggttttctgagcagtagtcatggaaacccaagcagtgtcacatatttggattataagaattaggcacattttgaatataacgtttaaccgaaaaggtggctacccaccaaaaacgaaagtctttttcccaattcccctagtttagcgacatgaatgtggtttggggtgtgtgtgtgtatgtgtgtgtgtgtgtgtgtgtgtgagacagagaaaaactaatccttgcttcataatacaattatttttatatttttgtgtttgaattgcttaattggttctcttcgctctatttttgaattctctgtttaattgaaatgttttcacatgcaagcttctgttttcatactttatctagggctgctcagtcacaggttattacttttttattaaagagaaaatgtagaacttaatttacaataaaatagcatagaccactcactgtcttgagtatctctaaggtatcacatcctttctaatgctgccccaaacctctgatgttattaggttgtaagattttcaagtgtgttagacaattgctattcatgaaaaagcctagtgttactgcgaagtttctagacctgctctattagaccagttgtatatatggttcttttatttgtctcaaaaagtgtctcttcagaatcaatatcgtcattaccttggatgtgtgtgtgtgtgtgtgcgcgcacacacgtgcgcacaagtcaaccaggcaatagcaaaaagctatcatccagtcttcagtaatggtgtacgtgaaaagaataaaaataactggaagttatttatagagtataaaccctctggtttcataaaccgtgtatgctgctatttgctcagttttattccacaaacaactgcagtgtctaaggctcccaaacctctgctttcctagactgatgaaggaagtgattagtaataccattaacaaataacagaagagtaaaaagaataaagggaagcaaagatttctttttgttactacttctagttttctgcctatttaaaattgtctttcttacagaaatgtgccatctcatggaaggaagcccacacatgtttgaactattttcttttgcactttcatttgttaaatgtgcataaatagtggggatcttcctcggagctccagatttttctctcatcttacactgatcctttctctatggtgaatatgctcagcggcatcatcttttttcccccaaatgcctttacaacaaggtattactgtgtctcacttgcattagggcccacctactttgcacccctgaggctgtgcctgtgctttcattaggattccaactgcatcgctggccaggcttccatccatctgttgataagttgcagctcctctgcgattctttttggaattaccaggcaaatactggactgatgcttcagcaaatccccaaattctttctttatttttatttggtcatgtgttacacttactttcactcttggcctttaacttttctgtgaactgacttagtcagaaaattccaattggaggtgtcttttcttatatcattttgcttgtgcttttaggttttggaaatttgtagtcctgtgcttatgaagtttacctgtttgcaagggcttgttgacttaatcccgtattatctccactttatcccttaggctctctccctgacagtccctttggttgtttcttaaaggccaaactcattttgataacttcccagcatccttcttctgcctcatcatttttctagattatttctttgaggactccacttaagagtcatctcttcctctttcatggtaccagcccctcccagtctgaaccaagtgccccatgtatagaccatggcatgacactaataggtgcgttgaagggatcagcttttatgtttcccctgctgcctgaaaactttgaggttcttgaaaacaaagactgtatgttattcatttttctatcctcagacctttgtacattgttcatcacatagtaggtgcccaatacatgttcctggcaatgttggttccatgttaaaggttgttaggctgcttcattttcttactgtggattatttttgttatctatagatgcgttctgttttgggggaaaaaacatcatgggatacttggagacatatctgtcatgtaactagcactttgcagggcaaaaatatttgaatatggactgtgaaacattggttgaacgaattagttttttctttaatgtgtggagggcatccagggacataaatgttagactctagacttttaggcaaatgttttagaaaggcacccctccccagtgaaaataaagtcaccattgtcaccttaattaattacaaataaaaaggtcttactttgaggtgggttccactagaaaggatgccttttcccagaggctgagctcagttgcagattttgtttctaggctacacgttagccatgcctgttagcatggcagctaagttgttttgaagcatcagacattagggctcttgtaaacttatagaaaatgtgtctatgatcaggaatgtaagcactctttgagtgatccagcagcagacagaatcaaatagtaatttggaataaaagcatttttgttgtgataattaagcaccattgttagattccatacgctgaactgaaaacccacgtatgtctgtaattgatggctgaaatggttgaatatagcctccgtatttgttaccagattggctccaatatatttggtctgtaaataacattggagtagtgcacacatctatagggagctaagttttacctgagatgcgcatgcacaattttctctgagttcaatgcaaggccaaacacaatttagtttggtgaataacaggcttttatcagcagcatgtatatcacagctacacgttttgaaaaataaagcgattgttgtcatttgccatagtaaaagagagttgtctgttgtaatatatttaaatgatgctgttagtcatttatgccccaacataaatgctgtttcatgtttgttttattaaatatagtagtatcgaaagaatattttgttgctcaaagacctacatgaaaactggactaaataaaattaaggagctatcactgcatgcagtgtgtggaaaccaagtaaaaagtttgatgttttgttactgtgactggaaaactcgtcatgaaactgacagctgagctttattaaagcatttaatgtgcaagatggccaaatagacatgataaaatatgaggatttctttagagtaaataatttgaggtgctatgaaggacatggaggagtggcagaattcagcctggagttcttgtgtgtactaagagtgaaaaagggaggtaggtcagcgtctcttttgcagtcccattaaactaatttcctttgggtcaggcatcactattgtgcagatagtgcatgatttttagagataacatgtaactttgcaaccctctctgctgccaagttggtaagagctcagagactgcaaactgagctgaacatgctatgctgtttataaaccaaggtgcatctgtggaactagtactttaatacttgtccaagtagtgctgcatttgcctggatacacttgcccattcatatccaggggctttttgcccagtgcctcctatttgccagatggctgctactggttatgagtcagtgaagcctgtggttatcaaattgaactcagcttctaggaggctcttagggggcttatccttggaaccagcccatccaccttttgtaaaagaacccccaagtaaaatatccgtcattggatatttatttaaggggaaaataggtaaaataaaatgaaaaatattatcttcctattcttttagccaagtctcttagcacggtagctaagctgttttgaagcatcagacaacagagctcttgtaagtgtaaagaaaatgtgtctagatcaggaatgcaagcacccttagagtgatccagcagcagacataatcaaatagtaatttgaaataaaaggatttttgttgtgataatgaagcaccattttttcattcagatgaagttgtagaaaagaccaaaacaaaattttaaagaaaattatttgaagttaggcacatttttgaagaaacaagttcataacagttttatatatatatatgtgtgtgtgtgtgtgtatatatatatgtgtgtgtatttttaaaaaataagcttaggtaagtgggttgaaataaaataattgtacttcttaatgtaaataacaaatcaattttatactattattacagctcttaaaaaactttttattttgacatacagaaagttataagaatcatggaaagaattctcatatccctattacccagattcctatgttgacatttgtaccacattgcttccttcttccctctctcacaaatatatacatatatgcacctcctacacacaaacatatgtgtatatatacacacatatatacacatatgtgtatatgtatatatacacacatatatacatatgtgtatatgtatatatacacatacgtatacacacatatacgtatacgtatacacacatatacatatacgtatacacacatacatatacgtatacacacatatacatatacgtatacgtatacacacatatataatatacgtatacgtatacgtgtacacacatatacgtatacgtgtacacacatatacacgtatatacgtatacgtgtacacacatatacgtatacgtgtacacacatatatacgtatacgtatacgtgtacacacatatatacgtatacgtgtacacacatatacacgtatatacgtatacgtgtacacacatatacgtatacgtctacgtgtacacacatatatacgtatacgtctacgtgtacacacatatatacgtatacgtctacgtgtacacacatatatacgtatacgtctacgtgtacacacatatatacgtatacgtctacgtgtacacacatatatacgtatacgtatacgtgtacacacatatatacgtatacgtgtacacacatatatacgtatacgtatacgtgtacacacatatatacatatacgtatacgtgtacacacatatatacgtatacgtatatgtatacacaaatacacttttttcctgacttgtttgagaataagtcacagacatattgaacataaagttcaatgtatacttactaaaaataaagattcttttacataagcacagcatattgatcaaaatcaggaagctaacattggtactaatctatctaaatactttaatctaaaggctttattcagattttgccaatcgttccaataatgtcctttagagcaaaagaaaatccagggtcacatggtgcattgggttattatgtttcttaagtctcctttaatctgggacgttcctcgctctgtctttgttatttcatgtccttgatatttttgaaaatacagggcagttattttgcaaagtgtccttcattttgggtttgtcttattagttttgtctttgttagttttctagtgattagagtcgtattatgtactactggcaggaataccacaaaagtgacgttgtgttcttctcagtgcatcattttaggaggaacattgttgatttgtcccattactggtgatgttaactttgatcatttgcttaaggtggtaaggtgatagaaagcttgtcacgataatgccaggtttcttccctataaagttagtatttttttctttgtaaatagtaaatatcttgtagggaagtactttgagactatgtaaatgatcttgctgctcatcaaaattttacccacaaactaattaaaaaataagaaggacatatgaatatgctcatttcttcaaagagcatatacaaatgtccaataagcatatctaaagatgctcaacatcattaatcatcagggaaatgcaaaccaaaacctcaaaatcaaaaccacagtgagataccacatcacatctgctaaagtaactatgcttaagaagacacataatgacaaatgctgaaaaagtggagaaattggaatcttcattcattcctgctgagaacatacaatggtatagccactgtgggaaacagtttggtagttctttaaaatgttaaacatagagttaccatatgacccagcaattttactcctaagtatatacccaagagaatcgaaaacatttgctcacaccagaacttgtacacaaatttttatagcagaactaatcacaataaccaaaaggtaaaaacatcccaaatgtctatcaactggtgagttcacaaacaaaatgtgatatatccatataatggaatattattcagccacgaaaaaggatgaagtactgatgcatgttacaacttgtacctcaacttggacaaccttgaaaacatgctaaatgaaagaaggcagacacaaaaggccacatattgtatgattccatttatgtaaaatgtgcagaatagacgaagacacagtgacagaaggtaaattagtggttgtaactgtttagtgatggaaggatggagtgcaactgcttaatgagtacagggtttccttggggttaataaatagtgttctggaattaataatggttatggttccataaccttgtgagtacactaaaaacatctaaattatacactttaaaatagtaaattgtatggtatgtgaattgtatctcagtaaagccattacaaaaactgaagtttccctcactagatttagcattcattgacaattctgctgaatcaattattattgtggtggatgccaaatggtgatttttttaaaaataggctttatttttaagagcatttttagtttcatagcaaaattgagcagagggtacagagattttccatatgcaccctgcccccatacatgtatagccactcaccataatagtatcatgcatagtagtttctatgtcctaaaagtccctgcaaatgctaagtcctcttagcagatagagttagaaaatccatgtgtatacatatgttcatatatgcatatgtatatacacacatctattatatattttttatctttctttcatacagacttcaatatagacaaagacacacattaaaagctacaagtttgtactcatactctaatttccatctgacataacagggttcattctttctttttccttttccgtatttataactcctttttctgacactgagaaacctgagtccaattattcactatatattaactaattaactcaattctagaatacacggaaaagtactttcagaattgctaacccatgacactatggaaagaagcctactagctagtgtacaatatttgcttagagttatttttgtctttagcctaaggacatatagtttgaagattgtgtgcaaaaatcacttacattagctcttagtcgccttacgcctccacccccactgtggatatgttattcatttgaaatatacttaagtttgcttatttctgtttgaattcctttaaaagttttgttttttcacctttgtttattttttcttttctttttgtaaaaaaaacactgtgaaacattaacatgctttcaaatgtcagaactttttcatttaaaaaggtatccgggatcttactcaacatcagtttatagagatcttcctcagtttaaagcttattttaattaaataaatctctagtagaggaatgttcaataatgtattggtctctttacaagaaaaaaaaagtcattttattttctgttttgaattttattttcaaattcctgggtctgagaaactgttaaaatggtggcagagtatgtccaaggaaacattagcattcaagagagaaaactaggaaaatgactgatgtagtaattaaataatcaaggaaggtattgaaaaactgaattttattgtgtctgcttgccagctgttaaaatgaggagcccaggtcagcttgacgtagttatttgcccctggagttaaatgaaatgattttttttttttttttgagacggagtcttgctctgttgctcaggctggagtgcagtggcccgatctcagctcactgcaacctccacctcccgggttcaagcgattctcctgcctcaccctcctgagtagctgggactacgagcacattttttgtatttttagtagagacggaatttcaccatgttagacaggatggtcccgatcttctcctgacctcgtgatccgcccgcctcggcctcccattgtgctgggattacagatgtgagccaccacgcctggctgaaatgatcactttttaactcaatgcctacttagtggcaagtgctatttaggacataaaagaaacatgagatttggctgctgactttacagaacatcagatctaattggagaaaccaaccaaacatatacaaaaagaaaattaaatctttccaaattcaggaaaatagaggtgctgttccaggatactaaataattacttgactaaatggattgtccctgcttccaaggaagccctgactcctctgagagtagttcaaaggtgaagtactctgagaactggattgatcggggaatgtctgaggatgagttagggttgagataatttttgggagggcacatgggtaggtgaaaggaaccagggatctactgcagaaggtaagacagctactgggtacaaacataggtaggactgtccagcggttttgatgaaagagctagagccagactccctggatttcactatggtggtcctgccatttattagccctacaattgtgatcaagtcactcattgctctaagcataagttaccctcatctataaaatggagtgataatagtacctgccacctagagatcttgtgagaccaaaataagataatccattcaacttttagcacagtgcttggcacagagtatgctctcaatacacatttgctatttatcatgcaaaagcatgagggcaaggaagcataagatgtaatttaagaagactgagtaggccgggcgcggtggctcacacctgtattcccagcactttgggaggccgaggcgggcggatcacgaggtcaggagatcaagaccatcctggctaacatggtgaaaccccctctctactaaaaatacaaaaaaaattagccgggcgtggtggcaggcgcctgtattcccagctgctcgggaggctgaggcaggagaatggtgtgaacccggcaagtggagcttgcagtgagtggagatcacaccactgcactccaggctgggcgacagagcgagactgcgtctcaaaaaaaaaaaaaaaaagaaaaagaaaagactgagtaaaccagtctgattgcattagaatggtcaagatgggagcagtgggagttaaagcccaaaatatatgttgggaacatactacattgttgtggaaggagcagtatagtagttaatacttatatgcaacttactgtatgcttggcactcatcaatgtgtttttataaaatgtatatcagtccatttctgcctctcgccaaccctgtgagaaaggtattattattattatcctcaatttactggtaagggaaaattgaggcacagagatgctaagtaacttgtccaagatcacacagcttctaagtggagaatcctgggtgccaggtcaaggtgtattaactaggcttgaattataggtttatacatacttggaaaaacttctttacctcacttccagaagatgtgaatatggaagtggaagaattagtagcaacagtggcaacgtttatattaccagaagataatctcagctgcgccatgatggaaatacatattaggcttttagaatttgtagagattaatgttccacaagtgttcatttcaggtaacattagctttctttcctctcataagtatacattattacaagaggataatactcagattgttgaattagagtggtgataagtgttttagtaaacctatggaaacacttctcaatctgagctctgtcagtctgcaaattaagcaaatatatacccagttcatcttttcagtgtagtttaaatatttgagacaaagaattcttcaatatttagagaataggacagatattggactaataagagatgctcctctgaatacttttacatatttcattggtgaccaaagtacttttttattatctatattataattgatatcaatagacagtttaaaccataggatcacagactgatagagcaggcctttagaaattttctggcccactctcttcattcaatctaatggggtaggcttagacagcatcaattacttgcccaaggtcacacacttaatacagcctctcttccctccttccctccctcgctatctccttcctttttggcttcctcctcctcttcttttctccctccatcctccttcccccttccatattttcttccaacaaacatttgaaattggacacattctaggtgctagacccaattctgagcactggagacccaacaatttacgaggtaaaagtgttccttgctctcatcactctagcctatactcttaataactgtttctagactagagcttatacactactccattactctgctgaggattcactgattcagataatctagaaggggagatactttctgcattaaacaaaaacagttgtaacatacagccagccttttgcatattttaggggatatgtacaagaagagctattatttttacattgattctaacagtgtttccaaagccagaaggagccaaccactccaaaattgaatgaccaatgggaaattacttttaaatatattactcatgatgaaaaagcatgcattttagtatatgaatattttattaagcaaagtgcctgtgactggctccagaattttgtaatacttagtgtgaaatatgtaataaattgcataattgaaaaaagaaaggtgattacaaaaacatggcttaaggggctaataactcctagaaagagcacaccaatgcataactgcttgagcattagaatactatatcttgaaaaaggcctgtagtgaaagtttgagttgaacccttaaaaggaaacatcacgctaaagttacctttatctctttgccaaaggaaagcggttgattgttgaaaagtggctgaagttgattgcatggtcagcctggccctaaagtacccttacaaatgagacagaaaatccagagttatatgccctccaactgagaaagcatatttattgacttgaagacatattagtttttcaggcatgcttagagatctactctctgttttccttaggtattattcattctatgtatcttcaagtcccgtaatttcccagacactctgcatactgtttgcccgtagtagatgtcacatgtaggtttgctgatagcattgattttgcatgggtttcagctcccgccaaaaggcagtcctttgagctcctctttagggagcataggtgtgcttttaactgtggtggcttcattagtcttggtcccttcaatgccgttagtggatttttaacagaaggaaactagcctgctcccttactctctgcagcacgggttcttatgcagtacatgtattcacatgggtcttatacataccacagcttttcaagggaatgaaatgtcaacgttaatccagaattggtgatatttgttcatatatgtaaaatgtagacatttctaatacaattatgtgggtctgtcaaagttactccttgaagtgacgtgtgtgagtagtgccatcgctttaagggtggcactcacaaaactggcagaggccatagatgtgcagcagacagtgaaggtttcacagctgtcacctcatcaggcctctactttgttagtccctccaacaaaccagagggaaactgtttatggagggcagagacgggactgattcatgaatcctggattccaatgaagatcatattgagtttgcggagtcgttcagtgattcaacttgcagaaactatcatgtagattttatttctccaaagcaatcattcctgttcacatttttaaaaaaatcaaaatctgagtcttacctgattggtacactttccttctactgtgaaagttgtgctttaagtaaaggcagcaatatcaaaacagtatgcaatttctactagcttaccagtgtagtcatgtttgtatggtcacccccatgccactgtcttcttctttttgatcatctgctctggattgtttgagagagcttgaaccaggctaaactaaagtgactcacagcactccctggtgtttctattgtgagtcggcgtcagaacttgtagaaccgcaaaaacatactcagatttcagttctccatgttcactttagagatcacatgagacactatatgttactgagtaaaagaaactgaatccatgccatggatccatatggcatgtggacagttaagagctgaactaggttggcatttgcagcaggggagttggaaaagtggcctgatcatacctagccagcaggtctctcggtgcagtgacaagacaatcaaattggcaggctttgagaactttcctctttcagcataaggagggaggggggcagagaggcagtgagaggcatttaactgtgctgatgtgactttttaaatttgttgccactgatgccacggacgttaattcttgcagggttaattatgagaaattaaaaagctgctctgaacagactgtacctttcacactctgataaagcaggctctgacatgagaacatctcttcattaatatccatccccaaagggctactacatgcagcatttggaatatgaatcttgaacttccagggacaatgcaggacaccatggagatagggttcagagaaggatgactatgcttcttttacattttcaggaaaacactgcagtgcctgcctggaaatcacctggctggtgacatttggaaaggataatttatttatttgcttgttggtatgttatgagttttgaaatatgattttaacttcatttcatgtagacctcactgcatcagggctctcagtgtctctgtgtaattcatgcaaacaccaacaggtaggcttgcagaagccttgtaattgtttaccatttagtatgtcacccaagtggctctagggtatgcatttgtttctcaggaaaatttcaccagctccttacactaggcacttttccaccagcctaatatattatactaaatagcaatcttgttacaccaaatacattgcagaaagtaaactgtgaaaaaataccagtataaatagtgcaactctaaggcagatgctggggaaaaaataaaagccttcctatacaatatgcttaatttgtattattgtaaccggaaaggccatgttttgaaggaaactcacctagaaatggaagtaggtaaaacagtcaaatgccgtagcagtgttacctttcagcaaagataaagccctattgttcaatggattgggaactgagagcggtcacagagcagctcttcatgttagagctctgttccagaactcaagtgtagttcccccttagtaagggcatctgctaatcattaccaccaaacacgcagttggaaagacattaaaatatactacctattttatactgcagagctggcagtgtgaacacagagcaattcttggatttgctggctctctgaggagctgacagccattggctgttagaaaaaacaaaatatgaaaatccatcaatatgtaattatctcttctcttttgtctgaagatcatattgctcaaagggatataataaggcacaacactgttattctgcctctgcattctgtttcatgcattttccttcctagtgagcgggcacctacctagaccttgcttctgatcgtccactaagagctatttgcatagccatagtctctacatgcttttaggcctccctccctttcttcctttttaatttctcaagcccctgagacatcagtggttctctatgagaagcatccttgcctctttatattcttagctaggaaatgggtgacaaaccccaatgttgcctcattcagtacctcagggcatcataccacatggaagtgttcttggtagcaccctagtggctttaagaaatacccacatacccttctagaagaacccaagaatcatgaggataagatagaaaggagcccaggggttgctaatttccaagacaaggagttgcctcatttgttgtatttgttttccttaggaaatgtttcctactcccaagacccagtaaaatgaatatttttcattatgatttcatagaggggtaaacatagatggggaaagaatcatatgtgcaaaataactggatcgtaactactcttgtggtttttccattcagaaaatacttgtacacagcaactcattggaggagggaggttgtggtttattatataatcctggtctgcaattttccttagatgcacaagatggttgtttctgtttctctttgaattacccgtgttgccctctgggtattatataaacgatgaacttgtatgttcattgaaacattaacaatcttcatccaaaatgtttggcataatttttcttcctcttgaactcattgcttttgctgtgctgctgtcattggtagtatcatccaaatataatattggacctaaatgccatcagcagacatgagccacagggaatagggccataggtcatcataatcatgtgaaatttcttgggcactgtttacatggaaggaacacttgactatatgtggaagcttgtctacaagtcagtcttctggcttaactctagggtaaagagttccaaagctctggaggcaggagacctaggttccaggcccagccctgctactgatttgttctgggcctttaagttaattaaccaacaagagcctcagtttctttctctccttcaggaatggagctaataatcatttctgctctgcttttgttactaagcatcaaatgaaatgctgtacaagtgctttagataccaaaaagtgccacgcatatgctggttattcttgtagtttgtatattattatctaagtccattatttaatggattccagccacaatcaactctttcaaggcatggactggatttattccatcattagcgaagaaatttccttttctgagagggccaagattacgttttgtgtaatcttgctttccatagaagtgaccactttcaagtactaattttacatgcacttgagcacttggcaaataaagtgaaacacttttttaaaaaacatcttttcttttggacaattgttgcaaaaccctgatatatcatttctcatcagggtaaggatatacactgttttcaactgcatttcttgttttcatcgaaaatgcagcccattcacaacttgttcctgtctaaggaaaaggcttgcactgctacatttcctcattagctctgcctaagacaaactcctgtgtcatggctgatggagcctttatgagctttttagccaaatgactgatgtttgcctcgttatgtcagatctgagggcactcctggcatctctctttattccctgtctaacaccatcaatcgagcagctgccatgcacccatgatcaggctgattatgaaaatgtgctcaggagcctgatgactccagttgttttttatctgaagaggccagtagatgctggctagagcttatagttatatgaacagcagattttgtcccaggattagcaggtgagaatcactggagctgagtccatagcagctaggtgagggccatgaaaactaacattggtttattatagaagaagctcctagaaggactggttttggccattttagtcattttcccatttatcccttagaagattattttggccttttcattttggtttcatgtcctagacaagtttattattctcatgaccatgggaagaaagctttttaaacccaaggcctgctataaaaaaaaaaaaaaaagtatatttttcataagtgcactttttaattaagataaatattttttatggggcacatcaaaatccagctgtaccttcatgaagtttccctgaatatatgatgacagcttttatttgctgctgaaattaaaagtgatctgtgaccttctctgatcctgagactgttactagcctggtagagtggtctgcaaatgatggggcttgggcttcattagggcactggcctactcctgtgagctagcttgatggggttaggccctgaggcacgtggcctttggatggagctcagctaagtgcctcatcagcagggagtcagctctataacctcccagctgagcccaggcaggatgaggttgaaacagcctattgttttttctcctctaggcttttttccttacccaaaagtagccctgtggcttttctctcttttctttcttacctagtctccctttgtatcaccttttacttggaaaaccagaaacctgtattataatttagttcagaacctcaggttgttctgaagtgtttgaaatagatcgctctgctgaccctggaggggagcccaggctgaccacaccaaaggacatcctcatgtgttcaggaaaacttggtgagactgtagctggatcttgatatgctaatttctagtcatttctgagaagctgtgcattctctaaaccagcaagttcttggggtgctcaaacaagtgaatgggggtaacaatttttatatttgcttaacactttttataattagtgtatcatggttgcgtttctagctactgacaaggagtctagaacatgggtgggagataaaatacaattcaaggccacctgggagtgaaagaggaagtttggcaaagaacgtaagttttgtaacccttgcctagtgttagaatcacccagagagggttgagaacaaacccatgtccagaatccacacctgaacagttaagtcagaatcacttggatggaccctgtataggaatgttttcaaagcttcccatgtgatttgagtgtgcatgcagccagagatgagaccactggtgtggtagaagaagcatgaacttctaagtcaaagatgggagtttgagccttgtcttatctctgtgccttattggtactgtggacttgggaaaaatcatctaacgtttctgtacctcaggatcttcatctgtaaaatgagaatcagagtaatagctgctatttattgagtgctttctttgtaccagctattgtgctgagcacattacatgcattcttgtttaatcttcacaaaacctcaaataatttgagagtactgtagttatctccattttacagatttagaaactgaagctcagagagtgtgaataatttgtccaggttgtatgaacaatcagcatggaaccagaacccttaccagctcatgtttactccagagtccaagcttttaaccatgattctagaaagaatgaccactaccaaaacaatttcttcacagggatatgaactaagtgagttaatatatgtttaaatactctgtaaactgtgcatggatatatgtgtggaagttgcatattagtagtggtaggagtaaaaagaataggctgggaatttcggtttatgaaacatcagagtcagttgaaaagctgtagacatgcaagcagaagtgagtgggatgcggctaagcatttgtgggctcttgtggctcggttagaattacaagacagcactttagaactgcttagcctgagctagtcaggacttactcgggtctggaatcaattcagaaatacatctggaacaccctcctgaggacctctttgccttttgtttatgtctactaaatttcaagttctttctcagtttacagaagtaacatcaggcacataattcatgttttaaaagaagagagaaagagacgtggttgtcatatgtgaattagctgctttgacttttttcaatagtggattgatcacatgcctctaatttaactcccttttaaaaccacaccaaaactacaataagggattttttttttttaaagaaactcaaaaggactggagatatgtgagaggaaataaccaaatttcagaagctggaaagcatttgagcaaatattagctgatttagcagatctggaaatccaaatcctagcagtgggaaagcttagaatcaatacagttcacactgcagaaccttcaaaaagccaaggaattggtgatagcagatatcccttgaagcaggagtgaagagggtataaaatatagaggattgattgaaagctgtgtaagaagttagatccccaattcctctccctcactcttactgctcttcctttccccagccttgcagaaaatggaactttattttttggagaggataaaacagaggtttgttgtcctggagtacttttctggaaacatggatttttagtgaacaaatgcatacaccaccagctacacacagggactgccagtttgcttccactagaatgctggcagcaaggattcactgtgacattccagaaaaaaagaagataaagagaaaattccacaagcctccagaaagaaggaagaagggaggaaggtaggagagagggagagaataggtatcatgcaatgggacagaatagctttggatttcacagcagcacttgaaactcaaagacaatcctgaaggaaaataacttccaccttaatatttctacttagccaaattatcgataaagtgggaagataggataaagacattttcagacactcaagatctcagagaaaaattgacctctaaccaagtttttctcagtaacctacagaggatgtatttgttcaccaaagagaaggaataaataaaaggagaggaaagcatgtctataggaaacaggagccataacacaggagagaggccaaaggagtctaccagacagtggtgaagagaatcccgatgtagagggcaaccagttgaggttgaagtaggtcagaaagctctgaatgaaatttatgaagaaaatgaaatagatagctaatgtgagtaaatgtattgacaggatttatgcagctagtagagagtttaaggttggattagtgatatgtgcatagaaaaatgaccaaacattaataaaaagccagtcatgatgattgactccaaaaagttgctcaggaaaggaaaatcctagtttagtacatggcttaggtctgaataacatataccatctaaaaattgcaaaaataaaaattgatctaactaaacttttgacgtaaatatgttgggaagatggagggatgacaagtattccagtatgtagtagggaagaggaaagcaagaaggtcaactaaatgctcattttccacagaaggaagtcaatagataatacctaaaaataaaaaaatagcaatccagtgtgttttttagagaaatgaaggcaaatgctccaagaataaaataaagttataagcaattgcttgttgagaagaaggaataatctaggggtgcagtggcagggctgggaactgctttgggtctttaagaagctttgataggtagttgactcttgaaatcatcatatgtatacatcaatttgataaaaatccctaacatctactgtgctctttggcaaatacaacaatgaaaactgccttgagatagaaaatgaaatgcacaaagtagtaatagaaactcctttccttggtgtaggagataagatatatatactcctactaagcaggtgatagttacaaaagaaagaaagaagtccaacagtaaagaagcaaagcctccatcaaacttttattttgaaggaaaaacaatcaaacaccaatgaaatgggctgtagtacatctgaaggaacaagagcgccgcccgcctccaaccacttcatggccacttgtgccctggtgtgactgcctagtcaaggggccagggaagctgcacaaagaccctttcatctagccaggtctctctccttaattgcttgcaaatccagtagagctaacccaaatacaataggtacttgagatgtagcctctgaaaagagcataaagtgggacgactatgttcccatctcctctgacagtaggaatcaggatttccctggaatttcccattagcctcactttttagtatttcagctctcccaattaggccaaatagtgatatgctgaatgctggggcagatcctaaatgtcagttagcgaggtttaatgaaagcaaagagctctgtgcacaggtaagtcatattaacagatatttgtagtcatttgcataattgatgtgactaaatagtttaatcaggagaatattggaaatatttgttacacttttagcctccttttgtattgctctaggataaaaactgtggagataactgaaagtattgactaactcctcaggggatgtgatatatcttttgacaatgaaaactcccaataaattctcagcactactaaggaacaactcaatggaccatgttaacacttcctgtctgtctgtcaccagacaaccaccaggggttactatagctaggctctctacagaaagggttatgacatctgctggggggcagatgaaggggtctggcttaccctattttctatggtgaagctacagttagttaatttgaaattaataatgccttagtggagtttaccaaaaacctctgcttgtggggccttgcaacaaagaggagaatgtttaagccgaaaaatgcttaatgtcttttaaaatctcaagtcgggctgctttgtgtgttaccctatgaaaggccctatgaggtggtggaggagctgaggagggcaaagaggggagtgtggtaatctcaaaaagcccagtgagctggacagcgatttcctttctctgtgccaggtaaaatcagcacaggagcccttaatcgcttgttgttctagggtattattaagtgaatacatttttcatggcccacctgctagtgtaactaattaacagccattctcattaattacattgatcaggatcataaaataatttcaaattgctgagcatgatccgcaggactaaaatggtttcactttaatcccttaatgattttttcatgattaatcaaacaaaatatatgtagttatttgatccacttttttcatcttagaactgcaactcagggcaattatagtcgacataaagttgatacaaacagaactacgtttcatgcagtagctaattaagcaataagacacaatggggtgagggtatatgattatcatgagataatcacccccctgaggagtcacagagcaaaaggtacagttgagtacctctgctcccacagggctgtgattaccttcgcataaccacatatcccgccggcgccttattgctaatcgcaaactcttcgttttacacggaaataaactgaggaaaaatgactttcatcataggaaatggctcgctgcggtataaaggtttcatctattaacagtgacaacattaatgcgtactttggaaggtgaaataatcaattatgctgttctcacatcatcaataggagttgggggattttaaattgatgtttatactttgaagagtacgtacatctggtagtttgggtgtatgaaattaagtatacaaatgctcatacatctaataattaatgtttgatttaattggaaaggtcttgcttttaaggtactagacatttttgaatgaaattataaaataatagtaaggcaactcatttccaaagtctaaaaaagagaaacaaatacatttgctaaattttggccataattcctcaaatcactgccagcattaaaactttcacgccatcttccagccagcaacaagatgtgaccaatgggaacacgaggccatttaggtgaaggagatagttctggctctgagacatggttcgtccccttccccctccccataaatgaataaaaaaaataaaacccaaacaaacaaaaacgaagtaaaatgaccaatatccttcctgtgccatggccaggtggcagggtgagaaggccctgcttcctagagtgccaccatcccaaggcactagcgttctcctatccttgcctgcacactgcatgccatgggaaaccagaattccttccaaccaccagacttagttacttcttcatctaggaacaataacggtgttagagcaggggtcacacaaaagaaaagcaaaataaacagataaaaacctactaccctttccagcaacttccaaacaatacagagtagagatagaatctaatggttgacaaacatacctttggctaccctggctgtgtagtgtttgcgtttaatgtcttgaacgatttcgttcttgttaactataaagagatcccttgtaaactttaatgatattaatcaactaaacttcccatttatcatgaaaaataactatgtatctgatttatgcctaaaacaatcagatttatttcatttcatgtttcccttctgtcgggctaaataattatggttttctcaaaagtggtttctttaaaactgtctttctctatgttaactctagaacggtaacagagtaggtaaatagttgttggctcttgaagaggttcatccaaatttgcccaagtttgtctcaaaattagaatgcctggtttagcatctgtggacttcctgaaggaaatgcaatcatgtgcttattgtgaccctgtgaaatgaatataagttgtgtcatatgcaggatgcattactgactttatgacatgcatgcattgaaaattgagtacgtcctatatataaaagcatccttcaatttcttatattatgtttttaaagtaagtcagttaacaatatgatgaattgaaaaatatatatgtaaaacaactggacatcagattcaggaattttccttaacatgttggtaagtgaagagctgtctttgaaaacaagagtctcactttaaccttgctaaacattcaattcaagccatatggcttgatcagtccaaacatttgacttgatgtggctctgcttggcatggggttctctaccatagagaagcagtttttgtggtcagcgttatgaatgaccaagactttgctgaaaaacaaaacaggcagaagatataggcaatcagtatgatcttgaaacattggcttcatattgagtctgctggtctctcagcttatctcgggttcacagcagcactcaagcttacattatgtattacgaagaggaaatgtcagttattaacttaagtagcataggtacgaattgtaaaagggcttttaaagtgccaaatgctggaaaaaggaaattaaatgtagttatttatgatagagctttagaaatacttagatttgttcttgaaagacctggcatttagattttaaatcatgttcagtcctcgaacttgaacaattcatgcaaaaataagaataaagacatcttcccctataatcatctaagtgcatgtatgtgtatttggccatgatttctgctcccccatcccccaaagcaatcaaccatcacaactttctccttcaataaaacataacactttcttctgtctggtgagttgaaatgatgacaggtgaaaaaattgacaagtgaaggacatttgtaaacctctttcaattgagatcaatttttggtttttgtgtatgtgtgactcttccacatttggtggatatcgtctagagagatctttgcacttgtgaacattgcaggtgttttgatctttccaagctaaggagacttggtagtcttgtgtggaatttagcaacacaataggtctttagatagatagtccacatggtttcaatgaagtgccatttaggaattgctcattggcccaaacaagtaggaggacagcttggcgagacagatggaaaaggctgctttaagaagggatcagaaaaggcattgctcctctgccggcctaaatccactaatctgatgttattattagcgataaggagcagtagccagaagaaaatctcattctctacaaatgtcatttaaataggactctgatattttctggtcaagtcgacgggcgttattcaaatactgagcactttatttgtaaatgcaagaaggaaagaaaagcttcagttcagcagtacttaggacgtcagcttactagtattgattaatcgttcagtagtggcagctgcttctttattaaatgtgcagctcaccatacaaaagatatcaggtgtaggaagtgtttgttgataattcacattttctcacaatgtggcagaacctactcttacttgttcaactactgttcttaggagttcacctccttccatctccagatgcctgccgcccccaaactccctgtgcctgctcccaagtcagttagtaggctgagcctcctccaagcaggcagtgactgcaacatttaaaaaacatatttggaaatattttaaaagtgtcccaagctaagtgtagagcaaatgcaaaggctctgaggtatgaatgagcttggcaagttgaagaaagagaaaggaggccagtcttggcaagaagagagtaattaagttggagagtggcatgaaatgatataaaagaagtagggaggacagatactgtagggcctggaaggccatggaaaggagttacatttcattctgagagcgtttcttttacatttctttttctttccttgtcattgttttgctctttgggaagatcttgctacttaagtactaatttcaattatagatgtagcacatatattgctaatgagtcatattctcagaattgtgaaactacttcttacttggggaatgaggcagcttaagaagctgaaagaattctttgagaccactagaggtactgtttagcaagttatctgcttcacagaaattgtaccccagcgagggcaaatattttctgaagttttctaaaatatctcacagtcggaggtgagtttacactttaggagagcctggcatctatgtaaatcgtcaatgaatttatcccaaattcacctttaagaaacaaaagtccagtaaaaaagctttctaactctttcccatcctttaagatcagttttaagttcatcttcctttagtattctccagctctttaaattttcttggcatttaacttcagtggccctcacttggcattcagtataaattaagtgtgcatgtattacaggcatatcttttttttctccctccaacgagaaagtaggaatttcttaaggttatatctttagtacctgaaatccatatattgtgaatttttgagaacaattattataaaagattttaagttccataaatcactaaaatgtcttataaatttcaatattttaatatcccagcgacaaactctatatgcctctttctgcaaacagcataaaaatgttttgttaaatcctatgtctccattcaataatggttttattgtgctcatcaggaaacatggccaatatattgattattcattcctcattaaataaatttcttttgagtcattactgtgtgctgcatattctggatacttgaggatacaataaataaccagaccaaacaacaagtgatactgttatgaattaaaaagccttggctactagagtaaggatgcatggggtaaagtgatggagtgagggcattacctttaacagggtgctcagaagaaggcttttcagaggaggtgccatttaaaaagagagcttggagaaaattgtcccatgctaagtgtatagcaaatgcaaaggctctgaggtatgaatgagcttggcaagttggagaaagagaaaggaggccagtattggcaagaaaagagtaattaagttggagagtggcatgaaatgaaataaaagaagaaggcggggacagatattgtacagcctggcaggccatgggaaagagttagatttcattctgagagcagtgggaagttgttggagaatttaagtcagacagtggcaagattcgatttatgttttattaataaaaatgtagtcctcttccatatggagaatggattggggggtgtgggattggagggggtgatagcggaggatgagagaagagttggatgtttattatggcagttttctaggtgagagttgattctgacttgggccagggtcatagaaatatagatggagagaaagggaatacattttggaggtaggtagatgaaatttgctcttggggttgagtgaacaaaacgaacgaagaaatgacttgagagtgattgttggggccatataacgagaagaggctgaagaacaggcaatgtagagtaacagttaagagctccaattttgccatggagcagccttggttttgatccttggacatattctctaagcttcattttcctaatctgtaaaaggtgaataatagtagccacttcaaaagttttttttttttttaaatggaatctgtaaggactaatgcaggtaaaatacttagcacagtgcatcataaataataaatgcttagtagataattacaaaggagtcttaggagagaaacaactttggaaattcatgtaagttattttttttaattacataactgatgggactttcccctcttccaatctgaagtttctgatttgacacattaaaaagtcaagaatgtgtctagtgagtcaagggtaatgtcagcagcacagctggctgtcttgaaagatttacctccacaaaccataagaaataacaatataggaaaagtaaattctacactaaaccaaattcttttaggataatttgaagacagacagtgccaaatgtgaaatcactatgtgtaaagaggaaaaaaaaatgtcaccaaatctcagtgtgtgatttcatgattcttccctgactctgctctgataaaagactttgcagtcagtaaggggcgactgagaaaaacttcaaaaagggttggtatgtgcagaattccctaagttcttctatgttgaaaacttttattttctcctatattggtatctgaataacagactggctagatataaaatctagccactttctttcattaggtggttttttttttttcccccatcattgccttggttttgaaaactctgatgccagtctaattcttttgtgttctgtagcttatttttattttagggggagactttgagatgtttatcatcatctttgaaattactagttttgccaccaaatgcattgagctgatcattcaggatactttctccagatgcagtgagccgtttcagtgggttgattcagatctttttctatttcaggaacattttcttttattataattttaattattagctcagttccagcatttttgttttttttttccagggaccccaataatataaatgtaaaataattgttttttgcctttcttccatttacaatacattatttctgcttctttttgattttcttatttatgtaattatcttggttatttttctatatttcttcaatgtctcttattaaatttcatttgaatctattctccctcgtgcactttgtaatttattctttattttttagataactttgtctatttcatttatttattgagtttcattacttacttttcatttattcctgggttttttggtacatctctaattttaggtttagatttctgagtcaaggcagattttcatatcttcaaatgcttttttaagaatattctttttgagtattttaaatctttttatgtgttggattatagttttcttgtactttgcaattgtttcttggaagatgggtttactcaactgaaatgtataaaatttcacttcctgtgccatgacacattcacaaaaattgattatatattaggtttcattgaaaacatgaatcatttttgtaaagtacaaatagtataatacaaataacactctccaattgcaatgcaataaattgagaaactgctaacaaaataaaaactagatggtcactttcatctagaaattttagtttattttttatttttattttttaagagacagggtcttgctctctcacccaggctaaagtgcagtggcacgctcatagctcactgcagccttgaattcctgggcttcagcagtcctcctaccttggcctctcaaagtgctggaagtaaaggcatgtgccactgcaaaaactcctgaatgagagaggacatgcaaattgaaattacagatttaaaaaaaaggaaaataaaacactacatataaaaatctatgagatgcatttaaagcaaagattagagagagattcatttcattgaacacttttaccaataaaaatgagagtggaaatcaatgggaaaatgcccagatcaaaatattagaaaaagaataacaaagtacaccaaaagaaagcaaaaagaaggaatttataaagacaaaatagaaaataatgaggtagagagcagaacaatagagcaaatctaatcaataaatcaaagttctgtgatttttaaattatgcaaataaactattagctaatttaatgaagaaaaagaagtagaaagaaaaactatacaaaataagatatgacaagagggaactatcctttagagaaaaataagttttcaaaaatcacaagtatttacttttcagatatccacatgaagttgaaaacctagataaaatcaataatttcctagagaaatacacattaccaagactgagcttacttgattttaaaagcttaaacagatcaatatccatgaaaggcatagagaaagttatgaatgaactacttcacaaaaaacaccaggccctgatgatttcacagttccaaaactactctgtgaatattacggttgagcaaactgtgaatatatgttatttgaataacatattaatatatgtgaatatacgataatgagcttaggtttctcactgttggaaaaaggagttacaaataagcaaagggggaagtccagattgaaacttgtgttggattgtaattggaggtatcagtatgaactcatgtttgataggtggtagataaatagatataaacatgtatacattcccattatttcctagcttggtttgctgagagagcctagaagtaatgacatcctcatagcaataagcacaccttgcacccagatcttaatttctaaataccatactctgataagtgaaatcagggcctcttggtgaagtaattgagtccggcactggggccagaaaactgtaaactaaacctataatatcttgtgatgctagaaataaggaagtgttgacaaacgatcaaggtgtcaaaaggacaaagaacacaggagccagcacaaaagagcatccaatggtcaaatcatggacaatttagataactaaataagcagtgatagtaacgggttatgatccatagaatgaaataaatatccatgagttcatactgctatgaattaatgagtgagtgaatgaatgaaataccaagtcaccattagtgaaagaccactctgtaattatcgcaggcaagttcaaacaatgaatatcaaaatctatggatgaatatttgaggagaaacagggtgttagcatagtctgaaaatatctcccccaaatttagaccagttaaaaagggaaaaagagtaactttaacaactaagattattgacatcttgaactctctgatgtgatgcactgagaaaagtatgataactacaatattacttctgtgatatttgcccaaaggcataactccacatataatcatgataaaacctaggatacacacaaattgaggaaacttttacaaaataaattaccaggattcataaaaagtctcatgatcatgaaagatgaagaaagatgaggaattaattgtcacagattgtaggaaaccaaggagacacaactaaatgcaatgtagaatccaagataggattctgtacagaaagaaggacattagaggaaaatcttttgaaatcgaaaagagtattgtagtttagttcattgtgttttattaatgttgatttcctttttttgataattcaattaaggtaatataagttgctaacactaaggaaaggtagtcagagaagacacctaaattctctgtattaaagtctaaaattctttcaaaataattaaaaaaaaaaagtcaagtcagccttgtggatagatttgtaaaattttctaaacccaacctgctttttagtagcctgcatattttctatggtgtttccaagccttgtagatgctatagcatgtgaatgctatatgccagatttttcagtttctataccatacaggaattaccaattttcaaacgatcacttagaactaaaactagattgtatgtaattgaatctttgacgattcagtaggcacttcaggactttgcaatacctctggatcatgattataaacgtcaaattatggttgtacagcataggagactcacacagaagtgccaattaacagagattcctggttgagacaatgacacataaatgagtgttttcctaattcaggcctgaattagtcaaagtgaaataaggaacttgctctctttttttaaagcatttactctaaactcacttgagcttgtttctgggcattacacagctctcttgctctaaggcaattataagaaattggcttcgtgtgccatgcaacatgtttagggtcatagacgacaagatgtaaagcaagaaaattgagaccttactataggctgagtacttcaagatgaggaaacagaatctcataaaggtaaagtaactggctcccatgctcactaagctagtaaaagctcttgcccaaatcttccagattccgaaactcaggttccttgaattatccaagactgtctttagaatagagatataaaattatttgagaatttggcctgtgatgttgttttgctgtgtccccacccaaatctcatcttgaatagtagatcccataatccccatgtgtcatgggagggacccggttggaggtaatttaatcataggggtgagttttccagtgctgttttcgtgatagtgaataagtcttacaagatctcatggttttataaagggcagttcccctgcacacacactcttgcctgccaccatgtaagatgtgcctttgctcctccttcccctttcaccatgattatgaggcctccccagccatgtggaactgtgagtccattaaacctctttttctttagaaattacccagtatcgagtatttcttcatagcagtatgaaaatggactaatacagtctatctacattagagggcaacatcaaaggggcacacaaccactctatataaatcctgcaggaataccatttctctcatcatttgaagatttgtatcaattagtttatgacaaggaaacttgattttatatttaattataaggaaaaaaatctcttttaaaaatggttctacaaatctatctggtttcttttttttagagaagctatatactggtaatgtgcctggcaggccattgctatctcatcagaccaagaagagggtttggactcccaatgttgcctatttgccatgtgcagcttttcaacagaataatacaatgagtattctgagaagttgatgataccttgccatattcagaactgctgctaaaagggaatatttaatataccatgcaaagaggcaattgtgttttggaaactagaagtcagtgtagagctataatctagttttgttgcacttaccgaggtccaggatagaatatgacccttgagagtagggtgttctgtaaaaagggacaaaaaagccatggtctggtattggattatatagttttgggagatgtattccaggacttacagcactggttttgacataccccattgtgtcaacaattttttttccaaatggctttatgaagctatcataaggtcctcaaagcaaaattaatttgaattagcatacacacagtcacgtaactatacagtacttccataaagaaatgggaaagatgtcatgaaatctaagaagcacagatgtggaattgcatcttcagaatccatggaaaactctggctacctggtgacttttgtgtagttgcttggctctggaggaagctaaggcttgtattctttattggtaggggagtcagtggaatactttattttaattaattaattaatttttagggacagggtctcactctgtcaccctagctggagtgcagtggcgtgattgtaggtcactgtaacctcagacttagccatcctcccactccagcctcccaagtagttagaactacaggcatgcactactcatgcccgcatgccagctagttaaaaaaaaaaaaattgatagagacggggtctcaccatgttacctgggctaggtgaaatattttaaacacttcctcagacatctccaaagtctacattttacattcttgtcctgaaatccaatcttagtttctaatggcgtatatgtgtaaagatgcttttaacaacacgaatgtttagtgtggcatagaaagtccttgagccaaatcctgccttcaatgtgcacttaagtttccattaaaggagagtggcaactgagcttatagagctgagggtaacatttgaattcttttataagaaatcagagtactaggaactaggatattgaatttcacttttacccatgctgacattgactttcctctggagcatcaccaactagtgagatctagttcagttgcatgattttttgtttttcttcagtgaccaaaatccagagatacaaatccagggcttagggggctcgcatatagatttgccatattgctgagggtctgtgagagcttaatcactttcatattttatttataaagcaaatgttccatgacattgaaacattaaatgtattatactcagtcatgtgcaatgtataattttctaaaatctctgattaatttaatatgggtgattttcattctttgatatgtggccttggtgtaatttataacaagctataaatatttgaaatgccatggaaatgtggtttgaggaatagtattaacacctgccttctgttctagttgggttatattaagttctgaatgtacatgggtatgtttctgggatattatttgagctgtggtctgtctgtgtgtgtagtgactggctgaattaaaaggggttctcactattttcttagcttttgatctgaaaccaagtctaattttgggagttttatagcagcattccttttctgtactttgtaattccttgtagaagcagaaatgccaaagtactttgcatgctaactcctctccttcttactccacacacccttcccaactcagtatgtgcgttataaccaggaaataaataacacaatccctgttaaagcctgtaccctgagacacacacattggatatggtcctggtgacattcttcctgtcatggtatggctcagccaacctgcccagggaactacaaggattgtcttgaaatctgatcccttcctgcttccttggcaaggcagttgaaaggggcagcctctgagcaaagtggcctaagctttgcccctcccacatccatcttgttcttaggaagggaaagagtgagtgcaaagcagagcctgtgaaagcttttggctttccctgagcacttcctggtctccactactgagtaatctgaacctcatgaacctcacttcccttatctgtcaatgatgggtgataatagtgcttatctcataggatcgttttaagaattaggaattgcccatgtgaagagagagaggggggtggaagagtgagagcactcatgcacacttggtacacagtatgggtgcattgttattatcgctgtagttctttcccctactattaataattctaactgtaaatgacttggtattgagtcacaggtggtgaaactacctgtttgttgctcacttggcagttaacggccaatccagtaacagaatgtgggattcctgactcctactttggggtttattctacccgatcatgatgctctttgccctcttagtattccatatttaatgatatctatgtttttgtgcatttcctttcaaaacgataaaaaccaaagtgaagcaaaacagaaaacaaatattcttgcaaataacatttagtgagggcagaggaaattgtacttcccttttctgtttctccccctttcattctgagtgagccatagtattacacgtaaaagttgtgtagctgcatcttttttcttctacaagatgagtgatttattatttatggaattggcttgggatttatttatgcaagtgaacttctgccattccaactgcatttccagtgggtaatgtgcctggagagttgtgggggttggtgatcaggccgctgctacaatctggcatttgggaaatggcatcaggttatctccacttagtgacattgggctcaactgatcttatcagcctttccaaagactgctgtgtaatagttgagggtgagaataaaatatgttttaaaatatattttatttctctatataggcatcacaatccctttaaaaggtattcagggagcttgttaaatgggaaataaagctaaggaggaaacaacactgaatgaattatattagttgacattgaaagcagtaacttattaaaataatgctttataattattttacttagcccaatgtttttcaaatattgctctgtcttcccagtattcctagcagagacatgaaaaacaggcccatttatcaactatatgatgtgacggttaaatggaaagttgggctagattttcacttgtgtgaatttgcaccctggaagttggacattcatgatcaagtggtctggcaggtaggggaagccctgggtgaatggttgttgatttaggcagtgagatatttggaaggtaagctttctttggagaagctggctttgctgtcttgtctccaatttgttgaaattaaacactacattcagatagtatggtctaatggttacagtaatgtttgtgaagatgagaaatgtatttgtatacacataagatatattagtttcccatggctgctgtaacaaatcatcacacacttagtggcttaacacaacacaaatttattttcccacagtcctggagttcagaaatctaaaatgggttagcagggttacattccttctggaggctctaggggaaaatccatgacagcaacccctacccagtacgttcccaaactcatcttcctttgcttccttaaaattgctctttcttcagacagactgggacaatcactgtgccctgagtgggctggttggactcctatctctgagccttacatagtctccattctccatcttgggaggctccagtttcaactcctccatgaagccttgcttgcccactccagccttcaagaatttctcctttccctgaacccacccgtagtgggcccagccactcatttggcagttgttagggagtgtctaaatcagttaattgtctttatatgtcaatgggtcttatttttccaaataattataatcttgagatctggggccattccttgcacatttgcatgctttccactcagcatttagtacctagtaagccttaaatacatatttcttgataacagcatgtgtgaatagggattaactttgcagggcttttgttctgggatttattttcctgtgctattaatcaggcacttcatgccatttaaatttattgacctttaatttcttaggaaaccccctcagtctaccatagagaattatgtactgactcattttcatgactgtgaaactatatgaaagttcatgtaagttttgtggtaagctatacaccatttatagttctgacaatagcgacttttcctaagcctccgtccatgtatcagactaggcctatttaaagagagttcttatctatggagatttttcctccctgcttaagatgtctgaaacctctattaacaaagccctctcttcttgtgcattatacttgtaaggcataatctttgtaatttcctccaaggatttcctcaatatgaaagagtaaactgttttaccaaagctattgaatatacattgcttttctaatagggtattttccacctgatactgctgttgctgctgccaaactaagaaatatatgcaaccacgttagcaaatgaacatgcttctaaaaacagacactgcatatgtgggaaaaacatttctagagacttacaaggttaaaaggagacatgatcaccagaccaatcctaggtttgtggcttatgtaagacctggttggtaagctggttattgtccttgtggcagcccagtaactggaagaaacaacatgctagctaaggccagacattttgtacaagagaattttctgattagtacgaaaagataaccaatgtgcaaatatttgtgatccaattggtgaaatttcccaagtgcttttgagaccttggagaatgtggccttcatgaagtcattctttggttctctctttccccctttttgaaacttggctcttgaaaaggagggggagggaaaaaggaggtggtcaatcttttagagaagttagaaaataatcactgtagttgtgtcaaagctgccctttgagactataataatgatcacatcatagattttaaggcagtctttcactcacagtttctaaattggagaggctttttccaggagactcaatagtgaccataaggattgttgttaggcttcattatggcctgcttccattttacatcccctaatatattaggccatagaaatcagaagtgtgaattcagcctttcatttatcattgtacctccccacttatcgttaaatccttaattttgaaggctcaagtggcctattgtgctggcaattagccaattgcaggtgcaaaatcttgatggcatccacagggaggccttggtgggaattgtctgaagaaatggatccgtctttatgcacttggatgcagaatttgtgaggggatgagtgtaaagaatattaaatgcataacagatgacatcccaggaaagaattgcaagtgaaaatgaatgtgaaattgcttgtctacggattgatcttctttgattaggcaaaaaaaagacccttcactctaagccctttacaatagaaatacccaggatacagtgggaatggagacatttagatgtatactccattgccatctgcctaaagagttcaataatggggtggccttcaatgcctttctgtctccattcaataccaaggcaaaatgttcgggcttggaatgtgagccccagcacaatttaacccccagctttatctcccatcacatgccctcatgagccctgtgctatagtctcctgttgtcatctgagccatatctctctctctctctttgaaattcctttccctgctttatatactctaactgatctgtaaagatgcacatcaggtcctcatcacttctgagaaacatttccaggtcattctagccgaagataaaatctttatccaccacattcctgctgcactctgtatctctgtttttgtacttagccgtgaattagagtgatttatgtctcattgatgtgtgtactcctgtaaaacctagcttggtgctttggcaccggttcattaaattaataacaactgtatatccagtttaggaaaaacttgacataagaaaatccgagcacattcttctaaataagatatgtaagaattggcaactcattaacaacttaatggagaggctagggggaccatcagagatggagagctcaattgttaggataaactatcagttgatgcaattagaaatggagacaaaccatttttaaaactataatcaaagagaaagtgggaagtgactgatgatagcttaatttacacacaattttgtgtatctacaagctttgctttatttttattttttagctacacctttctgaaatttcttgcattgttgtaggtggaaagctgaattggccctttgaatgagagcaatgtctgctaatgccatttatgaatctaatgctagaggccagattgaagaaatgagacacagtattctattttcaaccacctggaggtgtgatccctgcttggcaaggtgaacatagatgagatgcacttttacctcatcctagccagcaggatttggaaagaccaaccatcagagtcagcagattcaaaactactatagcaggccgcctcctccatgtcttttcctccctccttccctccctctttccctccctcccttctctttcttttccttccttcctttctttctttctctctctctctttctttcttccttccttcctttccttttcttccttctttccttctttcttttctttctttctttctttctttctttctttctttctttccttcttttctttctttctttctttctttctttctttctttctttctttctttctttcttcctttctctctctctctctctcgctctcttcctcatctttcttttctgcctttcttcctccctttccttctttctttttcacccttatgtttctttacaggcaaagataaaggacaaatcagttttccttaatgaataaatgactctatgcaagagaaagggggaatgatcatttaataactttacattatttccccacacctcccttatttctttagtcccaaagtgaacgtaaatttctgttggctggtataattttttgcctggctccaaaatgttgtcatcaattcttgaaggtttgcagcaagtttatatgtcttttgtcatccagcacaattcatgcctgctttttcctcctgtgacttccatactagggaggattaaagcccattttagcctaagcaaaacaaagtgaagagggtaaaatatgcagcatgcagaatcaagaaatgcaacaatgcactgagaagccaagggcttactctcctcagctaatgcaccatttcaagtctctgtcactggccttcttgcacatagaaggtatgtgataactttgaaagagatcgaatggaattttacattgacagtgtcgttttggtggtttaaagtttagatggagttgtcaaaccattatcgtggctctgcatcataatctctaaaagaaaattactgtatgtgaaattaaaatgaatagtttctgattttcccatctcttttctattcgtgcctttagggggcctttaaggactagaaggcagaatattatgaaaggagatagatatatttattctactcatgagaaggcccaatgctcttggctttgccgcctgtgaatcatcatgtctttcctcccttgaaggataaatatggcattcattccaacccatttagcccattattcttttgtatataaaataggtccaattaagacattcttgtgttaatttctgcattctatgtatgggtagaaagaatttaaaaatatccatcacagcaaatgtctcaaaatgtttcatgcatactgagcataccactcttgcccccctccccaacccaaaggcaataattcacccaatcatggagatttgtgattttgtgttttccacttacctacattaaggctctgtgtatgcacaattcaatatttagatgaagccatatatttgtaaatatctggtgtttttactaaaagttttcatttttatccagatgtctgacatcatagaaaatcagtctaagaatctactctttatatgttaactcattcatggttattcaagcatacaaacagaaagagacatgcttaccttgttcttgtctgcatcccctgcccctcctcaatgagcgagggggtgggatcatcatgttctgaagtgtctaactgaaatttcattatgtgtcttccactggtcatggaaattcattagacaagccactctgggctttaatcttccatttactagccgtatgatcttgggaaagtcattgaacttctctttgcagctggcttctttaactcataaaaatgaaaagaacccagggaagagttgggatcttataattgccaaggcaccattgcaacccaaagttctgtgaatttctttacttctaccttgtatgaaaattaacagttgatgaatattattgtgccagtgtcccttgtgttataatttagcgtactttgaggtgatgttgacatcttgtgtgtaagttggtatacaataaccaaaaacattgttttcaaaatttaaaataaaaggacaacattttcttttttttttaaattttattattattatactttaagttttagggtacatgtgcacaacgtgaaggtttgttacatatgtgtacatgtgccatgttggtgtgctgcacccattaactcgtcatttacattacatatatctcctaatgctatccctccccccttcccccaccccacaacagtccccggtgtgtgatgttccccttcctgtgcccatgtgttctcattgttcaattcccacctatgagtgagaacatgcggtgtttggttttttgtccttgcgacagtttgctgagaatgatggtttccagcttcatccatgtccctacaaaggacatgaactcatcattttttatggctgcatagtattccatggtgtatatgtgccacattttcttaatccagtctatcgttgttggacatttaggttagttccaagtctttgctattgtgaataatgccacaataaacatacgtgtgcatgtgtctttatagcagcatgatttatagtcctttgggtatatacccagtaatgggatggctgggtcaaatggtatttctagttctagatccttgaggaatcgccacactgacctccacaatggttgaactagttgacagtcccaccaacagtgtaaaagtgttcctatttctccacatcctctccagcacctgttgtttcctgactttttaatgatcgccattctaaccggtgtgagatggtatctcattgtggttttgatttgcatttctctgatggccagtgatgatgagcattttttcatgtgttttttggctgcataaatgtcttgttttgaaagtgtctgttcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaatttagttgaattagatcccatttgtcaattttggcttttgttgccattgcttttggtgttttagacatgaagtccttgcccatgcaaagaccccttgaatgttgagtgttgcgtgttgatgcaattcacactcgccttatgtttactccttgtaaaatctttcttgtgtatacctgttcgatagaatcagcgtgtaagaagctcatacaaaatatgtatcctcaagatcgtgtaatatttggttactaaaaagattcactgccagaagagatacaacaaagttcctctgaattatgaagtaaaactttgatttaaaaaatgttgctttccattgaaaggtatctttccacaagggagaacatgatgatagatctttacacaggagtgacatccagggagagcatttagggtatatatacaatgaaccttacttattttctctttctctctctctgagtgtatctgtacatttatatttatgtgtgtatatatttatgtatgaatatctatagtttatattattagaagatgaaagttatttataacctgaattatgttatttctgtgactaactctttaaaagttctaaatatctgtttgagtcattaaaaaaaatcttattttcttacctaagggacagttgaggtttatagcctgtgttagtctgttatcatgttgctataaagaactgcccaagattgggtaattcataaaggaaagaggtttaattgtctcacagttcacagggctgaggaggcctcaggaaacatacagtcatggtggaaagggaaacaaacacatccttcttcacatggtggcaggaaggagaagtgccgaccaaagggggaaaagcttcttataaaaccatcagattttgtgagaactcactcactatcacaagaacagcatgggagtaactgcccccatgattcaattatctccacctggtcctgaccttgacacatggggattattataattgaaggtgagatttgggtgggacacagagccaagccatatcatagccttgagattgaatggatctaatttaaaaaaaataccatttcattcctttacaaatattttgctttatgatgacatcagcagaaattgatacaaggtggatttttataagagggcttcatgttagctgggacagtttatttaggcatggttatcattttcttatgaaggaaacagattgaccaaagggattctgctattcgtagaagtgagcaagtactgaacagggataaatttctagtcaaaatggatgcctactgaacaagacttttggtactgaaagagtattatgttgcaccttttgtcttgctcatgaccctagaccccactgcctgataaccaccagaaggaaagaactccctatgccactgagtgaagttatgatgcaacctgtccagaggccaaagaatattaaatgagaacacccaaggacaccagaaaaaatgagataaacattcttttcttcctgtttcttcctcagcttcttatattctattttccttcactatgacctattattcatcttcaaaatccctcaaactggcagttttgaaggattccacatgtagccttgcatacaatccctcatggctttcataaagaccgtgtcatttgtcctgcatgagtccctcctgacctctcttatcctggggctacagactttctccaagatagctcaggtgctaatgtcagcaaaacaaagctgataatgatcggtactgtgtgtgggagtgcagtctgactattgaaacagcactagaacaaggactttggaccaaatacatagctgagcccagaggttgcattataaaaatgaaatccctcaacttccttcctgcacacacttcacctcattttgctggatggctccaatgtaattgatgaacatattctttaccagagctgttaacaaatagattgagaaaaagtgggtttcatcttttattcctgttattaatcttccaaaagttggtaagatgtccagaagatgagagatagttggaagatggaatgctgcattaatttaagacctctgtgttgatagaatattccagatatgccttctgtaaacaactgtatgggaaagatttatcatagtccatgtatctgaactcccagttgcataagctacatacagaagtcaaacggatgatatgtacccaaatatataacaacagtttttctccatcttgcctccctagaggactttcccaaaccacagtcttgatgactgctatttcacactttggctatgtgattttatgagttctgtgtgatctaccagcatatttttgtttgctttagcaattttaccaagaaatacataattgagattattgtcctgacaaagcattttcatcagtgtgattagaaatacataattttgaagagtgacagtaattgccaccccaatgtgtatgcacttttgaggttagctcagagggactaagtccttagaatgtcgataacatgagcgtgcagatgtagtcagcattgtcaaactccggagttcagtctcaacagaactgtcaccaggactagagtcacaggtgtcagtttttcttagggaagagtgtcttgggccattggttgcataaagtaaggcttgtctctcattgttactcagtagtctagtaagtgatgttcttaggaagtccatactttgtggtttgtggctagcaaatgtgaagggaatgagttaggtggcaggggagctgtgtttgtaataaagattgttttcatttttccaataactcttcaccttcgtaccattgttattcatactatgtgccttagaactcccaaaatgtaaggtaaggacctttaaaaatatatcttaattcattcattttagagaaactgaaatgtacaaattagtgcattttatctctgctggttaatttctgaatccttcattatgccctgggttcaattaaaaaatatatatatatatattgttcttctagtgatttttgggttgtaatatagactgatcttactctggaaaagacattctcatcagaagacctggattccaggctctctaatactaattttgagcatgctttgtgattttgagcaagtctttttacgtatccctaccttatcttagctactcctccctactgggacttttatttttcctctaggagatttctggaacttgttgcctccaaaggaaaagcagtgcctctttaactctgatttttagcaattgtagtaaccacccatttcatgaaaaccttttatcagagctgccaactcataccataaaggatggattcacatttttcaactcttctattttctggtctgccctttgttggtgatttcaatgagtatcaaaatagaatccttgcacaagtaacataactctcagatagcaaaatgatgatagaaagcactctcaaaggagagctgtgcaaggcagtgaatgctttatgagccaaacaagcacctgagtttggaagagacgattccagggagctgtcctggtctagctgccatagcagaagtgatggcaggagctaaggacataccaatttttatgctttcctgaatcatgggatctgtgattagagcaagagcccttttattggacgagcttgggacaagttattggttggctaatcaaaaagtcatttcaagcaaggaattatttagaaattttaacatataaagcattttgttttaatgtgtataatatatatattcattttctaatttttggtggtcttttttggagtattggatgacttattgaagttccatgttgacttttttttgtataaaccacaccctttatccatttccagtttaagtttctttgaagtggaacagggcttacaggcacttgggaaatgatctcagcagttttttagtgatacattttaatcaagtttctctagatattcagctgagtttttatagaaacagtaagtctgtttttcactcatatttagtcagtttatcttatatttgtttcaattatgtaatcataataacaactacaattggcataaactctcctgtggtgagaacgcaactcaactaacaagaacattgtgtttcaggcactctattgaagagcccattagctgtggatatttagctttttttgagtaaaatgtgttaggatcatccattcatttatttattatatttagtgagctacctactatgtgccaggtactctgctaggtgctgggaacatattggtgatgcaataaaatgccactgaccaggagcttacattctagtgggtgagtcagaaagtaaacaagtaaatatagctatagaggtttgtcctatttactttagtctattatgcatgatttgcaattactaaattatgatgttaacatgtcaagagcattaggactatactgctaatttaaccttgttactttaacattgtcaattgtttacttgaaatccagcacctgagtgattgaaaagtttcatattctcaagcctgaaagagtcaaagtgaagtggggcatttttgtcatgtgatacctcctgatgcttataaagtagatgcaaacagcagttgaggcagccctttgcgaaagctctgacaatgatttctattattcagtgcacatgggttgagctgtagtagtcagggtccttcagaaaaagagaaccagtaggagacagtgtagtgtaggtaaatagagggagagagaattttactttaagggattgacacacaaaattgtgggagttggcacatctgaagtctgtagggaagccaagaggctggaaattcaggtaagagttgatgttgcagtccggaggcagaacttctttcctgggaaaccttagcccttgcttgtgacaccttcaactgattggatgagatccacccacattatggaaggttgacttgacttaaagtcaacttgttgtgaacattaatcacatctacaaaatcccttcccagcaacacctaaactggttttgaccagctgactggggaccatagcctggccaacttgatatctgcagtttaccatcacaagcacctactctataggtgcagcgctcagtgctgggagctgacaggctcagtttctatgctcaagagctctaagtcaagactgtctgccttgagtatcagaaccctacaatgtagtagggagtcaattgctattgtctcttgcgatgtagtcccaggccaacctgtgccagatttctggcataggctgtttgcctattcctgccactctccttcccatgccacgttctcattcacttactccttgaactcagcatattatttggtagccatggttgtatagtattttaactgagttgtcactaaccttttactccaactacactgtaagctcttcagggacattatgtgtttgcatcctggcaaggaggctgatgaagatgaagcaggggcttggtagaaacaattcaggtgcagtgtgttgccattgattctagtaggaattgcccagagattaagaaataaaaataaaaagtcatcagattagttctaaaggttataaagatggtatcatataatataaagaaatccacatgctgtatttttctgggcaaaccattgctctttgctgacccttagttttctcatatgtaaatgaaagggacagatgaagtgttctctttgctctaaaagccagtgattttaattgacttccatgcagaagaccatgagtgttatttagtattgaaagaatggcaaacatttgttttttctaaacctttgaaaggcttagagctggaaagaaattgttctttttaagatctgtgtgaattggtgtgccttaaaaaagtgaaatgatgtgtttgtatctcccattccactgtgcctagcttagtgcctggcaccaaggaggtgcatattaatgtttgcagaaactgactgagagaagaacttaaatattggagggtttattttagtcctaatattttatgtgaatgtattatcacttccattatatagttcatatatatgtcccactcaaacatttgaatatatatatatatatatatttaacttggtctagaatttaaaccacttcaaatcatatgaggaacaagaagagttatgttaataaatatataggtaataaaaataaaaataaacagataatctgtttgcatggaagactcgtgtaggtattatgtattaacataaaataaccacagagtttcaaactgcatcaagctagaaaagcaactccagattcatagtcccaagtgtgagcctctcctatcccagttcttttgaaaatttctgcctctttcaacgtgaggtttcataatttggccaacacatgtgcctttaaagcctacagggttggtagaaggtctgtgataagctggcagttttgttattcagatagtgattttgtcactgcaatttgacaaaaactacacatctaatttaatttttaagatgtttctaaaccagtagctctagacatagcaagctaatgtcaaataacataggcttattttgtaagggccaagtcttgaaatttctgacttagtgggcaattttgaagtgtcgaataatgcatcttctcacagttaagctgctttgaatcagcagaggttttgcagtccgcagtcccttccccatcaccacgtctaacctcgtcaccagccactttttattctgaactcctctcctttagcacctaattttgtcattctgtatacacaaaactataatgatctgggttaaaatgtgtttgattccaacataacttaaaaaaagctttctcaggatgtatcagcattgaagttgctcccatcttttaaagcaatgcagccatattaccggcattattttactttgtatacctgcttcaatatatatcttatattgcctgtgcagatatttaacttgctgatcatagcaaaatgagtttcaattgatttatgtatattttttctttatgtatagatatacttcttattgaacaatgataatcagaaggaaaataagactagattgttgaaaatcaatgtaattagtgttgatttctctttacatttctttttgtttacatatcattagtatttataaagctaaaataatattcacagttactttcaatataagagaaatcactactgcccaaaactagactatagggcacccaaaatccagatgggaagtaaaatttctgtcacatgtccaattttcccccaaatggtaacagtcctttttatacttgcacatcatctgcatcctaaacatgtattcagaaacattgatgcgtctaagaatggagttataacaattgtccgaggatgtctggaatttagtttgtacttagcccatagcaaaatgcaagtgaacataagaaaaccacttccaacattttgagtctctagttatgagctccattttctccattgttctttttttttgcatgctaattagatgagtttgtctcttgtgaatctatctctgcaggcttctgtaccatttccttgtgtctatgagggacctgtcactcttcactgacttcatcttaataatttgctttccctgggggccttgcttgtccacagggattagctactccaaagaagggatacctaacttgaggctctaagctcagcagccaggccctgtcaatagctgtgaataactgacttctgggcattcagctgcacatgagcttccagaggtgcaagattgatgtgtcccctgctggcttagcatgctggcctgtcctgagactaacgtgacttgtagaactgttaccttgtcactgacagatttgcttagtggtgctgacttttggccccttactcctcccgccaaagcaaaggtcagtgcagcaaaagacatcttcaaaggacaggagagtggtcactctttccagtcagaaagagcatgtagctcagtcagcctcattatcagtcgcatctggcctcccaccaattagaggacacttcatttagtgatctagtgctgcctgtcccttcctcctctggactggatggacatcagaaacttcagatgccagttacctttctttcatttctctagtcttattaatgtgttactttaaaaaagtcacactttctttcctccatcagaaaaatgtctttgttcctaaagatagaggatccttcagccattctaacttagaagggaaaggtaaaatgcattagttcaatttaagcaccaaagactgttatcaccaatgacctgtttaagcagggtgtatcatggggattaatgacagactcaagggagctgatgacccacagccaaaccaaaaggccattaactcccatcagttatttaattcctggggaaaacccgtttggaggtaattattgctgttataaactggacaaaaaacagaggtgcacgagttatattaatgaaccctgatcattttattttataatgttaatccaataaaaaagtaaatggttttaaaaatttgagtttcactttttaatttctaaggaaatgctcctttggaaaaattggtggtgccaagagaggcccagcagtttggtggactctccccctattctgtcttcaattcttaatctcagacatgctgaactaaagagacatggatgtcgggtggtattgtcttagagcagcatctctctaccatttactctttgtggttatttgtgttaatatttagccagacaggccttctgcttgccagcttgcacccaagtcattttactctcctggtgcgagttcaggtctcttcttcactccctcctctactcccacctttgtcaaccatatttggcaagaatgtactatgtccaaggtgctgtgttctattgggtgtaggtgacatggatgcatatttgatattaaagacaaagaggttagatgataggatttctgagatgaaagggggtgcattagtttcctaggatggctgtaacaaactgccacaaacttggtgtctttaacaatggttatatttttttcttacagttctggaggccaaaagtctaaaatcaaggtgtccagggccacactagctctgaaagttttaggaaagaattcttccttgcttcttccagcttctcatggtcccaggcattccttggcttttggctgcattactccaatctttgtctccatcttcacatggccttctctgtgtctccaatctccctctcctttctctcgtaagggcacaagtcaatggatttaggacccaccctaaattcagaatgatttcatcttgagattcttaatttaatgcggtgctaaataccccattttcaaataagttcacattcacgggttctgggtgaacatatattttggagatcactattcaaaatactataagactgggcatagtggttcatgcctgtaatctcagtgctttgggagactaaggcaggagattgcttgaggccaggagtttgagaccagcctgagcaatctagcactccatctccacaaaaataaaaaataaaaaaatagctagacatggtgtcatgcacctgtagtcctagctactccagagactgatgttggggaattacttgagcccaggaatttgaggctccagtgagctataccatgatcccgccattgcactccaacctgggtgacagagcaagattccatttctgaaaacaaaaacaaaaagccaaatgctacaggaagcaaattccaggcaggatcattagagaagacttaatagaagaagtaacctttacatgtagacatgtagaagaaacgtttttcgaggtggagagaatatcatgaggtcagagacacaagacaaaggagggattgtggcaaggatggagttgcagaaggattgaatgggggtcagcttgcccaggcacagaatgtagaggacagaggagtgaggggcaaatttaggagatgggcatgggccatattgtaaccattggcctgggaaagactgaacactgtaaaataagacaggagactttagaaatgcttataagagaaaggtaatgaaaacagggcagtagcaatatcaattgataggaaggactggattctgaaggtaaaatgaatggtctggaagcttgtagatttcatagatggatgaattagtgtgaacaaagagcagtaaagggaaggaggcaaagatgatgcccatatgtcatgtctgtgtgactgggggtttggtgaaattgattaaagaaatgagcaacacaggacaaggagcaagtttgagaaaaaaattgtatcatatgaactttgagacattggagggccaggcagaaatgatcctctactaggtgagatttcagggcttgagttcaagggggtatcacaggtgtcttttatgtagatttgggtgtcttttgtgtagagcacccttcaaagctctgagattggccaagctggccaagggaaagcttatggtgttcgagaaagagcaagcacaaggagagccttggggacttcctcaatggaaggaggagaagccaaaggtgggaaaggagattgtaaagaagaagccagggcagcagaattcagagctggtgaggcccattttcctgaagccaggcaggaaggtgtcaggaaagtggaactgctttgaagtgagagactggtgatggggggacaacactgtgaatgtacctaatgccactgaattggacacttaaaaatggttaaaatggcaaattttctactatatattttctattatatattaatatactttaatttgaataaaatattaatgtaatataccaaaaaagtggaaatgatcaacaatgtcaaatactgtggatgagtctatggagataactgggaagagaaagcaaactacttttaaaatatttgccagagagaaccaaccatgattagaaaggttatttagttatccccaatcatcctgatttagttggcactttgaaaaacatgttagcatattgggttacttcttgtgttgaacacttggcattataaaaaattattggtctgggacaggtaggtaaccaaaaaaaaaaaaaaagagagatttattgggctatgaatgcatggcctccttagagccaaagtggtcatacacattgaagcagagaaagctagctatgatatttgtttctagaagtaaaatcccaattctgatagttaatgatatgctaattgctgtaaagacatagtggcagtttcttcaagactttgacaccttctccagattgatataacagctgcactgtattggaaagctacattctgctttggcagatgaatggtggcagtctctagcaggcatctctcatggtttgctaagatatcagtttgactctaacattttttttatgtgttggttggcattgcccataggagtgagcatttgctctataagtaaatgtgacttttatcatagtactattagatatactgaaataaaatatgtatttcccaaagtgtatctcattttaaagtaattatccaaggaaaatagaaacctcataaagaatattaattggcctcaggtgaattacaactatatgacaagagtttgtgtgtgtgtgtgtgtgtgtgtgtgtgttctgaatgatcagcgaggttgaaggaatagggagaagatgataatctctctatgtctcagttttcttatctgtaaaatgaggggacaggactgattagcctctgaaagcgtactttcaactgtaaatattatgtgcttctaatattgagaatggaacagcaacagacatgcctaaaactttgagataaagctttatatgctttcaagtggcaaattgttagtttactttaatgaatccaaactttatgaagtcaaatatttgattaattgcatcattaatctgtttctattagctgattgaaacaaattgtttattaatttccagttggtaatatgtaaatttataatttaattaaaatctcattatgtattttttaagacaaaaggcacattggtacagagtttgatgagtgagacacagacaatgctatagaatcagttcagctgcaagaaagacaatttgttaccaggctctgtgcagagggagagctgggcctggggccaagctactgggcccacttagaatcacaaggaagctttttatagaatgtgagttcccttgaacactgacatgcttcctcggtgagtctgaaaattagaactttagaagtgagaaggcttctcaggattatcaggctctagtccggctccctgtcaggtatttgaacccacaactcttgagcctgttcagtgggccaagtaaagcttgcttccctgtggatggaaccaaactcaccatcatacaccttcttctctgtgaacccccaggaagtctgctttatcttccccaagctgtgcttcagagattgaaagacagagcccctatgtgccgagtcttgtctttttaaaggcaaaatatacccaggtttttttaacaactgtccacagaacagcgttgtgagcccactctgctttccttgaagctgatacattccattttacctagttccctagagagtaccagaccccacagaaatgccccctgtgtggggtcttaccagagcttctctggtcagggttaccaattaaatgtattttccgtagagacctgtgtgcacgttagtgaagcatcttgatgagggaggaggtttctcacacaaagggcctgaaggtagccatttcccagggggcattaaagtccctcactgggcttaaaaatgtgcaggggcccacatcttggtgatttggttttgattttctggataaatttggggagcagttttgagtgagataccacagataaacatttgcctttgcctttgtagtgtaattattgaccatttggggtaatatttttattccttgttttcctcaaagacttccctgatagttgcaggtgggaaacactgaaggtcacctgggtgcaggttccaatgatgtttccaaggtgggagacagcttgcctccgcccattgccctcactcccgcctaacagtagaacgtttaggacgtttcttttgggcacttccctccattggaggaacggatcttgcagacgaatgtcctctcttgccgctcctgtgtccattcctgtccccagccagcctgccctcctttctatgttttataacttttctgggcagaaagacaaggaaacctgctggtggagtccagagaatacattcatccctgctaacctttacaggttcccctctcatgactgttcatcaaatctctggttcagcctgacctgttcttcatagctgccattccacggttttcctctttctgtgagctgaggttcttacttaccccaacctgggcagatgaattcatcttctgtttctctaaggaaatcaaggtcatttggccatttggcatgagtttcataatctttcttcctctccacctgtcatagtgattctcactgcttccaagtatttgtcaatcttcagccccttcttactttcccccacagagtaagaaataacctgatgccatcccaaattggtctctcattcttcattctgccagtgcatttgagcacccatgaacaatgggatgatattttcctctttaggttagttgcagggttccagaagattatacttgtctaaagactcaataccagagaagatatagcccaaatgtaatgtaccctttatcagtctaagaaagtagtgaaattatattgataaacgatttacaattacatctatagaaaaggaaaaaagctctcaattttgcatacgattgctttaagaaagtttttagagagaggaaatatatatgactgtcatatatatataaatatatacgactgtcaagcacatacgtagaagtacaagggcaatgcgcaacctgactgattgaactgggaaagatatagcaagaaattttcaaattcagacagtttggtacctacacagactgtgaagagaagaataagccaaagaggccagctccctattattctttccccacacaacaagaaggacaacagagaaataaaaggggccagatggctgtaaagtgagttgtaggatacctcattgctgaagacttcattctagtctgcagctaagtgacatttttactcagagctccattgaaaggcagggggaggagggcatgggccagaacccgggagttgttgagaaactggctcataacagccttccagaggagttagggaggtaagtgggagatagcctcagaacagctcttttaataacggcctaacatactcttgtgttttgggagatcacaaggcattccacaaaggctcagatcagctatggttcaaacttctgtttgtgtggatatgtgcaaggttgccagggtaccatgccagagccatgccccaagaacagtaagagaccatgtaaggcacagatgaataacatgtgtcttagtgtctatttaaaagcctacctttgtgagaagagggattctattgaaatgcagccatcattttggatttcactggtctatgaacctggtagtgagagactaaaaacaaatttgtattgaacttgaatgttaacttaataatcaaataaataccttcatgtttaatgcttaaacagaatttcattaaaatttctttgacgttaagccaaattttgaagtgaattggaactggtttgcatttcttaaattggtctttctttggaaataatgaaaaagtgttagagtcttggccgaattccagtgactgtgactcaacttgttaaagttaaattttaatatttacacattacatagtataatatttatactaggcaacagattgggtgtgtagaattcaaaataggatacactttgacttggaattgcagtgtggtagtcattacacccggagaattgggggttatcaaatactgagactgaggcagcccaagcaaaggagtttgaaatataaacactgctaagtgtgcagttccagcttgtacttatgtgttggttttcatgacaatgtgtgctttgtactctcgccgatcattgattttactgttgttgagatacttaggggaaagctggcttgtacatgacaccttctactaggttggatgataatgtagtcagtgagactgccagtgacctcctctcagcctgccaggagccaggctggctcactactggaaagtaggagaagttatgtaaagatgaatgtaatcatagaatcccagaatgtaagaattgcttagcacactggaaactttccagtacaaactccctgttttacatgtgaggaagctgaggcccaatagggttaaatgatctgctcaaggtcactgagctagttagtgacagaaagatggaaacccaggtctccacttctaatccagatagattaactacccctgaatagaaactcacatgtggttacctgagattgatctattcgaagatatagaaataaataatggagaaactcctggatcaaacatccctagattttttggcaatgatgttgtaaagggcattcaagagtcatttatagtatagaatgcaactggatgatactgcagttcctttcaaaagtcagagttccaggagtaatgtgaaaaaatagcagcaaatacaagatggtgtagtattaaactctgaggtctagtgcctagagggcaagggactcaacacagtgccctttctcacccagtcacgatcatacacaaagagattaccgggccaacttgttaggtcatgggcaccctgaaactaatcttactgcttgtctgaaagaggattcgacacattggatgaaacgtgggacagtttaactgcatgactacatgcagcctcttctactctgtggtactgtaatgtaaatctgcctgcctcatccctcaattgtggatgtgcatatgcatgtgcacacacacacacgcatacacaagcctcatcagcattcaccgtacccttatattcagtcatataattggcttaatagcgtcttgttgtccctagaagataaaattgagacaaccacttacaaagaaagcattctgtcagtcacttggccatttagtctccacatccttctttatttaataactctttctaccttgtgccaaaccttgggctttctttggagggcttccaagttacctttttcctaaactaatcccacacagtctggaatatgacagccttttcacatagactggattgcttgcagacactatgtcctgttaagtttgtactgattcatgagcattttaagtgaaacttccaaaactcattttatctgttcagcctcctgtttacaaaccacatgatataagaatgctcttttcccttcctctttcacctttcctttctcccatgaaaaagtgaactaagatcaagggtcagaataacccaaagggtggtagagagaaaagagcactaaatgaagagtcaggagacttgggctctggtccaagtcatgccactgaccgggtggatgacattggacagtcaacttccttttcgtgtacctgatcttccctaaaatggaaaatgatgcctttgatctcaataccctctaataaccctttgattgaaggttgttttcacgctcaattttctcctgttttcatgttcccgatttgaactacaataaagtgtttcgcaggtgtgtggtgtcttttagggtaattttccttctattggaagatgtatcatcatctctatggttgcaatatcactgaaactccttattatcaataaaatggatgggttaatatgttagattttataaatgagtaaccacagatttcatatgactgtaatatgtaaacatgacaaatctgtctttgattgttgtgcccaagtaaaacgtaagagggcaactggggccccacttatctagggaaatcgagcatctagttatttgaggtaattaaagcgtcttgtgtcagactcttaagctacttgcatatgaatagaaaacatttccatggtcacttttggatggttacttttgctgagttttacagaataataataccttacatctctatgtaagtgggacctgttccctcttctctccctctctcaaacatctagtgtctcttctcatagaaataacaagcatagagataaatgatgtgtataaagcaatttgtcttcaacaggcattttcacataccttatcttatttgagggtcacagcaatccccggagatacttaactgttgagaagagtcagccttgcagagctgaagtggctcaactcagctctcatgggcattaaatggcagagcaggtgtggatgacacaggccttcaggctcttcccttcctcacccagtggacactcttcatgtgtgaggtggttctgagaagagacatttgaaagttttcataaaccattctcatgcattaatttgcctcaggaagaattttgaagccctactgtatgtcatgtaatggtttgaggcactaggatgaccacagtgaacaaaccattatacctgtgttaggcaaaataatgccccgcctcccccaaaatgtccatgtccatatatatataatgtgaatacactacaacacaaaagggactttgcagatgtgattaagttaagaatctctggctggggagattatcctggattatcgtggtgggcctaaagtaatcataagggctctaataaaaggaaggcagaagggtcagagtgagagaaggagatgtgatgaaacaagtaggggtgagagaaagagagatctgaagatgctgtgctgctggccttgaagatagaggaacggtcgccagccaggcagtgaaggtggtctctacaagctggaagaggcaaggatatggattctcccctggagccttcagaaggaacgcagctctgccaataccttgattttagctcagtgagacctatttcagacttcctacttccagaactgaaagagaataatttttttgttgtttgaagccattgcgtttgtagtaatttgttactatgaaactgatgtaatacctgtccctagtaactcattatgtatttgggagaatggcaaataaacagccccatcagagaggaataagtgacgttgaagagaagctgcacagtgttggggactggaaactctgaatgcagcctggatgaaaggtgcaaggcttcctcaaggaggcaacaaggaagatgaatcacagatgtttgggcatttcagaaattagtgactggggcacagttttttatgtgtcactgtgcccagggtagggccactccagagggaaatgaataatagcctgaggattctatttacattgaggagcggggggcagagaagtaggggggcccaccactcataggattctgtatcctggcccagcattagtagagttatcctatctgattccatggaataagcaagcccacagcctgggcatcaattatagatctgtgtaaaagctacatatatgcaatatatgtatgagtgtgtggatatatatatatatatttttttcatttagtactcccagcatatatatcagcataatattcgatatccattaacttagggacacactgtggaatttgaaacagctgaagcttgaagtagatcatatcctttctttccagtctgtgttggatcatacattacgatgaatagaggcaattataggcagattcaatgacagtgctgccatttattggagtataattcctctagccaatcagtgctctaagtaacaataaattatgttaaacttccaatattacttgagcgtgtcgagggctatggatcaatgagtgtctgatacttgaaaagcttcagcattcagttcttgttgaatctgtaattaacaaatgaaactaaactaatcatagtaaattgttcatttggctacatttttgttgttgagcacactgagtgctgaggaacaagactgtgaagtgttgcagagcatgggcctgcacccttctatttcaaggtgcccaacagcaaatgaatgcatctatcaaagcatacgaatggtgagttgctgtgatagaatgattcatccttgcaggatgctgatttatctggcttgaacagtatgtgttaataagagattgttttatattaaaaggcagagtttaattttgatagattggctagcaattttccaagaaaatatcagtaaactgagggagttctaaaagttgtgtgtgaaatgtgtgtgaaacaggtagaaaaaactcctggtggcttatgtgaatcaaaattttttccacctattgtaagtaccttgggaaaaaaaaaaccagacataaaagacttcaaaactgcacagtttagatttaaagacacagttattggtagattgtcccactcaattatttagtctttttagcttttgtgcctgaaaaatgacttcatcttgtaaaaggcaatttacattaatcccggaatagtgcttaggatctttaaatatttcagagaagggcacgcactggttcccacataccagcacactgtttgtgatgttcattaaaaatattagggaccacaatgttcagaaactacttagcatagttttgttgtactagttaactatgcaccagtgatgctcaattgggtcttagcattaatacactcataatatacagtgcactgcttccatatggtgcattgggtagaagcatattaaacatattacacaaacagagctcaacacctcacatattattcatcaacaatgcaccaattagacaatacaatggtcatgaaaatcaacattggcatatgtgccccaggtccagattaaagtagatggatggggagaaatgaaaatagaaaaggggagataattaaacaggatggcataaggccgcataggttagactgttacaacaaacccaaaggcacagttttttattgtcctgaggcacagcactgaaaccaatattgtttaagctctaagtgacttattaagtagacctagaaaatttctacttttaggctagtgctgaccaatagaaatataatgtgggccacagatacaagccacatatgtgagtttgaattgcagccatattaaaaaggagtataaagaaacagatgaaattaatacattttatttttactcaatgtatgcaaaatatttcataatggtgtctgtataaaattattaatgctatatttaatattttttacatactaagcctttgaaatctgttatatattttacacttacagtacatcttaatacagactaaccacatttccagtgctcagattggctagtggctcagattgatcagtggagttttggattatttcattacaattgtatcttatcctgcagtttattttatgctcctttggataactggggttttttttcttagaaggctgggagggtggggttgaatgtgtaaactgcagagacagagccacagaatagtccaggaacttgccccaggtcacacaatctctaaatggcagaatcactctcggaggtctttccaccacatgacctcctccttctaaaagtccattctttgtatgtcctgccatatccttgttttccataaaagcacaattatgatctattagctagtcaattaataatgataacccattgtattagtctattattgtattgctgtaaagaaatagctgagactgggtatttcagtccattttcacactgctataaagacattacctgagactgggtaatttataaaggaaagaggtttaattgactcacagtttcgcatgacaggggaggcccctgaaagttacaatcatggtggaaggagaaggggaagcaaggcatgtcttacatggtggcccggaggggagagagcaggggaactgccacacttgaaaaccatcagatcttgtgagaactccctcacaatcatgagagcagcatgggggaagccacccgcatgatccaatcaccccccaaccaggtccttcccttgacacttggggattacaattcaagatgagatttgagtggggacacagagccaaagcatatcacttggcgatttataaagaaaagaggtttaattggctcactgttctgcaggcggttcacacatggcttggcttctgggggaggcctcagggagcttttactcatggcagaaggcaaagcaagagcaggcacctcacgtggcaaaagaaggagcaagggagagaggggaggtgccacacacttaaacaaccagatctcatgagaactcattcactatggcaagtacagcaccaagccatgagggatctgcccccgtgacctaagtacctcgtgagatttggtgctttttgtcaaatatccaaactatatcacccaaagaaagctactctctaaaaaccttaaaataatgtccctttgctctaacacttaggacctctttctacattctagatgaacagaatttgaaagcattttacaatgagagcagggggtggtatagaagaaaaattaactgcacctggactcagacaatctgcattcatattctggttttgccctgcattacctgagtgacagtgaatgctaagcagtcagcccttctgggtctcagtgccttcatctgtgaaatgggaagtcagagtgcctgtctggcctatttctgaagattgctgcaagttttgtgtaagatcatatttgtgtaaggaattgctcagtgaaaagtaccaggcaaatggaagagtctgttgcttttcaaaagagaaacatttaaaaatcccggtatgccccatatttattcatttgtttatttggtaatgacatcaataatctgtgaatttactcaccttcaaaaaaaattcagccatgacagataaggctaatatcatctcaatatacccccagctccgcctgtcacttgcttaactacctactgctagtttgcttgatacaagcatttagtcaaagaaagaacatttgtattaaggcccagtgctagataggagacaagcaattggtgcacacatagttttgaatggaaggctgagctggtgaccccaggtaagcagaggcctctcacctccacaacagaaaacatttgtgccaatggaattgctcctgtgctgccacatataacgtgtttattgtgtgtgtaagggtgtatgcatgtgtgtgtgcagtgccgaggctcaagaatgaattatgcactggtgggtaaatccagtggatccacacaagatgcaaaggataaacatggctcaaattgagtccaaaagaaagaagaaaagcaagcattttctgtttcatattaattggtaggatgtgggctgtaaaatcctctgtggcagtatttggtgtgccgagaatgttttctttattcaatgaggatagtagaggagaagaaaaatctgccactaaacactatcataccaccttaagtagtactaaagataatgattctaatgcagatagagaaaggagctgctatgtcatcaatgatagtaagttttgtttatgaaatattaaaatattaaactgcaaggcattgtccatttttattcactgttcttcagagagcaaatgcaaagttacagaagaattttattaaaaatagcttgcctagaagaagcattgttaaccaaattactatcactgatatcatttacatgtgtcatgtttcaaaagaagactgtgttgttttaatttgcttttttaacaccacaacaaggtctccaaacatttaaataaaacagaaacagttcattagaacagaagaaaactatctgaatatactggtcacaacttgcttaaagcatttctgacagcagccctctgttgaagagaaaattgcacaaattgccagttattatcatttttaataaataagccttctaccttctccctccctccctccctctggcttctgtgtgattgtgttcaacaagcatattttcagtggcaccatttctattaccaagtgattgagctctgatttacacatcaattacccaccttcatggagattttcatgctcccctagctgacatcaatgaaacataactgcgtaaacgctttatttcataccagttttggataactgagactgataactaatcatatcgagagacaacgtgctataatacacaaaacaataaatatttccctttaaaaatctcatctattctttatgagttaaccattcacatgcttatctcagttgtccatttcttcaaggatcttcctgtcactgcgtatctcaaatgaagttagggttttaccctagaatacaagcattcgcaaaggccaaattatcagtttccagcttccccaaggcgtagaaattcttattgttttccttccagtgttgtagatctcttgttcactcttccatgtttgtcgcatgggttcatctttaataccacttcattcatgtgtacttgaattagctgaagtgttcaagtcccagctggaacacagctggctgattttgtttcctaccccaagccaacctgagagtgttcctatggcactttcctcataaagttataacatgtgttactctgcactgcaattgttttggaatggatttgcctctcctgggctgtgaatttcccaaaagcttttattatgtcttttttttttctttttttctgagcactaaacatggtacctggcatgacatagatatccagtaagtgtttgttgattaaatagacaaattaatgtattaattaatattttgtcaacatttgtcagtgaacttaggtagaaaaatatgttagcctgtcatttgttcattcattcagttgagaaatatttattttgagctgaacactgagcttggcatgtttccagatacatgggaagcagaaatgcattattcctctctagtgacagtttcatttaacacccacaagttctttcagacatagcaggaaaggggagaaagaagaatgagttggaaagccaaaggagagttgtgctaggtagagtagaagggacaggattagaatgaatcgagtgcaatatagagtaaaaaagacaaggtctagatgatctgcacacactgtgaggaggcctggagatttcattgtgaaccggctcagaaatgcagtctgtaggtgcatgcatttggtagtttgaagtaaaggtgttggcagggttggttccttgtgacgagtattaggaagaatctgctaattcttcctaatacccctgaagtttgaatgaagtatgaagtttctggtagtttgttgacaatatttggcattctttggcttgtagaagtatcactgtgatctctgcctttaccttcacatagagttctctctgggtttctgttttcacatcttctcctcttataaggatgccagtcttataggattaggggcccgccctagtccagtatgattttattttaactaattacatctgaaatgaccctgtttccaaataatgtcatattctgaggtactgtgcatgagaatctcaacataggaattgtgggttgatgcaatttaactcacaacagggttaccctgattctagtcaggcaccttgttagggcaagagggagaagtgtaacctagggaagagtcacacctataggtccacatgagaaagcaagcctacggtcataacagtttgctgctgccctactttcatactcaggccggggctctgcaggagtgcatggtagaaggaggcagggccaaaaggttaagcctatagggggtagaatttgcctgggcaaaaattagtgagtgcaagtggatcaaagggtttgttgagatgtgaaaacagagtcagcttaaaattgtcaattataaactgctccttaagggcattaatttccttagtttaaaagtaattaagaatactatttctgagaaaatattgttttaaattaagtagttattgaaattgccttgcttatagctaaatgaaaataaaacaccttttaaaagtgtcacttatgagaagccagaaggttatattaagactttgacttggaaaagaattcctgatatttaatgggcctagagaggaaatacttcaggtagctttttcctaatttgaaagacagagctgatctgtgtaagttggctgcagaagcaactggtatggaacttgggacgtggcgcatgggatgaagccaggacacattgggacaggacaagggctcatcaagagcagagggccaagctaagccttgggccactgagcagggtactatgcctgcctcactagggcaggcaggcctgaggaaagaggaaaaggaggaggtgaaggaagaggaaaaggaagacctcatcgatgacatcaactgtgtactcctgagcagcaccacagattccataaactgaaccttgcctcaagccagaattcaaataaaccatgaagtactttagagccatcacaagtattctaagcttgtcactgcctctctgcttcctttctcgtaaatccacgggaccatttctagttgtggaaaggatcctcctgaagtaaatcaagaattagatctagtaactctttaaagctcagcattagtatcaactttgattaatttagatagggaattataaatgagattggttcaagttgacagtaaagagtgaatgaagaaatattggaagaaacatgaagaaacaggaaatatataagaaattgttacctctgattggcaatggggaacagggtggatgctgacaagagtggaagtggtaatgttttatatcaatttgatatttatgtacagtagtttaaatttttgatcatattctaaagtcataaaatataaatgaatacatttgctatattcactatccgattacatatttgcttggtttttgacatccattcaaggcccctactagtcttcaggaagtatttttataagcttccaagtcattcagttgtttgcagctctcttggtttggccatgttgagtgtggggcacttgtaaggcactggtttctgttacaaacgggtcaatgagccatatgaagtgatagtgaagcctcgtttttaattaataggtcagaactaaagttattttaaaatgattttctataaaaatggaaatcagacatgtaatctaagagcatgttattagagcagaaaagaaactcagggatccttagatatctattgtgcaatagagctgtggtagggtatgtgcatatggaagaggacaaggaagtgcttgacatgagattcaaggagataaaatcagacattccatagttgtaaagggataactgacacattctgagctgcttgggggagaagcgaagtaacatttgttgaggagataggcacccctctcaagcagtcagggatattggaccatatctcttagccaacagttatagtgtatgaggacaaaagaatttaatttcactggagaggttgcttttagaggacatttaattggcatacaaagtggttgatatgctgaatactgctgcaggcagatgggaaactttggcttgctagagtcatggtcattctatataaaagtggcatttccattaaaatggaatcccctgaaaatggagttttagtgcactcttacaatatttttgacaatcaatatccatttgagtgtctacctatgcttgcttttctgagaagaatgtaaaccatgctccaatagcccctgagaagccgagatattctgaagatagttaagattttagacataccttctggatcaattgcactgtgcacgttgtgtgagcagagcttaaatatgtggatgtgcctctctgtgaatagagtgcccttctcttctgtgagtaagactagaatcttctttatgaccaagagggtggcctctggattctgacagccccagcggttactgtgtttttgtaccactgactaattgtgtggtgttgagcatgttaacctccctgtgtctcatgtatctcagtttcctcatccgcaaaatgaggatggtataccacttcagagtttttgtgaggattaaataagatagtactcataaaagtcctggaacagtggctggcataaacaaggaatcaacagataggaactattagtgttattgttgttcttctgcacaagtctattcttgtaataactgctttcaccttcaaggcacttttcccaacatataccagcaatgtatgtttctacataatagaataaatacattagttccctaaaggtgtttggtccttgattttccttcatgaaatgaaaagacaaatgatctcttcaggttaagtttgtcagattttgatatgcccaaatgggtcaaataaagaaatttatctattaatataaagaccaggagttattttccatgtgatgcctgggactcacactgtgagatccagatgcagttggtccaatgtatgccctgagcctggagatttataaaatcttctctggatgattctgataggcagccaaaattgtgaaccaagtgataggagaaatatttagaaacatttccaatttaaagttattattttaaatttcagatcattattaatttgtgaattacatttttaaattgaccaacttagtgtctctgtctcaaaggtcatatctgagtctatagaagaaaatttgtaaaggatatctaatgaaattaacttaatctgttactagaaagactttagacttcagcaaccatgaaattttgctatgtttttacagagtaaagaggacccaaaagctataaagagatttacatatcgctttatcagggtgtcagtcatcttatctgttaaatgtgagcagtcattagtagtttacagaagccttttttgataactatcatatgtaacctttacactaaccatgcagagaagacataaagttaattttcatgttcaaagaaggaaactgaggctttaaatgtaaagcaatttattaatgaacaagaaacttgtaagtgaaagtgacagagcctgtcccagatcatctgaatctggatgccatcttttttggacacactgtaaaattccttaaagctttctacctgggaacaaaagaatctgtttctttgactggcatcaggttaggtttctagtaggtttttaccactcctaagtgtattaaattatctttgcagcttgagtatttggtatttgttagagagatgacaacgtcttcttgagtgtttggtaggccagtcaaaataattttgtccaaagcctaagccacacactttttttcaaaaaagcaaatatgttttccttatgacatttgcattgtccattgcttatttatgtacagaaaggttatttgtgttcagttggaggatgcagtgacttaaaaacctctgaccttaaggagggaaaagtctaatgggagacttagagaatcctggttaaatcattagaagaaaacaaaattgagccctcttaatgagcacagtatatcataggaccaggaatatccatacagtggaatattatttaactataaaaagaaacgaagtactgacccatgctacagtgtggatgtacattgaaaatagtatgctcagtgaaagaggccatgcacaaaaaaccacatgttgcataattccatgtatatgaagtatctagaagtggcaaattcattcagagagaaagtagattagtagttgcttagggctgggctggatggtaggattgcaggacaggatgatacctaaaagtgtacagagcctctttttgagttgatgaaaatattctaacattaatatcatggtgatgctttcaagactctgtgaatatgctaaaaaccactgaattgtacactttaaatgggtgaaattgtagctatattagttatatctcaatcaagctgttattaatgaaaagagaggactagaaaagaagcaaagcaggggatacagaaacaagttaggagggatggctcttgggaggtctgcctgacttaattggaggaggcttagacaggctttgcagatgggctgaatctttgcttccattttcagaaatggaggggatgaggtagtcccaagatgctcctacattgaaatattaagcctgtttctgccaggacctctggactattgatgtctacataattttacaaaccacagatttaaaggaaaatcaaaaacaaattggaatgatcagatgggcagctgtctagagctaaaaacttgtgtgtttctcaccttttcattctcttcttgattatttttcatgagagacagtgtttgcagggagatagttcatttgctgaagagagtggtggtatgctgagttcctcatgagtcctgacattaaatatggctgaggaggttctactggttttagaaattcctttccaaggccacttaccttctattcttttgcacacctccagatccaaggttcttgtgtttttactctatatgtgtaaaataatgatggcctgttttgagctgcttttatagttttgaatttagcactttacataatgtgggttaagtttgaaggtattggatagcagagattttcttttcttaacaaaaagaagttatgtagagattagatcagtgtcaaattcaaaataggactcggtatagaaaaagtatcacctgacactctggaacatataacatggataaatatctacacatgttatagaaggcagggattcattcagaagaaccacaggaagtgagtgatagcttatgtttgtcctttgagtggattaaatatgtatttttatgcttttgcaaagatattagccaaataaaggtgtttactgtagttggactggaaaacaagtgaggctgaattatttaccttcatgtacaccattactacagtaaatcatatattagcagtattttaaaacaaatttatcattttaaaatatcaattttttattccccaagtggctttgtaaaataaccaaattaggtaaacaatgagtattagcttcatgaaatatatgaaccaaatggactgaaactggtttttactctccctcgcccagcctcttccccacagatgcagttaatttttataatccctttagggtctgtacattttgatataaggaaactagtggtttatctatactcgaatctaaattaaatccctaaagtttttccctactgccaatttctaataaaatgcagtcctaaggaaaggtgaccaatggagtgcatgtgaaactcatcttcattctgaagtgtgatggaaacacaggaggcagaagggacaaaccatgttgcttgggaatgtgaaagcctgagttccagcctcctagttctctgacaaacccgctgtgaggcccattaccttaccttagttctatttcctcatctgtaaaatgagggcactgcaactagatgattgctaaactctcttcctgttataaacagtctctgttgtaaaagactagcctgcattgtcagcctgtgtgggctaccactgtgcgctaatgaagacggcataattgaactttctagatctcacggaatctacatgtgccctgcattttattgtcccaccaatgaacctgaggcttttaatgagcaaaatgagagttatctacatacaagataaggttcaagtgtctgagagaaggagaaggctaggagaagatactacatgtacttgaagatggaagaaacagattcagatcttcctttgccactagcttgatgacggcttgagacagctccctctgttcatttttggagggccttagtttcctcttttgtaaatgagggcagttcctctgtttgtggtggctagggaagcacacaggtgggtgaaatcacagctaatataaaaatcctgggctgggtgcagtggctcatgcctgtaatcccagcactttgggaggccgagacgggtggatcacctgaggtcaggagttggagaccagcctggtcaacatggcaaaaccctacctctactaaaaatacaaaaaattagccaggcgtggtggctggtgcctgtaatcccagctacttgggaggctgaggcaggagaatcgcttgaacctgggaggtggatgttgcagtgagctgagattgcgccattgcactccagcctggtcgacaagagggaaaactccgtcaaaaaaaaaaaaaaaaaaaaaaaagaaaagaaaaaaaatcctatgatagagagaagcttctcaccatcatgccttacaccaaggtgattaacaaagtagttaaatggaacttgttcttctttctgaccttttccagtcagctagcgtggatatcaatgaaatagcgattccaaaaaggtaacctggagagagagaaacctaaggcctttggttaattcatagtaaatttggttttgagtggtcagtttttatattatcataatgtgaccaattttattatatccaggagaaaaaagttggaaaaatatcctaacttgctaagagtgatgaatccttgagttgagatttttggcttaacttctcagtatgaacatgggttttcatgctgattgataggatcaattcatcctgtcttcatcacagaataaacttgaattgttcataccgatgatatgatgattaattcaggtttttggcttgagcatttctttgtgggctatggagctctttttcctttggaaagcaggcctgggtgtgtaaagatgtatcaaattatcaggggacagacatatactttcctgcagcctctgcagggctcacaggttcaaacacaacctgcctgaatcataagaaatttaattgagtagataaagaggtcctcataattataaactgcagtaggtataacaagaggctaaatacatagctgtggttttaattagctggtgcttcaaattagtaatgttggtttcagtcagaaatcagtgacgttatagactgaaagcctcatcaccatgtagttcattactcattagacctcactgtgtgaagccttcaatacaacgccatgctgagcaagaaaggaaaaagttggagatatttggttgccttccaagagcagtggagctctgtggagattaaattcattctcgccagagatatgagaattaactgttctttgtcggatgtgttaaaaaatgcagcaggcagttttgcttgcaacagataacacccgcatgcacactcaatctgctattcaaatttgtgtctggaatttggtagctaatgaactgatgcaaaatgcagccaagagcctcctaacaaatcaaagccagggctaaagcaccgaaagtgcccttactgctgatcgtttgaaaggttgtcatgcaagctgaagcacgtttccttttcttctccttctcctttctttttccttcagggttttaattatatctttccctcggagaaggaaggtagtttgcaaagccaagagaccaaagcacttcagttctcttcatgggagaattaaatgtgatctatgggcctgtcattcttagctgtcaggtgcacaaaatgaacagatagctagaaaactgacatcctgctcgcattactcagaaggaaaagactttggttcttgtttgtgtgtagatactaatctgctatggaaagcaaagaaattaagtgtccttctcctttgcaacaaccctgccctcactaaatattgctttaacttgttactctacccccacccccataacacccaatctttcttacatttggataaattgatgggattggattacacacagccaatttatggtgttgaggtacggtcacaagcgccacacttaacggactgaagatgttactgtgcctgattgtttccatgtcagtctcaaacatggagacattgagacacacaacaattgtttggggttctgagttcaacttgtgaatggaaatgaaagatgatgctagaaaatctaatacctatggagggcatctgagactacaaataatagcctggcttccagtatctggacttgatatcttccttgaccaggcaaggcctagatatggggccctggctttgggtaggactctgaaggttttctttgctttactcagacagtgataacatttgctgaatatactcatgaatggtccagtgagctttaatgtatctgacgtttgtattatgaaagtgtaatgtgcatttaaacatcctataaatgttgttgctgttttttaatggagaaatgagtgttctttatccaggagataaagttatcaaagtcactttgaatttgaccattcaaggattcctgtgaagaaaagtggatgattaagtgtagtggcattgtacactccatgtttatcaacatctagttaagctgcacagatagtttatgttctaggttctttgagcaaactagcctaccaatgacaggtattaaggtttcggatatagtcaaagcctgtcaactgtagttttatatcagtagatctcttataattcctttagctattatgttcatttgcatgtcaattatctaattaagtcttaacatgggactattaacatggggaaggaaaccaacatttatccaacacctgctaggcattttatgtacatttatgtaatttaaatttgctcagtgtatatatactcactttgggtaaggttaacatcaaaagcatgaaaaaagcccagtgaataaaataagatacaccactacgagacttagattatggcttaatttgcagtcttgcatgatgaagaaaataattgttttcttaataaggaagcattccattccataaaaccagaaggcctggaatatatcttaaatattgtttagaagcttttgatcctccaatgggaaagcctgaaatgtgatgagagtcacagttagtctttataaaacatttgttcgttgaggtcattaaaggcttttgacacctcctttttttcatccacagttagtcatttgttattcaagtcagacccctttttttgtgaagagtttctcaaaaaggcttccattcacttttgaagaaaactgtgagaagaccaacaccacaacaaccaaacacaaagaagtgtaggtgatttggtgatttatttttttgtggacttctgaaaatgcccttaaattctcctgtgagttcatcaaaacaagctcactttggctatgggctcaggacagaaatccaatttatcttcagctccgtactttgataattcctttcccttaggactttgtgacatctgtggattctgagccctaggtagttggcaacacaatgtaactttaattcagtacctttctgcactgtgggctgacttttggggagtatgtaattgcttataataatcaaaaaaggacaagggaagagattttgctttacttgcttgtcatgaatatcatttcaaataagcaagtttttgttttcttctttattctgaagagctggtcaggatcttaaactcaataggtgtaatgaaaaggattatctgttctctatgcagtgtcaacttgggcagcaagttgacttgaatttttttcttattattgacagcaaggaaaatttaaatgacttgcatgattaattaatctttttctctttttgtcttttccttttcatatcagtcactatgaacaagaccgtagtgcacttaaaaaaagggaatgggagcggaggaatcaagaagtccagcaagaagacgatctcttttcttcaggctttgatctttttggggagccatacaaggtagctgaatatgtatgtaatttttctttctggaaaatggttgcttgttacatttttgaactcactaatcaacatttaatttatgtttaaagcacccaactcatttccaggggaatatattttacaagtgaaatttgtacatacactgtatttgaggcaactgcaagtttctgacgaagtcttcagaaacaaatttcatcttcttttgggagcacagtatgattgaagagagacttgtgagacttcctgtctccaatgagcccctctctgcccaacacttcctacagcaaggaatgcccccttgacactttctactgctgtgattgtcagtaggcagctcctgaagacttcatcagaatgtcaatggagatgtctgtttcttttcccaatcagtgtcatccattgcaaggccactgtttttcttttccattttaggttgttagcagctcttcagtggtttgagtgctctttgaaaatcattgttctagaataaaggaaaaaagccaatcatttttcctggtggttaataatcatgggttagaagattgtctcaaccagaggggggtagtatagctaggttgaatttctagtggtattctgactagtgtgtagctccaataatcatcaaactgctgtgtctacaagtattgattttacaatgactgcttctgaactttctatttggggtagagatgagaggcgactgggaagagattatgatggaagaatcttattgaattgctggcagctggttggtttttattgaaatgcagtagcagtgtaattttctgtaataaaaatgatgtaagaagtacaacaatagagaaaattttcaagagctgtgattttagaagagtaccctttaagggacagtgacttctggaaaaggaaagttcttaaggaagacagcataggcccaaatactactttggggtagagagtaagctatttggattggtgactggtgagaccaggttcttgttaccttgttcaaagcaagtaagcaactcttgattgagacactgcaggaactttcaagtttggtaagcctgatgaagaaacttaggtcacctaagctactggttttcaatctgtcagtaatagtatgatccctaaaaaagcagtgttcccatatcaacaggttaatttgtatactactttgaaggtatatatttagatatataattggtttaacaaacatttatgaaggtctactatgtgctagtcactgccttacaccagtgtacaaagaggaatagcatagtctctgttttcaaggagttcctagtcgagtggcagagatcatttgacacagtgatggcatgcctgcatggtaacagagagatagcaagggacagatcagcgaagactttgtattcaaactcattataaagagcttgcacataattttttacatgatgaaaaaaatcattacaaatatttaagtcatagtatggccaggaaaaatgaacagtttagaatgatgatgttgggcagtgtggacagtgggtcagagggaggggaaactaaggaaagataaagaagctattgtaattgatgaggggagcttatgtcaggaatgatttaaggtagagtaaggaagttgaaattatggaattgggtatctaattgcatgtggggagtatggaataagaattaatggttcccaagttttttatttgagagggtggtggtatcatgaacaagttttgttcaggaggagaacatggttgctgcttgtagagaaaaaacaattaatttagttttgagtgcgttggctttgagatgctagagagatatcaggagagagctatccagaaggcttggatatatgggtctgaaactcatgggagtggtcaagggagaagtttagctgttattgtcttataggtatcagtggaagctgtgagaatgcctaccatcactgaagagattatggagtaaaaaagaggacaaacaattcttgggagtagcaccatttaaggggtaaaagaggtggtgaaagcagaggccaggaaaggaaactccaaaggaatgatcagagtgataggaagagaactaggaaagaaaatttaatagaaacctagggaacaaaggaaggatttgctgtgcctcagagaggtcaggaaaggtaagaactttaaagtggctgtttggatttggcagttaaggagtaattggtgaccttatggagagttgttttatttgttgatgacaatggtcattgtgggatgccaaactgccaggggttggagaataaatgggaagtggttaagtaaagaaagcgagacagtcaatgtagatatgatcttgaagaaatgttttgcatggaggaaaaaagaaagaaagataagttagaaagtaaagggaggaattatataaagggaagctttttagaaaaatgagataaacgtgaacatgtttagagattgatgggaagcaaataacttcaatggtgaatgagaaggtggaagatacaggagagaaaggtgaggctaagttgagcaaggtcccggaggagattaaaaataatacaagatggagagcagttgaggaatcatgagctatagggtagaaggtgggaacagaacattagaatgagaacaaagcaggcgaggggaaggaagattggggaagtgcaagaaatcagggcctccattttctgcagaaaatggaggagaggtcaaagcacggtaagtgtcttatcctttctcaagctgaagaaggaataaggagataagttttacatgttatctttggatgggttagaaaaatgagctttactcaaaaggtttattcttaaaatccaatgtccacactatcctcaacattataatgaggtggagaactcttgatttattctcccttcataattttaagtcacgatgaattgatggtcttgtacctttaaggtaaatgccatcttttcacaaggcctgttatatagatccattttttaaatgttagcagtgtctttttgagtaggcagttgaaaaaaatctgttatcaacattttcagaagttttgaaagccatctgtcttgatattacaagggtacatcaagtagagacatagatgggaacatttagtatagtgtggggcagggcctattgtgtgattagtagcttgttacctttgtgcttcctgatggggaaaaaccttgtcctttttttttttttttctgagatggagtctcgctctatcgcccagtctagagtgcagtgcgacttactgcagcctctgcctcccatgttcaagtgattctcctgcctcagcctcccaagtatctggaattacaggtgtgcaccaccatgtccgactaatttttgtattcttagtagagatggggtttcaccatgttggcaaggctggtctcaaactcctggcctcaggtgattgcccaccttgacctcccaaagtgctgggattacaggcgtgagccactgcgcctggccaaaacctttgttcttaagtcaaaactgtgaaggaaaagaataatgctagtgattggtgacctaataattatttttctttcacccttgctttgatgattggttgttatcttgagctgcatccacattcagggttccctgggagaacactgaggagtaacagagtactagaactgatgttgcacctccataaggctccccagaccaagactgggcttgatatccttggagtatctggacatgccagtggtcatgggagtcctagagctggcccatggtccactggtagaaacgaggacataccacagctcttccctaagatagcagtgggagtgcttatcaaatttagaataaacattcctgatggtgggtcaagactttcaggaaagttcttgctaccctgaagcctaaaacaaggtccagtcacctgtccaatagcgccagtggttcataaattagccaacatgaacactgatctctaggacctattatcctttcttggcagaaagataaatggtgatctctcatgttcctggctaatttctttcccttcttttctttgcctctaccactgccagaatggagagaatgttgaccacccctagatttggttggtaatagggaacttctctcttgggctgcttttgtagcatatgattttcaaattggagtttgtgttatgcttttgagaaggatgtcttcaaatgtgcctgaaaaatatgaagccatttgacttgtctaggttagtgcactaagtttggtaaggaactggcatgtaacaagtgcatgccagcttactgtctgctaggcactgtgctagagttttatgtgtatgctcatttagtccttataacaatgtgtgtgttcatttagtccttataacaactggggtatgcaactttcccatgttttccatgaggaattttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggccgaggaattttaactcagagaagcgagatggcttctttgcattttcatatccttatacatggcgaatttagaccttgcatccagttctgtatgattccgtatctgtaacaggaagttatttatcctctgacaggatgtcagaatacttgataagcttacctgctgggtgatggtggagaagaaactccctttctctgatccataggttttctttttcctttctggattgaatcatagtaattaataagaatagtaatattttatggctcttcatagcccaatgagaatgaggaaactgaggtgcacagaggattattaaatggcttacccaaggtcatttgtgttgggacacatagaggtagaggccagatggaggccagagctactctgctgactcacatggttgttttaaggatcacatgaaataacctgggaaaccttgctttgaaatctgtaaggtgctacacaaattcaggtattatctttattataattagagtaaagaaggaaatagaaacttagagcttagagagattaactgcaaaaatactagaattagaaaaagacaaattactaaatcacatgttagccacaataaaataaaagaaaaaaatgcgcttcaaaacttgaattattttgctacttgtattaaaaagaaatactatggtacaatagcctcctagcacattagtcttgcatgcaatgaaattatactactgatttgtagatagcattagaaacaaactgagggaagtttgcatttcctgaagtaatgagaggcaaaaaaacttaaatgagggaatgctgttagtcatgagccacaaaccagacatgtaatttatgcctgaaaatacttggaaaatgcatttcctgatgatagagaaattgtgattgcttagaaaataatggctgcagaggttacctttaaagaatcaaccaattatctagaccaggaagtaaataattagccaaattgaaagaagcatataattgattgaaatggctgaatttcatttttgtcatgtttataatgttcaatcaagattaccaagaatattttgttccttaataggattactaagactctggagggtgaaaaagaacatttagtatgaatcagaagttgctatggtgtataatgagagtacattgtgtaggtgtgtataaatgtatttcaggccccattgggttttctatccagtggttctcatatctccatcttgagaaatttaaaagctgattgacagttacccacctccagtggtgggaaggtagagtgcttactctggcgacctggactggactactaattatgtgctgattgttgaatggtgaacttcttgaggctctgtgtccatgtgtcctctgtgcgtaaccctgcctcaggagggtctcaaatttaccagtgtctgtcttaagaactactacaataattcctacttgtagccacagaacatctgttatgcaaaccatatggatcttccttcaatcagcaactcagaaagcatcaccagtgaactcaaccttgaactgtgtgctatacatttcctgtcacacgtccttccttctgagacaattgctctatgaggaaactagtctaagggagatgacatccctctatttctccaggttatcacagcttcactcctgtgtcattactgtgcaagaaagctgcacgcctggattgtattagcctagacctctaagtccacatgcaggcaggctttcactgagttagtcatcataagaaaaagccacatgaagacatatttgcatcattttggaaaatgaggccccaaaaagtgttacattgctcaagtgttcttgtaaaaatatcagtgagaggaattccttttcacattttattatcagacaacatttgtctcatttaatgaattaggatatgcttctttcgatgaaagataattctataacctacgagcttttcctttttgccttagctaccaggaaactcaaagttcaatttaatgttcaatcatagtaacgaagttagcctgatttttgccttctattatgtacctttgacttcagccattgcaaattctttattttgatatagacagggtatgaattttaatttatcctgttcaattctgtaaaaatgtattgagtatttgattagcacaagacatggtgctacatcttgggtatataaaaataagtgaaatgtagtctctgacctttaagaactcatggttttattcaaggaaagatatcataagtgtagtatacactgtgtagtagaaggttgattttccagacttattgagagaaatttcaattttcctctaattttgttcacatagacacagtgttagacattggccagtttagaaattcttttaatttcaagtatatttttaaaacctagatatggaaaactatatctaagcttgcttcagaaacccagatcattataagtaaatgtcaatgaagagacattacaaagtaggcaaggttctccctactgaggacaagatgaacctcttttatttactcctgaaacaagaacaggaatttgactagcttgcttgtaagcaaatgagctttcacattcttgagtcctgattgtgtttccctaaggagactacaatgacttttcagggcatggaggtattacagtggtctctatgacacctagggagaaggttctgattttgcagagctctgtttctgtgaaagccagataatgaaatgaaggcattccaatgggaagtgaaatggtgttgttttcccttgttgagtcagatcattgaatatggccagatatcactgttcatgaggcaaacatctgacccaagaggtaatctgtttgacaggccaaaacaacctacaaatgtttaaagcttgcatcagattcttgttggaccctcagcacaatgaaatttctttgttttaaatttagagattgaacagggagcctggttttggctactgtccatgtggttcattgtgcaactcagttgaaggagaccactatatacaaagagtttattcttgtctgggctaaaaagtaattcctgccattaaaaatgacaaacctagagacttttaggaaataaaagtgacttctacccatctataacttttaaatatatctttcagatgtacttttgaaaacagagtgattattcagctgaggattatacagaatgttaattgtttaatcactacttcagtactaaggttgcgtatgatacaatatatgattggaggataagcaaactaaaattgacatatagttatttgacttctaaaaatatctgtccctgacagagctcccttagcatatgtttagcatacttttccttaatctttgaaatttatatttctcctattgccctcatttctttggaagtgtctcatatggtttcacacacacatagtatgagttaaatactttttacggtatatggagatggtgctgataatgaggccaagattactggtttgattctctctctgttccttcttggtatcgtttgctggttcctcatcttctctcagtctcttaaaggttgatgcttgccagggttctctgccaatccgtatcttctcattctatgttttctttccccagacgacttcacccatttctagcacttcgccctctagccatctgcatatcctcccatcttcacatacaaaggaaaacacacagccttagactgagatgctagcgctggataggtatactccctgtgtacactaggagactgggctgtgttaagggcatgtgaaaaatcttagatgttaaacaactatcttcagcagagagtgtaccaatggttagatggtcactccctcctgtgcactgaaaatgtgcccatggcttctgggacttgaaggccacatagggtggtatttttcccatccagtggcccagttgccagatggctccttgaatactggtagccttctatcattgcaacatcttgggccaggatagtgcagcctaggtacaaaaaggtcctttggctttctgaattcagcagcttgttttgataaactctttggcatataaagagaataaagaaagtcacttttgggggtgatcaactgagctttcatcaaagtcatttccaagtatacagctacccaccattttttagtcatgataactttgctttctgtattacaaaaacccatgcaggagcataattattttaaaaacaatcacagccattttaatagaaccaatacatcctacagggggtggtgtagctggtatactgattgtccataaaatgagttggttgcctctctaactgctatacattaggctaacatcactttgaaaagataactttgttttggtttccttaaacaacagtttaaatacttgaataaattttccttaatcattgaaaagacacagaagggcttgagtcactgttgatgaacaattgcatcatttcaaagtaaatgagtatgaatcatcaatatgtaaacacagtcattccagaatatacaggcaaacactagtaattcatacagttctttgattagaaggaatcagattcattttaatcatgagttagctcaattagatgctgtttaattccattcctgtcctaaacttattatagtcatggtagcacaatttaactgattttcttatccaatagcctaagcctttttcatggtataatgtggtgcaaaggctgatatgtcaaaaatttatataggtagaaaattccattataactccaatgattggtaagcagaagttgttaatcacaatgtagaatgtagcaattcagctcatctgtcacagaataagttatttttctaataaaattaataaatgatgtaatttaaaagtttttctcaatgaacatgtttaaggactggctagggagtataaaaatgttaatcatacccgctcattccagaagctttttcaatagtgttcttgattttttttcttacatagcacatgaaaagcatgaaattatatggcagcaagacatatttaaagaatcccgtatgatagtctacttagggcatctgtttgaaacattaacattaggaaacacaaacctattcattctctctcctcccacccccatctttttgttattttagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagtaatttttaaagttttgtttggtttcacttttttttagttctctgctctaacctctataatccagtattcacaagcagctctcatttaccttaatgagctgtataggatactcttcaagttcagggtctgaattttgatcttctgtcacttgtgacataactgattaacacgctgcaaatagagttaaatctcaataatttggaatgacagaagacaaggtcggtctgactgaaagaatgacaagttggagttataaaatagtttcataaaatacagttgtggtaatactatgtataaattaataacatttgagattataattggtcataagtagtatgaggttcatgagaagattgcgagtcactatatgccttcactactcagtagcatattctaaacctaaaatacagaagttccttaaagtagaagaatgtagaactgtggtttgctggaacctgaagtagaaggcgttctttaagaattttagtttcttgagtgattacagagctattccttggcaagatcttaatgttttctcccgtatccatcaatcttcccttctgcatctccttcctccacaggtatctacatagcccttttattctactttcatcctttctgtcaaagcaaaaagcattacgagcaaccaaaagcccactggtttagaatgagtaaatatcctacccatctcaggaatcattgccttgtaaaagagaagtccagaggcaccaaagcctcttctaaggaatgaatcgctaatgattggattccaggccttgtggcccctgggtgggggtcatgcatggtgctgcctctcagacactaccatgtaagcggctgtctactgcacctcaagcgtttgattggaagaagccactgcctttagattggattcctgtcactggtgactaaaggcttgaaataacacagaggaagaaagtagggttaaattcttactcaataggagtgacaggcagtctgtctgaatggttgtagattccaagttagtggtatctgagttagagaagtgtgaccctataagcaccctggctctccttcctttatttatcctcagcagatgcggtgatttcagaggacgatgggaacataaagggagggaggcctggggctgttgactatattttctgaatgtatgtttttaatattgtttcatttctgaggcagttttgctttttgtatcatcattcatcaagtcttgtcaagcttcctcttaagtatctctccagtctgtcatctctacccccactgcctttgaaccacctgtgagccttcagtggactgctgtgagagcccctcttgactggtctccttccctctagtctcacctctcttccataccatccatgcaggctcatctaacaggcagatctgaccatgtcactccctgcttttgattattcagtaccttctcatcacttccagggaaaagtccaaatttcttagtcacacatacaaggctcttcaccctttagtttcatactccttttttggccacatatttcactacttcttcatgtgcagttgaaatcccagccatatgggactacctgtggttccctgtcatgtcatgctttatcacgcttccttgctttttggcttgctgtcccctcagcctagaatgtctttccccaccctcccttgtcttcctggtaaagtcctgtttctccttcaggtctggtcagttgtcaccttctctgtgaaagcttccctgatcccctcagcttaattaaaaacccctttgtcttggctcctctagcaccttctatatgccctgattggcaccgactccattgtattgtagtgatttagttatgtttctatctcctctactagactgtgagctcactaagagcaaggaatacctcattctctctgtatcccaagcgcctaggaaatacttagcacatagtagatactcaataaatgtttgttgaatgaatgaatttcaaaaatggttacttgattacattttctaagccacaatgttaatcaaataacatgcacaaatgtgaacaattgctaggaaatccatcatgagttatatctttttcagttgtattctgtctgcctgtttcttactctgctctgctcctgttctgtcattgagaaatcctagccataatttctactgaatgacttaatacaggctttaatacttaaaaatcaaaaaagagatctgctttgaaaaagtacaagtataatgggaggtggggatatcattcttgtttcttcttttgccctggtatctgctgctgttccctccttacacagccagaactgatctggaaatagcactgccccataaagcagtctgtcagcctgtttccatacctcattagtagagtgacaaatcacagacccagcgaaatccaccctgttgtaattctctctcttatacattcacaaaatggctgacccagattcagaaatgacttcatgctttcactcagtgctctggcacaccaacgagaggtacattttcaaagacagtctgagctgtcatcagctctggagacgattatcccaggagcagcctatgtgcttgcagcctttggtgatggtacaaacagaccttgctagagctctgtatgaaaaatgggccaggtgcaataaagtcatgataggagatcagtgaagaaagtacttattttaaaatatgggtttcaaggaaggatttgacagaagagtagagagaagcttaaagccctaaagtcaggggcatatacagaacccaagggtaatgtgaaaaccaaaaataggaggaaaggaaaagagaggttacacggcccaacaagagagcttagaagggtgcagattaaaatgcgggcataaatatagacagggaggagcattatggagctttgaacctaatggaatttatgtggctaaaactctgaccaagtctgaaaattcaccctattaaatcttgatgcacttttcaaaagcacttagcattagaattcagccccagttcctggcgccaaggagtttcaggcactaggttccgggtctctagtcagtgtagccatctttgatgagtggtagcattactctgagttattaccaaaaaggcttatccgtggagcaatcacagtatttctttgagtattctcaactttttccctggctttagtgacaggaggttgatgagtgttagtgaagtgcatttgtggggagggtgaagcaggatgggttgaatggccagaaaacagacaacattctaagctatacaaataagcagataacattatatttatgaattgagagatcacaaactattattgaaatgtgatgtgcaagtgtgtgtgcccatgtttgtttatgtgtccacatgttgagtatatagtggggaaatttttattttttatccttgaatcatttccatgcttcttagaatttctgtatcaacaataaggatattagaagtataaccaactttattgcaaaaggtcagcttttcaattgaggcatgtcattttaacaaataatttgtttaaaaactttctgttggccgggtgcagtggctcacgcctgtaatcccagcactttgggaggttgagatgggcggatcatgaagtcaagagatctagaccatcctggccaacatggtgaaaccccatctctaccaaaaatacaaaaaatagctggccatggtggcacacacctgtagtcccagctactcgggaggctgaggcaggagaatagcttgaacccgggaggcagaggttgcagtgagccgaggttgcaccactgcactccagcccggtgacaaagctagactctgtctcaaaaataaataaataaataaataaataaataaataaataaataaataacaaaacttcatgtcatagagtttattaacattcctggcaacaacaacaacaaaatgctgatgtgttctgcagttgggtttagaagaattttctcggaactgcatctgaaaacagtaaaaggcctatttatatcaagtggaaactgagggttgcttgcagatggtgctttattaggaaatgaatttgttaataaacgtagctttatacatttctttacagaaatttttgttcatttttaccttaggataaaaatctgctggtgtagacagctctgcattttggtgcaatttgttattagtatagcttgccaagtaaataatcacatgcacatgaaaggattgatatcacatattaaatgtctccatcctaagtcagtaagcttttgaaagtacaaaactaacgtgtagagtgtcatatccctaaagggtcatttgctttacatgctgctcttggctgtgatctaaggctatctgaggctccaattgccacaaaactagtggccttagaaaactttaatagaaatggtgtgggatttgtctgtagcttattttagtggttagctttgtcaaccagctgaaaaattattgctcacatttgtgactgtgcctgttttgtttcacaccctatgcagtgaacactgtgagtataattacctttatttattgtgagttagatagtaaactcaggtcccttgtgtgagaactgcagagaatgctaggatattaccattgatgttctagatatgtccatgcagctacacagaaaagagacagctgcttcaatgaatggaaggccatccagttgctgtttacaactcatgctaagaatttttcacttgatgtattagtctgttttcatgctgctgataaagacgtacctgagtctgggcatttacaaaagaaagatatttaatggacttacagttccacgtggctggggaggcctcacaatcatggtggaaggtgagaggcatatctcacattatggcagacaagagaggagagcttgtgcagggaaactcccccttataataaccatcagaccttgtgatacttagtaactgtcatgagaacatcacagcaaagaccttctcccatgattcaattacttcctattgggttcctcccacagagcatgggaattatgggagttacaattcaagataagatttgggtggggacacagccaaaccatattaatccacccccagcccctcccaaatctcatgtcctcacatttcaaatccaatcatgccttcccaacagtaccccaaagtcttaactcatttcagcattaactcaaaagtccacagtctaaagtctaatctgaatcaatgcaagtcccttccgcttatgagtccataaattcaaaagcaagttagttactttctggatacaatggaggtacaagcattgggtaaatacagctattccaaatgggagaaattggccaaaacaaaggggctacaggccccatgcaagtccaaaatccagcagggccgtcaaaccttaaagctccaaaatgatctcctttgactccatgtctcacatccaggtcatgctgatgcaagaggtgggttcccatggtcttggacagctctgcccctgtggctttgcagggcgtagcccccctcctggctgctttcatgggctggcattgagtgtctgtggcttttccaggtgcatggtgcaagctgttgatggatctaccattctggggtctggaggttggtggccttcttctcacagctccactaggtggtgccccaacagggactctgtggcagctctgaccccacatttccctttcacattgtcctagcagaggttctccatgggggccccgcctctgcagtgaacttctgcctgggtatccaggcatttccatacatcctctgaaatctaggtggaggttcccaaacgtcagttcttgacttctctgcacctgcaggctcaacagcatgtggaagctgccaagatgttgggttccattctctgaaatgacagcccaagcttagccccttttagccatggctggagcaactagaatgcagggtaccaagtccctaggctgcacagagcagagggccctggacctggcctatgaaaccatcatttcctcctaggcctcctggcctgtgatgggaggggctgctgtgaagacctctgacatgccctggagacattttccctattgtcttgagggttaacattcggctccttgttacttatgcaaatttctgcagccagcttgaatttctcctcagaaaatgtgattttcttttctattgcattgtcaagctgcaaattttccaaacttttatgctgtgtttcccttttgaaatggaatgcctttaacaacacccaagccccctcttgaatgctttgctgcatagaaatttcttctgccaggtaccctaaatcatctctcttaagttcaaagttccacaagtctctagggctggggcaaaatgccaccagtctctttgctaaaacgtaacaagagtcacctttgctccagtccccaacaagtaactcatctccatctgagaccacctcaccctggatttcattgtccatatcattatcagcattttggtcaaagacagtcaacaagtctctaggaagttccaaactttcctgcatttttctgtcttattctgagccctccaaactgtcccaatctctgcctgttacccagttccaaagttgcttccacattttcatgtatcttttcagcagcaccccactcctggtaccaatttcctgtattagtccattttcatgctgccgataaagacatatctgagactgggcagtttacaaaagaaagatttaacggacttacagttccatgtggctggggaggcctcacaattgtagcagtaagttaaagacacgtttctcatggcaacagacaagagaagagagcttgtgcagggaaactcccccttataataaccatcagatctcgtgagacttactgactatcacgagaacagcacaggaaagacctgcccccatgattcaattacatcccaccagattcctcccatgaagcatgggaattgtgggagttacaattcaagatgagatttgggtggggacacagccaaaccatatcacttgaggtatatcaccagtttatttttttgtgcattcttatgaaaatacaatagtactgagtccaaggctatatctgggctatttccaaacccatcaaaatgaagggataactttatacttttagggtgccagaaaagactcttgaacttagtatttgtcttatagctgtgtggaatctagaaagctttgtaccttcttctctgctagtccatcccctggtagttgcattttgtttatgcttttttactaactcttccaactcactggtctcattggtattcaaattcattttcttatcatattcctcctaactttctcttcatatttcccctaactttagtgtctccctaagctaaatgaagttgtctccaactgaacatgtgtagttgatagtaatacaaatagaatacctggctttgcattctttgtgatgggaaggttggagatgctaaaagagaagtgattaggaagggtgtcctgaggaggggagactgagaccattctcacaatagcaggactgatttgtcagtcggggacacatagaggtaaccagggagggtttcacagagaatgaatgggaagtttgttttgaacttggcctttaatattgggtggtattagagtagttcaagaggaatctggagagcagttcatatgtgtgcatattagtcatattagtgatggatagagataatagcatatacagaaaggggaagtgagtaaaatgtgaagtatattctaaggataagccagtttatctgcagctgcgggtatgtgggaccaaagtgagagagctcaaaagccagactgtcacttatcttgaatttgtaggcaatgtggcaaccagagtgtaatgctgaacttggcacgttactttccctgtcatcctaggagacctaggaattctctcaagaccattgccatcatcaattcaagcagtaatttctgagctttcccaggtttgttctctacttccctacaagaaaggacatctcaattcttctcttgtaaccatccattctttttcagtgtgcttccccaaggatttttctaaagtaatgccgaactggctattttataccatacttttcttcccttggagtccttgtcctccgctcaccccctttctcctccatttttttcattggcattagtcaaacccagagatagctctcaaggatggcttcttaaagagtatgcaaatacttgggattttttttctttctttttcctcaagtcctcttctttctcctatgtatttttttttcttttctaaggctgtatgcaagtggttctagccatcagcatcctaaaacaatgtcagtgatttcaacatgccattgtgtaggtagatcagagtatttggtttcagtgcatctttcttggtgcactttgcttttaaagcctttgtcattgtttaacactttttttggttggaaagaaaccaaaagattgatttattcttactctgttttaacaaaatttaattcttatgttatacacatttctgtcatcattattaataatgatgcaatttaaaacagcactatttgataattttagtgattcttcatgaggcagttgaaaataaatctctactttggaaagtgtgaaatattgcaaagcatagttttaatgaggtatactgagatgtgggtttctcttctggcctgaactttgtttgtaaaattaagagagttattttgcctttctagggcttttgtcacatgaggagattagactaactcattggtggggttgcttacagctctaaatcttctctttgtagttaagcccaaacctatcttgtttgtatagtaatttcagccattatctcccccacccataaccctctaggagtatccacagtagaacaacatgaagggatctgagccctgccggcacacattcagaacagtttctgactttgtaagactaggtaaatatgggaagactcaaattggatctttttagggattgactaccaattcagctggggtattcttatatttcacctttttttttttttaaggtaacagctatatgctgaattttaccagaaagtaccaaactgtagactcagcacatagcctcctaatccttttgtcaccacccactaaaataatgaaagatagagaactcctattttcacattacttctaggaaaatattttgacagattcagtatgcagtaaaatggtaagcttttgttacgtgtgttccaaatcatcttgttatcactggatatatcgattagttcagtactttctgagccagtcataaaaaaagacttctctcgttctgcatgaaagaataagagaaattgaaaggtagataaccatattgattcaacccaaatagtaaatgcaaggggctttagacataagtcataaatctctttatgggagttgtaagtctgtttggtattttctatttgacatgaaagaaaataatctctaattaaccatcattttaaagtgaactatgctttgatttgagtttataatacaggtgccaataacataaacctgttacctttatactttgtagtttacaaatgccttcatatgtcttatcttgatccagttctaatggggtctggaattatcataattttcttttctgcagaaacttagtctcggagaggctaagcgtcacttgcctaaaggcacacagccagcaaatggctatggcaggaccaggacccaggcttttagtgatacttccacgtggcatttggtgtatggtgtgctactgtatatgtatgggttaattttctaaaagtagctcctctactggcacgtaaagggcaagagaataatgagctgaatccagcttaagttaaaattcccttcttaggttcatatttcgaaagtctggaccaaacacaccaaaaagagcaatttttcttgtggtattacaggttatagtcatgtgtttttcatttacaaatatggtgagaagtagtgtttttgcaatattcctaaatgagtaacatatgacacaacttgttagaggactttttcttggttcataaagtttctgagtttttgtgtctttagtgggatgactttatcagaaatcctcagacaacacagctaaaatctaaatttctgtggttgaaacacagccaccctcaagagaaaccttagatgtaaatgagaggtcagtaaaaagtgggtatgaaactaattgctatagagggagtaagacttctctcaattgtttgagcccctgaaaaatagattaatttaaaaaaactgtctaggatcatcaaattgcaaaagtagttagcaaggaacagacagaatttgtgacatttattcatagacactaaatgggtgagtgtcgctctacctcagcaaaagaacgcagatggtccatagatagtctacttcagaaaataactgtgaaaataaatgaactaagtagctgtgaaagttctctgaaaaatgtgcaagactctgcaaatgggaggcatattagtttcctgtagctgcaacagaatatcacaactgagtggcttaaaacaagagatttatttgctcacacttctggagaccaggagtccaaaaagatgccacactcattcccaatactctagagagaatatttctttgcttttaagtagcttctggtggccccaggcatttcttggcttgtggcagcatcatgacaatctctgcctgcatcttcacatggtcttcttctaggtgtgtctctctgtgtcctcttcttctaaggacatcagttattggatttagggcccaccttatatcccagatgattcatgtctagatccttaactacctccatctgaaaatactatacatgtatccaaaaaggtcacattctgaggtactgagtggacatgaatttttagggactagtattcaaccctgtataagagaggtcattcttcccatttttcagactaagaatagagggagtctatgctgtgctcaatgtgaaaagcctaagccagtcttttggagggaggtgggcttctccacctcagaactgacttcaggtttagtccacaatgcttctgagccaaatctttaagctgttcaacttgactgcgactatgagaaagacaatggctctggataaactggtaaaatataattgtgcaaaaatgagatttaaaaatcttttagggaagtataaagtttcttttcacttagataatagataaaaaataatttattagtacaaattgacttttttgtgagctagagctaggtgggcaaaccttttctgaaaaataattattttctactatacgggctatatggtctgtctgtcacaaatacttatctctgctattgtagcatgaaaacaaccaaagacagtacataaatgaatggatatgggtgtgtgccaataaaatttgatatatggatactgaagcttgaatatcacatatgtccatgtgtcatgaaatattcttttcctcttttacaaacatcttaacagtgtaaaaaatactcttaacttgggagccaaaccacatcaggcagtgggctggatttggctggcaaaacttagtttgctgacccctgggctagatctagacaaagtttcacacagcagaacacattttgcttcttgtgcctgttatcaacaggaagatggtttttagaaagtggggaaagtcagttttgttcttgtacagagcaaaatcctagagtcaggagaggtatctatagtcaaggaagaactggccaagggagtagaggctctcccaggtctaggcctacagacaggtggatgtaaatgttgtgtacccaggatttgaaatactctttaacaccacaaatctcaccctctattcaagagaatctttttttcttagtgacttatagggtgaaggtcattttaccttttgcttccttagaattagagtgtctggactcccagcgcaggaaaccatttgcatacccagtcttggactcagaatcacaagatgtaaaagaggtgaccacagagataactgctaaaaggaagccagccctattattttatctaaggagaaggtggcctaggccaaacccaattgacattctggaatcccctatagatcagaaggacaaaagcatgtatttgacttgggtgtggggaggtagagatttctaagattcttagaaaaacaagtcctcttgtatagcctacgactttgagtcaaattaggtgaaagggttgatggtctgtggcatcccctacaggctttgcatagctgatgtgtaggggtgttttagtatgtgcatgcacgtatgcatgtgttaggtgtccatgtgtctctttggggagggggtgctgagaaagccagtggacttctggaggaggctagaaattatggcattcttggtactttctgaaatttttgcccagcaggcagggagatatctaggttcctaagtgatgtagaatgaaggagaaataacagacaggatctgtttagttaaggctttaaagatgaggtgaggttcagcaagggctttgggaaacacatgggttgatggagaaaaaaaaaaaggaggctgtatcttagatgtaatgaactgcataaagccttgaaagttagcggggctgtaaggtccatgcttcctatgaatgggatcatgtcactcacatcttaaagtaggtatcatagaagaatgctccaatgatgttgcagtttcatgaagaagtttggtgttgggagaagtagctgctatgctgtatagtttcaaagtcactgttctcatagaaaacagggtgaattatgacttccagagtcagttaaggagatggccccagttctagattgaacctatgctttggccttcctctgcttgtcaggttctcttattcatctagaccttgaagtgaacttactggggaagctgatttcctctgggacatccagaaatgccttccttgtgcatctgctggatatggagaccaggatgttcatcctgagtggggtctgactaaatgttctctcctgtgtgttgagacccccaaaactgcctttctgcagttctactctatttaacttgaataaatgtggccttcagattcttgggaagataagaagctctaacttcccttcccagtcaagattgatggataaaaagggcctacaccagagatgtaagcctgaacccacaatccacatatattataataaatctagaaggagtggtcttattcaatactggaggaaagcatttagctcaaggacaaacatttttaaaaacctagtgtaacattttgagtgagtagttcacactgagtttgatactatgaattgtgattttttttttttttttttttgagacggagtctcattctgtcacccaggctggagtgcagtggcaccgtcttggctcactgcaagctccgcctcccaggttcacgccattctccggcctcagcctcccaagtagctgggactacaggcacccaccaccacgcccggcttattttcgtatttttagtagagacggggtttcaccatggtctcgatctcctgacctcgtgatccacccgcctcggcctcccaaagtgctgggattacaggcatgagccaccacgcccggcccgtgatttttttaaactctgaaaatattatcttacagactgtttgaaagattcactcgatacctgtaaaatccagtattttcttttattcattcatttaccgaatttgcattgagtgcccattgtgtgccaggtaccatgccagaagctggaaaactgagatgatgacatgttgccttatcttaggtagcttaagtccagagatatagacacaaaaacagaaaagccacagtgaagtataatagaacagtgtttggtattctctttaagcagacaaagaatagctatctgaggtgtttagaaaagctttttcaaggaggtagtaacttgaggctagctcttggagtatgattggaagttttcttggtgaagaagtggaaatataagctttcctgcaatgtaaacccacatcaagttgtaaattggcttgatggcttctgggattcatgagacacaagagtcagctgtgtttggagagaaaaagaaagattggttgggaagactcggggcttggtatcacctctacatgatggggagtcttttaaatcattaaaaggtaaagggcataaggtataatcatggtaaataatgtttcagaaagtccatcttgacaggatgattggcaggggagttgggggaagggagtaacatgttagggctggtgagattcgaggcagaaagattgaaaaggctgttgaaatattccaggccagaaatgctagcaatttgaattagggtcatttctgagacagatttttaagtctgattcaatggaaatcagtgattaattagatgggccattgaaaggaagcccacatagaggaatttaaaatgatgctgagatttctagcttgggcaagcagtggatggtgataccattacccaagattcctttctttgacactgagagcttcagaaagcaggtaagtttttccctttatctcttttattgtcatgctgtcatgatataggctttgaatgtcatgatatttgattaatgtttgcacagtgcttcttgttgtaaagctatgtacaaaaaatgatcatttccttatgcttcattgaaagatttatttcttacaaatggcctttttggttcaccacttaaaaattaatgtcttacctcagagaggtttgatagtactttagagagcatgggaaaatatgctgaatattttcttagaaatcatagaagtgataagtttctattagtaatgcagtatattaaatattaaattatgttttgtcttttgtagtttttgaagtcaaatgaacacattaccagttgaatttatcttgtactgatagctgtggacttttctatgatacttcctgactttgtttcttttagactgaagctggctacacagggaacatgtttacaatggagagtgggaatgactttgcactcagtgctattctctccctcagtccctatgataaaatattgatggagaaatcgcatcctttgattttggtggagttggtgtagggttgttctgactatctgtatataaattgttacctcaaaaactgtttgactcagctcccctgcctttatttggtgaccatggacattgccttttagttaagatcagtgaatttctggtggtagaagcaggaggaaagagtggaattgaatgtacaatatttttgcactccatagttcctaggattgcaattatgtttttttcaaatatagagaaattaatcataatgtatttacttgactttacttatgcagtcagtctcagttctcaactatttgaaatactctgtaactcccatatacttttgtattttgaaattgctgtaaacacagagattttgagatctgaaagcttcacttcttgcagtgaagaatatagaagcctggcaagagaaggcctcaccaaatgcctcaccttggctaattacagaactgagccttgaactctctacccacaaatctgggcattaagtgaaaagaaaaaaaatcagcattttgaagaacagcttatattctgttaattcacatgaattgaaagagcagtactctgagaaaacggaatcattattttctttgagtgggggacaaggagtggcagtaagactgtagaggtgatagtggtactatttataaaattacagattcttgattctgagagggctctgcaaagccagccagtccaattggcttaatagaaacacattagtctgcttttaggctgcatattcctcactcaggaatgagaaagtcctgaaaagtcacaggtgaaaccttcatctgagagagcttgcatcaaaaataatcaagtgcagtgtggaacttggccattttccataacccaaagatacatataaaagttccttagttggtaggctccagcaaacatattagccatatgaaaaagcaacatctaacttctatattttgacttatgaaggaaaaggcctccctgtcccataaatatgtacatttcacctcctgtggggaaaagaaaggaaattgtagctacagtgtgttattgaatcttcctgaaattagcctttagagttttagagtttggtaagattgaacgattgactgccaatgccttccacacacaaaaaacaaaaaagtattatatgtttgcatcaacactcgttcaatgctgaaatacagctagtcaaaacccatgttaaagtttttcatatattacataacaccgctgtataatacattaaaatacatactggattggagataaattactgaagaaataccagatttcgtttgtaggttttaactgcaacataattcattgtgtgatttacataggtagacataagtacatttctttccaaactatatagcaatatacgtataaaagctataaagtaaaaaaagcaaaaccatactagatgactgctaagaaaagatgaatgttaattttttaaatagcaatctgatagtaattttaaatagcaatctgatagtaaacatgatacaagaggaaaggttttactaatagacatttaaaaattatgtcttcataaatcaagaggatatattacttagagctagaaataacagtgccgtgcttcctgttttgaataagccattatgcatttttgtctttgcatccctatttaatttgtacagtgttatttattccaataattagtgttaactttcttggcagtaggcgttataattacctttaaaatttaaatgggataaaaatgccttgagaacatggtttaggaaaactcttaatatttattttcacttgtctctttaattattcatttatgtagtatttgaaagaaaatcttgagaaatggaaggccactgacagaattacttcccagatgagcagacttggtttttcagttggttgggtgacattctggactgttgaggcattagtgatgccaaatggaagctctactacccattcaacattgccaatctaaatacatttcacttagaacagcacaggccactttttcttattctctttcttctgaaagtaagtcattatttaaaataagccattattctgaaaataagccattcacatgacttctgatttcaaatatacatatgcaggtgattattttcctaaatatataaattaatttgaaactagtttataatcttgataaatgctgtaactctgaataagcatactagtctccaagaaaatcaatgtttcaaaaggtggaagggataaatctagcctgtcctcagccattaaaaagtacacaagcaatgtcaaggtaaggttgacagtattcattcatttattatgtattgagcacatctacatgcataatatagttttaatctttacagggggatccaaaaactttagaagaagagatgactggatttttgccaattccagtcataatacctgacacagaataggtgctcattaaatacatgctgaataagtgaatacatcccctggagagctgaagagttcatagcatatctgaagcaattagacaataataataagaaaatgtgtatgcagttgtgtgataacaagttataaaatcagggtattgcatgtgcaggcctttcttgaagatgacagcccagagattgaccagaaacaagtctgacatttgaggaagttagccttctaggtgagaggaattagataatcaaagatcaagagtaggagtaagcgtggtttcggtaggtaacaaccagtcactaaattaaaaaaaaaatcaacttcgtttgacctttatcaagcacttatcatatgcagagtatggtgctagggctttgagagacacaaaattggaaaagattgtgttctgccttcaagaaacttacatctagcaggacaattttgatatattcacaataacagcaaagcaacaaaatgaagtaaaaaatcagggttgcaggagagttcagagtaccctgggagcccagagcagacagaggtgcatgctggcaggtggatttaggatggctctagggaagtatggtattggcatctgcactaagccctacaagacactaggatgaaatcatgggcattcataaacttttggggacttcatcctttctgagaagctggtaaaatctctacccccatgtctcagaaaaatgtgacttggaaatactcaaaccatttttcatgcaattgcttaggcttcctgaagtcaaactgtggacctccaagggaatccatatacccagagttgagacctttgcggtagtgagagaaaacttgctttggaaagggatagagccatatttaaattgcaactgctacctttagctttgtgatttggacaagtttctcaagccttcagagtctcaatttcctcatctgtaaaacaaggataataatacttacttgagattattttagcatagaacaagttaacagaaatcaccggatcacaccaggcaccaaacacattctacttttcacaataccttggggctgcttatgttttattgagagcaggggagttggctgcatagctgggttattatcaagtgctgtcttttttctatcctttcttaccaattaacagattatttgtattttagaataatcctcaacatgcaaaactttatgagtacacagggcgaaattaactgagaaatatcccacactggattcttaggataagaacaccagaaaatgagcctaaatgttcagttgtaatgttgatgatcacagtgtgctaaaagatgtgtgtgtgtgtgtgtgtgtgtgtgtcagtgtgtgtgtgtgtgtgtgagagagagagaatgaagaaaggaaagaagaaagaaagaaagaaagaaagagaagagaaaaagaaagagaaagaaagaaagagaaagaaagaaaggaaagaaagaaaaagagaaagaaagaaagaaaacaaagaaagaaggaaagaaagaaagaagaaagaaagaggaacggaatgttaaaatgggactttagtagtgtctctgtttttattttccccaccagagggctttgggctttcttaggcctcaggtatttccatcttcatgtatttccccatggtttgttttgatttactgatggatgactcaagattttggtagaaacatgcatactcacaaagaaacacacaaacacacacatacacatgcacaaaagcatgcataataacagaataaaagcagcaggtgacaaatacatactttagctgttgtacaaacttataatgtagctttacaaacatgatttttagtgaagaaataaaagaagggtagtgatgggtggttaggtttagaatcaaaagttactcagctggttgttgtacaggtggctcagtttggctttgtatactgtgaacgttttgattgcagggcttaaaaatatgtaatcctaattttaagaaaactaatggaataaacactcattatgcacacaaaagcccttccattcagcttttcattgctttgcagttattttctccaaaataaaatgagtaattatttggaagtactttcagcacatgcaccatgtgggctaagcttgttcccgacatctacaatcctttgaatggaagtgccaaaggcctcctgccaccatgggccacagccaagtgtcatgtgaacctgagtctcacaggttacatgggaaataaaggacagccagaccagcccgcttctgggaaagatgcaaaatgcaggaactagagaacagcgatgaggtgtttttggagactaggcaccaagtacgtatatcttatgtttaaggatgggtggacaggtggatggatggatggatggatggatggatggatggatggatggatggacatttcaagcaagcctaaggacatagtaagtttaggatctacataatggctcaccagggcatgctaatttacttacataaaaaagaaatctttttcaaaacattatacttgtgatttggtttaccaatagttaacattctatattttttagcaaaaacatattaaaaatgttcctaacttgtattatttggatgtgttttttttcttgtactgagaaattccaaaaactttacttggatagataaatacctaaacctcatgtctttggtagagtatatcagggaattgtggtgctcaggaaatggcagatactattctcattattattattgttagaaggacaaatagttctagagtatcaggaaatgagagtggatatagcgtggtaacactcttgtctgaggtgacctgagtagagagatcaacagaggactttgccatcatctagctgatgagttgtgtggtcttggattttcttgtgttggttacacatacactgagcaggttgcgtctaccctctgagctgactttctcagctgtatcagagggagaagtaatctttgctttttactttctttaaaaggctgtgtgactatgtcctgaggttgtggattgtgagtgctgtgtaaactgtgaagtgtttcgtgcttgcaagatgagggcttcatacatcttcagtagagctccccagatgcttttatctgtgcaattaaaattacatatgtgttcttttcaatttctatggttgcaaaaatgaatgtatcagtctacgtagtactcaatgacagaatggatttacttttaaaataccatgttttgagctctagctttgcatatttatgaacttctggagttgtccatgtggatgtttcctatgctaccctgctttcttgcgaatgaagaggtctgaaatgcttctggagtacttctatgtcagttttgcttatatgcatttaacatgttggtcttacaggggagacatgtcttttttaagtataaagtacatatttctggcctttttcttccttctctattgataagttgtaactgcagtttttgtttgtaggctttccaagcctggtgatttttcatctgattcaacctttctcttgacaaaacaccagcctcaaatgctttgcccattcctggtcaaggcttagacttgcacccttccctagtggcaagagactttcagttggcttgttgcctctcggaagactactttcattgcatcgctgacttttttttggctttggaggcttggggaactatttagagcatttatttatatgaggcaacattgcccaacagaaagttactttctgtggactttccatcattaagatgaatttgtgcctggtatacattaatttcacccatacttaatatctcagaagttaccctgtgagacaccctgtgcaaacattttaaatgaattagatcatctatgtacaatctaggtctgaaaggcattaaaagtttttaaagtgtcgtcattagagaagaagctatggaggctacttttaataagagttatgacaaaagacatgtctctgacataagaccaacatgttaaatgcacagaagcaaaattaagaatagattattattgtcataaactaattaatgcatattattggcccttactaatcagaggctttcaaattagaaatagttagctctgagatttctgacatttttgaatttagcaatgtccagcagtgataattttgaaggaagctattggttggcctttaagtttgtaccttcagcttcaaattcagcaagttcatgcaatattatatgggagcctcggtagattttactgaaaatgtgatacatttcttcaaaaaagttttaaaaggcagtatttcaagtttgattgataaaggaagtatccataagttaatgaggcagtcccaatttctaacctgggccctttcttataagcacaagtttctgtaactgctcaaaatagcacttaggcacttagaacaaatatatacctggcccacctacacacctatttgattttctaaatgttggagctaagctcctaagattgcaaatgaacctcaataagcaagtatcaatgtgaagaataagcaccccagtagctaaattgagaagtgcaattgtaattatttggtgaaatagaaatcaggtcattgcagctgcacattgtcgtagaataagctcaaaaggaaaatgtcttcattttgactaacattgccatattttaactttgggattgttataacttgttttttcacaggtattatctgtattatgtatgtttaggaatcaaagcagttcttacatttcaacagctaggtaaaaataaatgtgtgtaattgttgaaaagtatttttagtgtttaaggagaaagcaatgctttttgatctaagtagcataactcaggctggattccgcagtagacatccctgactatagacatttctgtaggcaattaagtgcaaattaagcatgctaagacccaaattagagtcaaatctgatgtgagccaatttactctgaactacagtcctggagtgagaagtgatctgctaggttgctgcttagctcagatcttggtgctacctccactgggacaggaggaaaaggggagatggaaggaagaacaatgaccagtggcttaaagtaatttaataattaactttccacattggttaatttgtgcattatttacacaaaaccagaaacatttttaacccagtgaattatccctgcccatagcaggaattattggagaatgccacaggaatatacagggctattgaaagcatctgcttagagcctttaaagcttgaaccatgatagcagaaatggtgactttatttttataaaaacttgaatttttgttttttaaaatattctattaagcattcagtattatcattaactaaatgacattcccaaattctagaatgggagagtaatttctcagtggagaaatagctattcttatacataataaacaacaatgattctggtgaaatactattgtagataggaaccatttaggagccaatgttcatgtatatgtaatagtttcagaatctaatgttcagaatttccaaatatctcccgttttctgcatagctacctcccagacccgtatcaaaatatcacttaatcttcattttttttaaaattaccggtctatttatctcttttgtaaattttcagggctttgacatagaatgtgtccaggtgaaaatatattacattgtctctctctttctctctgtctcaatctctttctttctttctctctctctctctatctctctctcacacacacagacacacacacacacatacatacatatacacacactcctatctgtaaccatttttcttctttcttttcttctcaggagattttaagcaaaaacagctatgaatttttctatttaacaaataccaacatggaattcagtagtatattaacagtggaaattttgaagtctgtattttttttagcaaagcctaagtgaatctgtgagaactaataaacatgataacaaaatgttgcatctcattaattgtttttattctgacaaattcctgatgatttcatatatatttgagacaatccagaaatcgagcaatggggtgaaaccattgatcttattttacatatgctgaatgaaaggcccaggaagagagagatgccgtaattgacaacagttcttctgactctcacataaatgtatgcagcagcagtgcccttgtcttttgttcttccttcatttagactgagtcaatccatcagcacacattgattgagcacctactctgtgctagatagtgatagggtgactgtatgagttattgttctgagcaggacagttttgaaagtgaaaaggggcataaactagtgaaacagatgcccgactccagctgagggacctttgacaagtgacttcgcctctttcagtcaatttcctcaactgggaatgatgataatatatgtatcaagtggcatgtgtatagtgcctaccagtacctgctacacacagtaggccctccagaaggttttgatttcttcctctttcctggaagcattcctacttctggaatcctgggtgtttttgtccaatacttaatggcatttactgaatgctgcctcctattggggtcctttgggtgcatgcctgtattctgttagtgctgtttagaccagaatttcttggagagctgggtctatgtctttttatctttgcatttactttgatgctgctagttaattaattaattcactagctatttattgaatactctcatttagcaaataatatatatatttaagatgagtacagaaagataggcaagtaaaacaaacctgtgtcaaatgaaaaaataagaacctgtggagcttaaaggattgatatagtctctatagatactttaacgcttaagcagtggcttgtgactctaggggaattttcctgactacattcagatgtgcaaagcatcagttttgttgtcatatatgttggcattttcattggaacaagaagataataaatacaaataaccatctctatatcatagggtttccttttttaaaaacaacaaattatcaggtttcattttcaactattaaaacaatcttgccaagaacttatttttaaacctgtaattttgtcaattttgagatttatttcaatttttttagatgtccaaaaaataatttatgcagattacaaaatctagttttcacatgaaggtatccttgtttctttatttttaattcaaatcaattaggtacatatcaatgtgttgatttggtagcagaaaatataatatgtaatacctttcatactagaaaaaatgttgaagggcatattttcaaatgtcatttagctgatgagatttagagttttctacatatttacttcttaagatgatattggtacttaagtaagagctcattattttaaagcctttgatttcccttctgcttgatccttctgtgaaaccagaagcttgtgtctttagcttcctagtctctttttatgcaatgtggatttttttttggtatgtgtagtacaaccaaggatgtcaggaggtgtgtcgctttgtttaatacacattgatgtttaaacatttaaatattgctaaagaaaaccagctggcaaataatttagacgtatgtatggtaagtcattcctttttcctctttctccgcttatccccatctctttcccttctttctgtatttgatagctactatgcactagacatcagatatgtatatgcagctgccttgtacacatctctatttggatgttcccattgggacctcatattcataataattaacactgaacagctgatggcgctactatctatgccagaagcctggaatcacctacaatctctccccctccctcatgttctatagcctatcaatcaccgaatcctaccttcctcatttactttgaaactgtagttccaacactttggccatcaccttacaacaggtaagcatcatgactcagctgatttctgctgctggttttcttacctctggccccacactgctgaacccctgccttttccacgttgcagccagactgatctcttagtgccacccattgcctaaagaaagaagtcaaacctctggagatccccttgtgacctggcccttgctgcccttgccagcttcttctaacttactgccttccagctatatgaagtgtgccatcatacttttaccagctaatctcagtttactcttgatatcctttgggaagacttctcaaagcaggtattcctcttttctgttcctgcagtttttgtagtccttacgccactgaaactcgtctcacattctattttgattgcctgtttacatatgttactctcccaatagcctggaaactccttgagggcaaggagtatagtgaaattaatttatcattgtatcccttgtacctagcacagaacgtagcacttaagtaggggcctaataaatatagtcatgaatcacttaacaacagggatgcgttctgagaagtgcatcattagacaatttatcattttgtgaaatatgatggagtgcacttacacaaacctagatggcatagcataccacacacctaggttgtatggcatcctattgctcctagtctacaaacctgtatggcaagcgactatactaaatactataggcaactgtaacacaatggtaagtatttgtgtatctaaacatatctaaacattgaaaaggtacagtaaaaatacattattataatcttatgaggccaccatgacatatgtggttggttgttgactgaaatgactgtacttgctatagtgttccttgttgtattagtttgttaggttggctataacaaagtatgtactacagcctgtgtggtttaagcaaaagaaacacattttctcccagctctggaagctagaacactgagacaaaggtgtggacagtgttggtttcttctgagccccctctccttggcttgtaggttgccatcttctttctgtgtcttcacatgatcttcctgtgcaagtctgtgtcctaatctcttcttgtaaggacatcatttagattgtgttagggcccactctgattaccttgttttgcctttatcacctttcttaaggccttatgtcccaaaacagtgacattctgaggcagtgggggttaggatttcaacatacaaatttggaaggaggcgacaaaactcagcccattgcacttgcccttcagatattttcagactagtgcttgattgtcctgaaggcctgtcttacgagatatgaatagaaatgtttggagtgggattttcacaatggcctcctggagtgtctgtggttgggaaggtcccaggttttaagtgtgtgtggtccccaggaccactcctgggcaatgagtttctctttttctagttcatggattcaactggtttgattgcttaaggagcaatgatgataggctgtgttcaggaaatcagagttgaacagatgtcttttggtaatattggctatactgccagatctgagggcttttcctttactttcagtgcccagtgaatgatattataactgtttagaatgtgactattatcagaatgcaaacatgtttgaaaaactttacccttagcttctctgaattgacttactactgttaaggcaaacttggatactcagaaagtatttggctggctttgttgcattttcaccttcttgatgaatggaatctattagttatttgcttattcagaaacatgtgaatcatctatagccgattctctctgtgtgtttgactgactgacattgtctgccatctctcaagtattctttctgtatataaaatcctagactcctgtgcagtttaaatataaaattaaaatgttaccaaaagactcaggtattttcagcctggcctgacagcccatcttatggaaggcctgtttgaactgatgggcccttgatgtcagcagacccagacttttcaggtcagaggaaagaaagtgtctagaatcatagatcttacagagaaaagaggctacttgccttcactgcagtttgtagtgagggactgttgtgatcaaataatcaggaaagagcatgcctcaagttgtcagaatgtgtaatcattttatgccaagtcaaggataactcagtaactgagcaaaaagctttttgttttccagttaactagttagttacaacccgctctctggcagtgtggaccatagaatcatagaaccacagagaatgtagcagtaaggacccatagataccatctagtctaaacctcatttagacatttagggaaattgaggcccaaagaagagaatgaacttactcaggactatgtgttgggccagagactgagctggcacctgcatttaggtctcctgaccctcagtccagtctcctttcttcattatatcagagtgtttaggcctctgccagccatctcaccatttagaggcactatggcttaccatctcagttgagaggcaagagtgtttagcagttaagagcatgtgctcaggggctaaactgcccagatttgtatcccctactggctctatgacattcagcaaggcacttcctgtctgtatgagtttgttagcattaccagaacaaagtaccacagacttggtggcttaaacaacagaaatttacttccccacaattttggaggctagtagtctaaaataaaggtgtcagcagggttggtatcctctgaaggtctctctccttggcttgtagatggccacattctccccatgtcttcatgtggtcttcccctgtgtgtatcttaatctcttgttcttagaagggcattagtcattttggattagggcccacccatattccctcatttaattttaattacctatttaaagaccctatctccaaacatagtcacaatctgaggtagtggatgttaggacattcatatatgaattggaagggggcacaattcagcccataaccgtgtgtctacgcctcagttatcttatcaacaaaacagggatgataatagattctaccccaaaagggtgtgaagattaaatgaattggtccaacatagaatgcctagaacagtggtagtgtgggttgttaattcataaactgacaacaacagaatctaggattttcatttcattcgcaagtatgaaatctaagtgtttaaaatgtcaaaacatttttcctactttcatttacttattcaacagttgtttattttatatttgtgtatcttatattgtggtagttgccattctggtctgaagaaactcatagtctagagcggagacacatgattacaatgtgtacaaagtgcaatgaaatacgagcagggagtcactaagaagaactaatttgacctaggagaatctaaaaggcttcctggaggatgtgagtgaggagccaaatcatgaagtgtgagtaggaattggtcagcaagccaaatgtaggaaaaaatttagacctagggcacagcatgaataaagtctagggaatgtggtggtgagtggacccaatgtagtttggtacagctggagtatcagctgtgttggggaaagtggtatgtgatgagactggacattttgccatgctcagtaggttagactcatattctgtacgttgaagctggctaatagtgatggctgacattactaattgattacatcactcattctcactaatcctgattgagaccttaaaatccatctcaacacagctgtttaggcaaccatcaccattcaactggagttggcctgtatcccagctgtagacagtgacaattattaacgaataaaattaagtcagaaatattcattttacctaaaactactagacttgagattattagtttaaaactgcatagttccttaggttgcaaaaatgttcttttttttttttgcctgatttgtagatgtgataggaacattcgttggaagaactgtaagtagataacatgtagtaaattgggtttacaatgattttctaaaaaaaggaaaaaagataaaactgtctcacattttgatctgaatttatcaggctcttgaagttcaatgaaatgttcaaatacatcatcatatcatgaccattggaatcttggcctaaaactcagcatcggaaagtttcaaggaataatacgtcttagcgtttttgcttctactaagggatacatgattttcctcaagaatgcaaacaaagcaaaatctttaggattgccctctatcgtaataaggcaagcatttaggactggatgtattggtcagcattactgatttgtgtcacaagacccacagtattccagaaaacttgacctgcttttctgtgtgccatcttaatacttatgtttttgttcagaaaagaaaaggttcctgttagggagataaactagattaaaatgattattctcagttttggtgagttgtatacaatttttataaatcatgtactattcatttctggcaagataaagtcatttattttgtgtcatacatataattatatataagcatataaaacttacatgtagttgcatgttctatttgctttcttaggttttctcttatatgtgtgcagagacaaaggatggtatcaatgaagccatctcaggtcagtttcttgaggaaattgattctgagatgaagatttttgcatgtgggaaggttcttggggagtgcatttatggtcaacacttgtgaaggagtaaagaaaatgaaatgactctttagagttgtcctgaattgaggcaaggtgccagggtttttgtttttgtttttgtttttgtgacagagtctcgctctgtcgcccaggctggagtgcagtggcgcgatctcggctcactacaagctccacctcctgggtttacgccattctcctgcctcagccttccgagtagctgggactacaggcgcctgccaccaggctggctaattttttgtatttttagtagagacggggtttcaccgtattagccaggatggtctcgaactcctgacctcgtgatccacccgcctcgacctcccaaagtgctgggattacaggcatgagccactgtgcccggccaaggtgccaggtttttaagcccctgcatcaactagtaattggatgtgggctgccccaggaagtaggcacaactttgagtcaggagctttcttagggtaagggaaattcttggaaaggtgactcagtggagggcagccagcagcccgctctcccagaagatgaaagaattagtgtttctgctcagaaagaggcagggatctgggacacttggaacacaccatggacgtgttcatctggacaaatatgaatatcctttgcatcttatggaaacctgtttttacattgatggtggtacatttaatagatgtttagcttatgatttcccatgtctaattttagttcttctaccacttctctccagagtggtctgatatatgcttcttttgcttatattgtcttcagttgactcaacttgatgtctgtttctggctctggcctcctggactaagccacataagaaaaggccatcatttgctgtatattgatataattctcccttctgtacacatcagatcttgtccgcccaaggaaaggaagttagattgcccagaaacaatcagtcgtttcaatggaatgcatgttcctggcctcacctggcaacaagttattatgtggcatgaatttacaatgaattcaacttcctttcctcttgccatacttcaaagtgaaagtaaaaagctgagtcccatttaagaaccaacccaaatgtccaacaatgatagactggattaagaaaatgtggcacatatacaccatggaatactatgcagccgtaaaaaatgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtcggggggggggagggatagcattgggagatatacctaatgctagagacgagttagtgggtgcagcgcaccagcatgtcacatatatacacatgtaactaaccagcacattttgcacatgtaccctaaaacttaaagtataataataaaaaaaaagaatgaaacaccagcagacaggaagctgtccaattggctaggaccaacttattgatgatgccttatgaagaaggctttattagatggagaggactctcaactcaagggtgtgggactattgcatacaatttaatgtccatcaactttgctagataggggatggaggagggtcaagtggagttcataaagttcaatagctacaataagtaaattttttagtgttttcagtcttaaaagaaaacattggctttgttgtgcccaaatcatctgtggtttgtttgcatgttttgctgctttaactccaagagataaatgtacataagcactatgtgttcatcctgctaatgtcatttaatttaatgagtttagaaaaattacttgattaaccttttatagtaagggttttgagaatttatgtttacattttaaatttgaaaataaaataatctatcttcaaccatgaacaaggtatcacaaagcactttttttttttttttttttttttgagatggagtctcgctctgtcgcccaggctggagtgcagtggcgcgatctctgctcactgcaacctccgtctcccgggttcaagcaattctcctgcctcagcctcctgagtagtggggattacaggcgcccgccaccatgctcggctaatttttttgtctttagtagagacagggtttcactattttggcaaggctggtctcgaactcctgacctcaggtgatccacctgcctctgcctcccaaagtcctgggattacagatgtgagccaccacgcctggccttcataaagcacatttttaactaccatccagccattccagttaccatttgtgtgggctaggttttacttttagcttcatttcaacttcaccaataatcttttgagagcctattaagtacaaattgtattcgtatggtcaggccccatctggtgacagagagactatgcatttggatgttgctgacacctggtcatgatggaatctgtgccattggaaacagaggcccaagtatgtctgagataatgacactctagtgtaatgcatgtatatagaatccgaagacaggcctgatgaataacaataccatctgacagcaaataatcaacgcaggaaatttaggccacaacagcttgcttgctctttacactgtcatggttgattggttattctcatcaccctttgtttaaaatcatttcagaattaattggcattcattaacgaaagtctttgcagtggaattgcagaaacagtcattaatgtagctaataaacataaaaaagaaaaaaggtcctattactgggtccctacaggctgttaactaacattttgaataagaatacataaacataaattaaacattttttaaactgctaagaatgtgggaatttcacatggtggtctgtaataatgctttgaactaatttgttccttttttaacatgtagtttagagaaagtgattctgtttagaaattattattgtgggtgatctctcagagaagccagggcaaagccaaaggtaagccatcttatcagccaatagattttaactaaaactagagcactcaaatgtaagtatgacaataacaaagtctaacatcatggagttatttgatcacttagtaggtaggtttctaaggtataaaccttaatgagatttagaaaagcactcattccacaagacaaagaaacaaatctttcctttcaagaagtaatgctttattgatcaggtgcctcagttttggtttatcagtgttgcataatgttgtataatgttgccattagaacaaactccagagaacatccacattattttggaatgatgaaatggtgctgacttctgtttcagttcaagggcctagggcttataaatattttcaaattagttctcactcataggtgggaattgaacaatgagaacacttggacacaggaaggggagcatcacacaccggggactgttgtggggtggggggagaggggagggatagcattaggagatatacctaacgtaaatgaggagttaatgggtgcagcacaccaacatggcacatgtacacatatgtaacaaacctgcatgttgtgcacatgtaccctaaaacttaaagtataataataaataaataaataaataatattttcaaattagtttctgactcatatctttatcttcatatacatagctctggttaactccaaaatgtgcaccattctagcagagcctggatagaaaatccatcaaattttcttattcttctgtaacatgactaggcatttccagttatccaaagggaaatggaaaaaatggcataaagttttaaaactttactttcctatttaaaggatatttgtgtcacatgtcagtgttgtgtttttaagaacaagacaaggtatggagagagtctgtgctctaacaccaaatacagtagaaactcccttaactcatcacccaattcaaaatttgcaagattaaccaacactctctgaaccctgtgggaagtatgctgactgctgcccatgatatatacattgttggccagaggcaatttttgggtagactgccacttctgctcccaaaagttgaattggatggctagtgggggctagttgtgtttgctcccaaccctgttaatgccagtcatacatattattgtagttatgtaattaaatttagtattgcataaaccaaagaaaaatgagtggaaaagaagaaagttgtttcccctataaaatgaatgttttggaaaagtttagtggtatcagtttcctattccttctcaaatggctttaagttcctactccactttcaggaatctcaaatgagcaaccttagagcatgtattgtagatgtgtatgttgtggaaatccagtcagtgagtctgtactcaaaggccttggccttgagttaaaagatttacaattttatggatgaagttataatataatttttaatataccaaatgttgtgataccccatttaaatacaatcctttgatttgatggccaactgagggttataatcaattccagttgaaagagcttctcctctaactggagagtatcaccattgtaggctgagatttactgtctcaaatgaataatcagtattgagcgttatagatcttgcctttatgtcctgctactacatctacagcagatgggtcaggccatttaccaatccgatctcctcaggcacatttctttccctaggccattgttcataccatttttccttatatacaatgttccttctgtcgccacttttttcaatctttccccttcctcttcaacaggagacatttatctaattcctagttcccattagaaaaaaaaaaagaaccaatttaggtaaatttataattctgaactttggttatttgaggttatttgatgtatcatcttcatacttgagtagctgaggtcatgggtctgcaagcacctggtggggttgttgtatacaggatgcaacagagtccagcccagggctctgagccttttctacatggaaaatgattttactgcatttataaatgatatgactatagctggtttgaaatatatgtcatagctttaggctagaaaaatgttttgttaatgtatttgaatgtaaaataccaggacaggtaatttataatgggatattgatacacttttaacaaattccagatctcctcagaagtgcaaatgctgaatgtattgcaaccatgtataattgtattatggcaataaacatatacgtgtgtgtctagagtacacatgtcattgcaggcgtcatagtacagtggatttgtattgaactttgactaaagtcagtcctgatttcatttaaaaaattgtgttaacctttggtaattagaatataaaaccaggaagactcaaaattgttagtctaacttttgtttattgactagaacatctaaatggctttaggcatcacaaaagtataaaaaaagtggcttcctattgggtctttgatccatcttaatttatttttgatgctgtatgcagtttctgaatatcttttgtggcttgtaataaaatagccacagtgcaattttgcatgtatgtcaagcgacgcgtgacctgctatgcaaatttaataccaaggtgccaaagctgaattcataatgtttctcagctacagagctgtttaaggcagtttagaaatcaatgaatatgtaatatgaaggtgataagacctaaataaaaaccctatttatctactatgaaaaagtatttatacacagaatacttagcacatgcaaaaaatggacagagtttccaattatatggtttgcataaacaaatgttaaactgcgtgctctgaatagataataatgtgaccagtccctctgcattgtgctttaaactttgaaaatgtttacagatgtgtttcccctcttaagatataaataaaacaaaatgtgcagctgaagcagtgggatctaatctgagttctagtgttttttttttttttttttttctgtattttatgttagcctagattctatacttgatatagggctgaacttctttaataccagggtaagcagacatgtgttttatgaagtcttgtgctttattttgcaataagaaagatcaactgacagtgattgattaaagtgagaaaattctaataacccaggttactgtagaatgtgtaatattatttggatctgaacttctgatatgccactatttaaatctatatgatgctattgtttctgttggagtggttatgccataattctggtaaacatttgaggagtttgtacagtagctgactacagtgtgagaagagattaacagggaagacaggacttgattgatgggagtcagtcctggctttttatcatgggaaaaatatatttgtgcttctacccagagagaaggataaagcaagtgagtgtgtttttgtatgtgcaatgtgtgtgcttacatgcatatggaagtgcgcataggtatacctgcacatgcatgcattcacacatacactcagtctgtactgtttatgacgcccctgccagtcagattccagacacatttatatcctctggtttagagtaagctgctacgataatgacaaatagtgtttagagcagtcaaggaaaatgtaggggtgatatttgaaaatagcatctataatgccatctgggtggtgctgatactttggagagcatggaatacacctatctagagggcaagtgctctcaaaacaaagtcagaagaaggtctatatggtagggaaagtcatgactcttggtagataatgatgaactttcactcagggtctgtatttaggtctttgaaggaggaaaatcaatttctagaaatttagctcagttaaagccacagttggtccttagataagctgccagaatagacaccacagctagaaaactgatgggtccctgtctttgaatttttacttgccatatgtttcctttggatagcagcatactcaataagaatgcttaaaaaccagacagtaattctaaggaaggccaaaataaagagcaagtataagtatatccgatcaaatgtcaatgttttaatgttaaattttatttagattgttttgggccattgtattttcttttaaaaagcttaaacacacagtaatttatgcatttcacctgaaggttacatatcgttttacaaatgggatgtgatttcaggcactgttcatcctgtttaagaaatggagaaactgtcagggtatgtgatgtgattctcaaaatatcagtgacatatttgggttgtggagactggtgaaatggagatgtggcaattaccagggtcatttcaacaacagagacagccaaacttgataattcagacaaaaaattatctaccttggccactttcattgagcagatgaactaaaaagttgccaaatctcaacttcctgatgctctgttcaaaccagccttccctgcaacaggaccaggcaagcaggctgactcccagggcaggctctcgttctacttagcttaattaaatgtgccaggcacccgaagtggtggagttacccaagggagtatttgagccccatattgatccaaaggaagggagtactgttgaagtgtgtgtgtgtgtgtgtgtgtgtgtgtgtgtgtgtgtgtgtggtgattgcggggggattctattctgaagtgcccaccatgtttctaaaagagcctcggtcctggcactgaggcactccatcctccacaagctccactcccctgatatgttctttccaataagctcttctgtccttggctttttgcagatgctgccgtgaagaggaagttaataacaggtgttttggaatataactacagaaaagcattaaaaattgttgttgttgttgttgtttagaaagaacatctgtagactcaattatttttcaagattctaatttactgctgtgcaaactacagggcaaattatattatatgtatttagccctactctgttgctatactcctgagaatttaattggcaagcaaatgtcctgtcaaaatgccttctgtggctggaaatctttctagctcttagagattataaggctcaaaattaactagaattcccctaataaaatttcagttcataatttggggcctttgccctttgtattctgtgagaactttttggtaggtatgatgggagagagagagagagagagagagagaatgtgtgtgtgtgtgtgtgtgtgtgtgtgtgtgtgtgtgtgttttgtgcccatgtgcacatgtgcccacaccattatggtaaattgccttggtggattccactcagctgtgtaaaaatctgtaattctggcaggaacaattatatcatgtccataatattgaaatagacctcctaggtttagagaaaagtggtttttcgcagacaaaattgtgttctaagggatgtgctagtaagcattttgatgagcacaagcttatgtgtggaaaatgttcgacccatctctcaacgcctggtggaacactcactagttttaacatttaaagtgctttttaaaaatggcactttaaagaatcatatagggtcctccatctgttctgatatccattccttcatagataagaaaaatatgttcattgttctagaattcattgccatgataaatgacaaaatttccagggaatttatataatgtccaaatgaggaaagccaatccaggaagaatctgcattgaaaatataaccattatttccaaccattatccatgatttcagatgttcaaaaatagaaacaaaattttgaaattattttaatactctacagaatagcactattttcctgaagaaacatttttctagaatcgttgctttagaatgtagttttcagtgcatctttattgggaacacattgtggtacactcacacactcagttttaaccctgaagtgtaatttacttggcacttaaattgattttatttgtggttgtatgtctgtgaattagtctgtaacttactgtgaaatttgccatctctgccgtgatcaacccatgaaatttatcatctgtctctctgatttacacaaaactccatttataatcatcaaacccaatttacaagtgaacagtattaaactaaaattctgaacattgaagcattttgacattgtatttgctgtgcattgaaaaagtaaattacaagtgtgaaccatgtatagatattttgacatttatatttttaggtttcatttgatcttaagtgtgccattattgtgaattcatttgctattactggaaaagtacttaatataatggattcattaggtatccacgtggatgtcacattttttttatatattctactatagttttacttcaattccactctagaattggttgatggattctctcataactatagttcatttctaaacatctaaaactcctaactaaattttctcatacttaaaattgtttaattatatggcttggaaataggaaattttacttggtccttgtcagaaatattgagtaatggcagttccattagaatggcgttcattgttgataactgggaacaatgtggtgcaaatggtgttaaagagacattggtgaggaggaaaagaaaagaaatgccatttccaggtaagtttttctgcatcttttttggtaaatgccaccataccgagccctcatttgttcttgtcttttcttaatgctttatctgttccttcagtgccgcaatcaggcacaggtggttcccttcaccaagtgaatgaatatttagtgctgtcaggagtgtcccatgaaaaagcccttccagatatctccaaactaggctgatttgtcatttctgaacaggggattcctgtgagtcacttctacacttaagcgaaatctaaccagcagaattacctaacactgcagttcaagcccatatgattagtgatgaatcttcctagggcattttaaacaaaagtggcttcatatccaattgtactggaaagggcagacagtctgcatcaaagctttggattgttgagaaacaatagcatacggttatgattttagcttgtttgtacagctacagtgaactgtttgctcgagatacgatttcgggtaaacaagcccctctagactcacttggaaaagcgaacaagttcattgaaactctttgcctattaggctcaggaagaaaattgaggctgaaatctgccagtatttataatagagtatttgattcagttgttttatcttatagtaaaaccagtgagaagagacaaagaatttgagggaccagaacagacaaaagtacatataaaagtatgtttaataaaggcatagtgtcaaggcatttagacctctctatcctaccttcagcatttcctgttacctttaacaatgtggtgattctccactctaatatcaactgcaatcttctaatttcaggaataaattgcatacaaaagttattttcatattacagggcccggaagacaaaggaatgccaagcctggaccaagatattcagattataatttgttttctttttctaaatcctcactaaccatgaaccatttctcccattcatgaactggtaacaggtgtcatgccaaatgattcttttaaaaataatatctgtttcccacgtttcaggtgtgtgcatatcccaggaaaaataattgtctgatttatatggatcccccaaggtacattaaacttggatattaaaacagtaggtttattctaggtgaggcatggatttagaagtttagtttttgtttcagagtttttgagagtaaatctcttgctttagaattactgatgcagtggaacagacagcgtatcaatggttgattctaaggtaatagaatttaatacagctcactgtatggttcacagccttttcctctaccctcttcttgctacctatgctaatccttcccaaatcctatctcctgtccacacttagatttctaactttattttatatttccacctggataccccacacatagtaaaaaacccactaattttattcttaagagtttcacttattagttataattattaatgcaaccttaaataggccagaaaaatagaactccatcttcttttttattgagacaggatcttgctctgttgcccaggctggagtgcaatggcacaatcatggctcagtgcagccttgacgtggacttcctgggctcaaatgatccttgcacctcagcctcccaagtagctgggactacaggtgcatgccaccacaccctgctaatatatatattataaatatatgcctataattatatatatattatatatatatatatttatatatgcctatgattagggtgactgcaagtggttttggaacataatttattttcagaaatttttatgttgggtgaaataggaagtattggaaatcctatatatatatgtgtgtatatatatatttatatatatatgtgtgtatatatatatttatatatatatgtgtgtatatatatatttatatatatgtgtgtatatatatatttatatatatgtgtgtatatatatatttatatatatatgtgtgtatatatatatttatatatatgtgtagatatatatttatatatatgtgtagatatatatttatatatgtgtatatatatatttatatatgtgtatatatttatatatatgtgtatatatatatttatatatatgtgtatatatatatttttatatatatatataaaaattttttttgagacatagtcttgctctgacgtgcaggctggagtgcagtggcacgatctcagctcactgcaacctccacttcccaggttgaaacaattctcctgcttcagcctcccgagtagctgggactacaggtgtgagccaccacacccggctaatttttgtacttttagtagagatggggtttcaccatgttagccaggctggtcttgaactcctgacctcaggcaatccacccgcctcggcctcccaaagtgctaggattacaggtgtgagccaccacacccggcctattatttttattattatttgtagagatgaggatctcactatgttgcccaaggtggactccaactcctgacctcaagcaatcctcccacctcggcctcccaaagtattgagattagaagcaagagctaccgtgcccggcccccatcttcctttataacataatttgtttcacacaggcacccaagttcaaaaccctaccttcaacagccaatccagtactgcctgacaatttaccaatttatgatgcattcctctttggatattttaaatattttaattgtaacatatatcccacttcaattcttattctgatacttctaccttttcttgtataatgtgtattccttgaatagatcatttattatattcatcatggtatccccactccccaacacagtatcatttacacagtgagtatgtcataaatgtttgtgaatcaagtcaactggaatcaaatggaatccaagtatataattgcacaaagtcaaggtgccacagtcaagacctcatagcagaagcagtacacttcttagtggttaacatgggatgtagtgatcaaagagcaaacagaatcttagccaggagaaagtgtattattttccaaaagggcagtgatcacgttgcagttgactctatactgttaagactgtgccacaggagtttcactgaggactgtgtgccacagttaaaggcaccataaactggaatgagttgagaagaatgtgagcagaggacttagctttttcatgtgaagccaagtcagataacttagggaacaacggagttttcatcatatatctgacagtctgttgaatggaagggaagagtaatatggcttgttctatgtgggtataaggaatgaagtccccatcaactgatgaaaacttcatcaaggccagtattggctgagtggtcaataatgtgtgcctcatcttgagttagaggaagtatgagttttctgtcacagaaagtgtgtaaagagaggctagagaagctcttgagaggggatgattcatagaggagtcaagtataagatgaggatcctcatcaactagaggtctacaattaagagatccttctgactgtgcaatcctggggctctatacattcacagaattaggagatccttctaactatgcaatcctggggctctatacatttgggaggagccctccttatcatctcataaaatatttgtgaacttcagttttagttgtacattttgatcctctgtaaatcaactgcacttcttaaacccttaacttatttattctagcttctgatatcactcccttcacttcagtgcaagaatcatttgtgctctccagtaattaactccaaaatcttgtttctcagagccttgcattaaaattgcattttcagaggtgagtgcttctggtagccattctagctacagttcttcctgggaaactatatggacatgatgtctgccatttcggaacctgtccattcggcaagaaaacaagtcattcacctttgcatatggagcaatagaattgtaggccagaggaactgttgatagcttctgtcaagggttctcccaccattgaatccaccagcatcactattgccaaaaagctatctgccgtggtaaactcagctatttaaaactttgagaaagctcacatgtcatacgacattcatggcacacgcttccactactgtaataccttcactttattggagttgtcccagatacatttaagtacctgtgtgattccttttccagatcaagaatgttcaaattaggatcaagagggtgtgttgatgtgatagcccgcaccagaatataaggatgctctttctttgaggcttggaataaaatgaaagagagatcacttgaaatgcttatggcttcctatgcccttatttcagctttactgaccatttgcaaggatgttccatagttcatgaatgcaactcacatttgagtgtagtggggaaaaatcattggccaatttaaaaagtcattgtctgcaaatgttttgactgagttgtgcctaaacagaagattctctttttaggatagatatcattctttcatcctgtctggtgttagagccaagctgcttctttcagtagtctatcgtttcttttgaggacagagattatgtcttgtctttcactatgtagacatagcttatcagagtctcttgtactcatagtaatggctttggacccatttactagattgaatggtttgaatttgttttggaaagttgtgatctgttctagtttttatttcagttttagtttcataacaatagctctgatttgcaaattggaagaatctagactgttagaagactgtcaaaatagaatgtgaatatacagagacaccatctaattctcatttctagggatagtaacatggtaagttctaatgttgccctaaatacatatttttgaggagttgaaatcgttctgcttgctgtatttgtacagagatatcttttattcagttttatctattcgttgtagagactaaaatctgtgtattgtaggcattaacatattaatctttttaagttctccagaatagaatctttttggcactttcatgtttggaaattataactcgtaattaggcatattatcactttatagaaaaataatatatcactatagaactgaaaataatatatatattttttttcctttttttttgtcatttgggggaaggaaggtggtttacattgagtatctcttatttgccaaaaagtgtgggaagtttttttgtatacatcatttcatttaatttttgtgattctttgaagcaggtgttatcatcatcccaattttattaatgttcaaactgagtctccaagggattaaagtatctggcttgaggtcatagaataaaggatttaaactaaaaatctgtccagtttccaaaccaatgtttctttaaactacaataaatccatgcaattgggcttgttgtctgtggcatcgtgctttgtattagtgttttacttttgatccaatgtcatcattagaattttgcaatgcctctcatttattctaagaatagctcatatttaaagaaatgcagaaagaatggccactcaaattttaatggtggtaatgttagaggacagaactgcaaatgattcatcacaaatataaaataagcacatgaaataaaaagaacaaagcatactgttggaattaccctgcagccccctaaatcttttaaatcctactaacttgcaaccacaattgttggcttattcttgttagtactccagtgtttcaattgttgttttttaatgcttgctcactcattgttgcaaaatgttctggtaattggatctttaaaaaatcttcagaatattatagatgagcttgtttgcaaatgtgcacatattagagtctgaactgtgcactttaaccattctagagatattgaaaacatgctagaaagttatgtcatggaataaaaaggagctaaatcaaagatttaagctgcctcctgtcactccattagagacaactactcacatgtaccattgtggtctaagtgaaaggtaaatcttacaagtaatggctttattctcatattctttgatcagctgaactcagttggagctatataagcaacaaaaaaatccccagcaggttaaatctttgcctttcttctaatctaaatgaaaatattacagtcactagaaatatggtaatatggtgcaaaatggatcacttcaggtcaagatttcatgggtcaacttgtttgtttaaatgtagtcccagatactcgagcgactgaggcaggagaatcacttgaacctgggaggcggaggttgcagtgagccaagatcgcgccaccgcactccagcctgggtgatagagtgagactccgtctcaaaaacaaaacaaaacaaaacaaaattagacaaatgctacattaatgtttgggtggtaagattctattttgaagtctgaagtttgcagatatgcctatagatttttggagtttaccactttcttagtctgtatcactaatgaaatattttaaattactatatattttaccgtttttctgtatttagtaagaaatttgcatttttgatttgatgtaacaaaggttttaatgtaatttatgttagattttgcatttttttcgttaccattgtactttaacctgacggaatgactgatctctttgtattagtattgtgaataatcatgtgaaatgttttgagacagagtattatatttgtgaatataattttatggctttttcacttagtaagaacctttctattattgtggaaaactaagaaaattgctttctgctgtacaatctggcattcattgtagattaaagcttatttttctgtgaataaaacttattcaataaaatactaaaaaaatttttttaggctaatcaaattttggattgactgccttgccaaatgtgccattaattaaatgcctccctgaccacttttaacttgaatgggaaaagataggattagaatgactatttttaaggatgtctcttacacatccttggcacctggaacagtcgttggcacacaataaatgtcaatgtattgaatgtataaattagtgtgtttaatgtgagtgctcaccaagggaaaaacacaatatgttatttgtcacctctgcaaaattataatcgtacctatctcatagagttacagtataaggataaaattatataatcatgttaaatcctttgagtagtgtatgatacattgtaatcactcagtaaatattacggtgtaaagtacatagtagaggatttgctttttacaatgactttgctgtttgaattgtgagatacacacatacacacactcgcaggcaagtgcacacacatagtgtggcacggtagaaagggtagcatactagtggtcaggagaactggattgaatgcttattccaaagtttgcatgttctctgaagtcaggaaggcattattacttatctcgcttcaattgtctgtcctgtaaaatgggaattgtaatacttgaactgctggaaggcagggttttaagataaactctctttagagggcttttcaaaggtacttaatggccctgagtcaatgataaacctagtataaattgagaaagcctaaaataagaataggttcatgacctataaatacttaatctaaaaatcatcacttaatgatgatgatcacagaacctagaatagtcatgggctatttaaactggaaaaatcccttactcaacagattcggaaatggagaccctgttaaataaagtaaattgcccaaagccagacacaatttctaagaggaagattccaattagaaattacgcattcaactagtgatgaaattgatcaggttgttctcattgcataactgacttggattaaaaaatggcacaacagaactgaagacaaataaggctcttaaaatatatgcagtgataaaatggatctctttcaaaatggatgattctctgcacccttcctctctgcctccctacatagcagtttccatccatcacataggcaatatagacttgagagcaatacttataatttttctaggcttctgctccatctttctgcttagacaaatggaaacatttaaattcttatgattttataaataacatagcattacatatttattcttgtggcaaaacatatatgacatcaaatttaccattttaaccatttttagtgtacaattcagtggcattaagtatgtttgcaatattgtgtaactgtcatcattatctatttccaaaattttacttttttgtcacctgaaacaaaaagtctaatataaaacacattgagaaataaaatatatgttgatttttggaaaatttgttagagtagtgcattaacctcatgtagataatttgcacaatgggtttatgtttctttttctgttaaattcagtttaaaccatgatttatttgccctaggtatatgtcatagcccttggaggcaaatttcacatatttttgagcctgtgaaatagtaccagtttcataggttgggccaaggtcagttgactggatgaactgtaagaattatctatcttaaaaataacggctggactgggctcattttaatactcttactgatcaccattttcatatattgtttaattatttagaaacctttttctgtaatgaattatacctgattaaattatttgcattaccatgtgtttaaatgtgccaaccatagtcaaatattatcattaaaatgcttaatttgccaagtatagagtcaagagcaactcagtaaataaaggatgaagaaattttctctatgtagaatagtttttcctttgcttgaatatatcatagttaaaaatttttctaatggagaacaaaggctagaatccaattcagctctggaaaaaaaatcattttgtaaaatggataaactgccatttttcttacccagtgattcatcatgtatttctaaattctgataagaattgttacaagtcttttctctagcattattagaaaatctacattattatgtatgacagaccatgtcaaaataattgtgtgtgggactagtctaggttaaggggaatcgtatttgatgttactaattttcacattatttcacctataaaaattcttctagcagcaaaagttttattgcactgtatttcagagtctctaatttattcatgggataaatgtttcatataatgaattttcaagtaaatgtattctgaaattcatgcataaccatgcctgctctaaaactataaaaatttggttaaaattgaggcatctcctcattccccttggaaagtatattggggaacctggaagattttatgctaatgaaggcaatatggttcagcttttctttttatccaatatatttcttttattgagttcaaaccattgtcctaattaataactttaaatggaagcacttcatcaattgtattgaggcactaatactgcttaaaaggtagtatgtgctaggcccatcctgtgtcattcaacacatgccttgtgatagagaaatatgttctacattttcttctgaatattttgtgtggtttaagagccctctgccatatgatcttgtatctgcctttcttccctcactcactccctgcttcatctcctcctttggatttttgtagtggtggtggtggttgctcatctcgatgctgtgctacagtctgtgggcattggtaaggagcatctctctggtgtgatccacacacaataaacagacatgaatacaagtaatggtttaaagcatgcagtcacatctgcctccatcttcacatggaagggtggtctgaggttattctggcaggattttattctactatttgttcaatttgccaatgtaagagataaacataggatttggaagtatagaatctatgtttatcctcaataccaagaattcttgtgccttgggaatgttgccgtatgccaaacccaaggtattatatttaaagattaagttcctgaaaaaccctcattttcaaagaataacattatattgcatttgtaaagttgtaaagtagaatttcatatataaaaaaatctgtattcactcccctcaagacagcgaagaaggtcacttttcctagggaaaagaacaacacaaattttaaaagatcacacagtgtgtgtttctttgcctagacagcctctttggtttggaatccttccctgaaagatgggcagtgatcagactgggcaacccctccctcaattaaaaataaagaaaaaacagtctattatgtgtagtttttaatgagtataaaactcaatatgcaatgaattcaatatacaatgaaatgtcagaaatacaatatataatgaaatgtttcatttgaagagagaggctgttgtgcatttatactcattcattcattcacgcattcagcgacatttattgtgtacctactatggactggtcacttttctaggttctagggacataataatgaataaaacaagtcaggactctgccgtcttcaaacttgcatccttggagcggtggcagatggatatcagagaataatgaaaataagtgtgtaaaatataaaatatgtaggatgatgacaagtgctattaaaaacatgaaatcagggagggtgttagagaatggctcaggggctcaatttctaagagtggttaggagaggcctaacggatgtgacatttgaacaaagacttgaaggaggtgaggaagcaagccatggactatgtgtgggaagagccttccaaacaaggggaacagcaagtgcaaaggatgtctgaaaaatataaagaggccatagaggctggagcagagtactcaaaggggagaatggcagcagatgagacagggaggggaaggttgtttccattttgggtaggtagagaacaggtcttggagcagcatcttgcagaccatttataagggccatggattttactctaagtgagatgagagccgttgaagggttttgagcagcacgagtgaggcacctttgcatggcactttggtggttatagaaatgcatcaaattttgtcatttctcttgatgtgatatagtaaacttcgataatgggattttataaaactcatgtctcttagggctagcaccttcagtgttgggggaggttggtcttgcagtgaagaatgcacaatgtgccctgattaaataattagcaataaattttacagaaaataccttcagcataggatttccagtacttcctatttcacccaacatacaaaatttctgaaaaataaattatgttccaaaaccacttgcagtcagcctaattataggcatctctatctcttctatccattggcaggaataaacttgaaaaggctgcccacttattgagtcttgagtccaaaaatcaatgtgaggtagtcagttctcaaataaaagagattgggaagaaagcaggaagaggattgaaaaattggcctcctcagaaatgcacgaaggggacatttgcagtcttaaggggcatatttcctagtagcatgtcttgtaggggccctactgaggtaaatgagttaatcttagtctgtttaagaagttccattataatggttctttcagggtatgaaaatgcaaagaagtgaatctttcaatgaccagatgcatagaagcatgttttaaatgactgcaatgtaattgatatatgctgccatcagttgtgacccaggtaatagtgcagctaaaataatttcaagtgggtcaagatatccctggagtacttcctgcagtgttataaaaaatctcccagcaatgtatcttaagttctgtaaatcatgttaaacttaatgaaaccttctgcaagagcattccatttctatgatgcatttaactgcagttgttgacatgttgtatcttaattgaagaaatatgtaaacttttgattaattgcttgtggtaccaggaatataaaatatactgaccacttttttaaagtaagatttagggtatgtgtctttatgtataattgattactccctaattaattaaaatatgctcctttagactttgttttccatctcagactaatatttgcattcctatgttgtggatttagtttatgatgcttatttttttaagatagaaaactctgaaactcaaggctgacctgcagtatgttcatcatgtttattcttactgctttggcacagttgagtttgataataataatgctagcttagttcagtcagattcagtgcccttggagtacctactctgtgcagtactgtgttttgtggaagtcgtgcagtgtcttcaattgaacaagtatataccatggctacaacacaaaaaatttactgagaaccaaaattttatgccaatggcctgtcgatagtctccttcctcctaagatgtcgcctccagaatgtcaggagcttcctctgtctcattcacttctgtatccctagccagattgacacatcaaattaaccatcatagtgctggacacagagtaaatgcttactgcatatttgttgaaagagtgaataaatgtgagaacaaacatttgctatatacctactgtgtgcaggggtctaggccaagtaggtcacagtccctcctattgagtagtttagtcttgatgatgtgggaaatgaggctgaagacagaaatcagagaaacaaaaataaaataaagggaagaggagagtgaaagttcaaaaatgagttgatggtgtctgccaggaaaaaccaggaatgccgtcactgcagaggtggggttcaaggaagcatcccaggaccttgaacagcagaccttgaacaccaggatgaagcgtagtctggctgggagaatgacgttgatagaagcgctaacaagggaaaggacacattatgtttgcagagcagcaagtgatctgagtttcttatcaagcaatttataaaaatgtaggcatgttccttatcaagcaattagtaagcatgttcttctagcacctttaatgtcactagatttagtttctggttaggtgtacaagcaaaggggaagaagttcagcaagtaatacatcaagaaagccccagatcagcacatatatgtacaccattccactcccactagtgtgtgctcgctggcacacacagacatacacacacacatgcgtgcatgctccggatgattccaagcatagctctctcctgttgctgccagacttgacctcttctaatgatggggagcagaccacagagaagtctcttgcacatatcccaatatgaggatgataggggccatttgaacacatatgtccaaagagaaaccatgaggttttaattgtggtcaaaagcattctacttatagacttgaatccagatggatgaattcactgctcaacagcataggtatgaatttgtttaatcaacttcgtaagaaccaagtcaagttcagatacacttactttgcagtctaattttctaggggtcccaaagttttaatacaatcatcttctctgatttcccacaggaaatgatgatcccatacatttaaaatgttttaattactcaaggaatacaggaatacatgattaaacacaaacactacagataagcctcaagtgcccttttgcttctgtctgaaattcttgtcccttctcctgcttttgtaggtaaaaactgctatgaatttgatgccttcaaagcatcatttctctctctctctctgtgtgtgtgtgtattcacaaccacattatatatattattttgcataggtgcattttacataaatggttatatatacatatatatgtgtatgtgtctgtgtgtacatatatagtaagtgttgctgttttcagctaactatatgtcatagtaatctactggctttaactcaatcctttgaccagctgtcccaaattctaggctattaaatatgataatgcactgtttattgtgccatccccttgttggaggacactggagttgtttccagttttttggctgttggaaacagtgctacacttaacacatttctatactatactcctagtgcccccagggaagaatcaaaagagagaacgttggaccctacaacttaattttaaacaaatgtcttctgatagaagaatctatgccagtgtaagatgagcttccttatttccttaacttcttatttcaggtgatatgaatgaccttggttgggggagtgtttctagattagtcattattggtcctacatatattttcccatgacatacagggtggcaggccattttctctctgagtttactatggatggctctgctacagtgtcttgttttaattactcaaggaattacaactcaaggtgttgaaactgcatatcagaggggatttctaaatgcagggagcccctctctcagttgccttatctatatatactcttacataggaatagtgacttactacttgctctccccactcaccacagatgccttttgtggcctctgtcttccttctttttctcacaaatagttcttggacacctttatgtgccacacactattgtagacactggggatccatcaaggaatacagcaaactaaattcttgcccatgtggaggttatattttagagggaggagacagataataaatgataagcacaataaggaaagtatagtatgttcaagcatgctaagtgctagaggaaaaaaaggaaaacagtctggcaattctgcaaaaagttaaagataaagatatcatataactcaacagttgcacttctaggtatacatttaagagaactgaaaccatacgtccacacagaaaaatggcacgcagatgttcataatagcattattcataatagccccaaagtggaaacatctcaaatctccatcaatggacaaacgaatacacaaaatatggtctatccatacagtggaatattattcagccatgtaaatgaatgaagtacgaatacataccacaacatagatgaaccataacaacattaggctaactgaaagaggtttgaaacaaaacgtcacatatattatttcattaatatgaaacattcagaaataggcaagtccctagagacagaaagcagcttatcagttaccagaggatggggaacacagagtaactgcttaatatgtagagtctctccttttcgggtgatgaaaatgtttaagaatcagacagtggtgatgttcacttaacattgtgagtgtacttaatgccactgaattacacacttaaaaatggttggtgtttaattttatgtcttgtagttttacctacatttaaaaaaatggagcaggtcaaggaggacctggattgcagaattggagtgcaattttgaagggtatcactgaacaggtgccatctgagctgcaaacataccaggtagcgggggcagccattcaaagggtcataagaaggggcattgcctggtgtgttcagagaacaggaaggaggcaatgtgcctggatgtgagtaaaggaagggcaataggaacagaggcagccttggtcttcctcattcacctgctgttttagacaccactggctgcaattgcccacagttagttacctgcccaaagttgcagtgatgatggtactggcagtggtgaggaaaagaagggaaaaggcagaaaaatcactccagatacttcccaaggcccagaatttgatcatacattatttcttttgactatgagtttcctttacatgatatttccccttagttttttttttttttaacatagaatgcatctttcagtaacactttatctcatataaaggagtgtggacttaccttttgtaacatcagtgaagaaaggttaaggttcccaacaatttaaagggatattatttcagtgaatctctatgtgagaataaattaaataaaacagacatgcaaaagaaaaagtgaattcatttagagagagatcatgtccctctgttctcagatgcttttgaagaaaacataatcatggataatcatccactgttgcattctcaggtctcctctgaccccacaaaatgagcatagggtcatcatttccttttcagaaacacttataaataattgagcgaggcaatgatgtgaactgggaagggcaatggacctaggactagaagcgtggatttggggcccaacacttgtatttataatttgtacaaccttgggcaagacacctaacctcagagctgcaggttctttatcttcaagttcgaaatgatatcatccctacctatctaactgggtcgccgtgaagttcatatgaatcaaaggtatataactgctttgaaaagtacaatttcataaatagaaagtactactattagtcttcaaacataaaagcggttatcaagaaaacctaaaacctctctccttctatgtgtgtttgcatatttataatttttttttattttatgatagtacacatgtggagtctctgagccccttgagaaaagggaaacctgttttattcatctctgtatccctggcactgagcagtgttctatacacacagtaggagcatagttagttaggctaggttgagtgaatggataaataaaccaactgtattttgaattattctcatgaggtaatggtttacagtgtcccacgatttaccatgcacactgtttgatagtttgagtattcaggtgtctaagaatggatggaggaagctaacaaaacagagtttaaattgagatgatgtcataattagcttatttattgtgacctagaataaagaacatggtgattccacaacagttttggggcagtctgggatattaaggtgagttttggttgtggcaacccagaggaaggttgcagtggcccatctatctatcccagatgtaagatatgcttcacccctctttcttgatccatgaagttcaaaaggaggcaccaagcatttccgtccttcttcaagatgaaggtaggcaatatgagttggctgtagaaggtctacaatcagccaaaggcttaacaagtagcttttctctctctttacaaatgagtcctgatcacagtgaggtatttcctttggcttaaagctatccaaagcactgatttaaatacagttccttagaggtaaaattgtatggatttccttctcactaagtaaggaaactgagacaaacaccagttaaaggcctcagggtagtcagaatgcttcactgactgtcccttttggaactaaggacaaccagagcataatggattggatctgagattctcacatcagaaagtgaacagaagaaaactgaatgtcattctgagacttcagtaaaggataatgtccattttctcatccaccaaatagggataattatctctaacttactaagtggtcgtggggatcaaaacaaacaacgataacaaaacagcctatttgtctgctatttaagtgctcacatgttccagaatggatggtgcaggccaacaacatggggctgagtttgaagtcagaattagcttctttattatcagctagatttgttgctttctaaccagcaacaatgacaacaaaacttagcatatggaggggcccagcagagctcctggcatgtagtaggtgctcactgaatgttaagaaatacagacctataatgagggatgcttggcaatgggtatgtagaatgctaaagataaccactcactttgcccatttacatcagttagaccattgccaccatttgcactcccagcctcttccattcccccaactctactctatttccctctgtgttctcttgtgtctttctctaatttttttcaactctcactttttttcctcccctactttttgcttggttcctcagtgagatctatgagcataatatactccaactacagtaattcaccttgctgaagtggctgctgagttctgctttgaaggaaatttacttatttaattttggtggggggaagttgtggctggaccacttatagaaatgtaggtctagttttctgggaatgtttaaagaaaccatgcgcaaatgtacattgtcttcctccctctctccttccttcccttcctttcttcctttcttctttcctcattcccatcctccccctttcttccttccttccttcaatcaatcatatatccatattcatatatagatatatatatttaatcttttacctataactcttgtcaattctatcttcatttttcccctttgggcttatgagtatttatagttggtgctccataaatgtttattatgagtaacaatgataatagtgatagaaagagcaacacatgtgctattcctcagtgctttttatctcatgtacaaaattaaacactaatgttgccatcagttactcccaaaaagatggtggaagcatatttgttagtaatattttgataataactatataaacagatatttgtcatgctattctgactcctacatcttcattcacagaagaacattttatttacattgtcaagtaagagggtggcaatttaagtgacacttgcaatttatcacttgctttgctttccaaggcaagtcctaggagttgcatttttgaaatgggtctagaatcattcttttctaagtgttttcaaatatactcagaaggataaaacagatctctatatccatatctcatatttctatggagggttcatagagatatttgtcctccatagagatatgagatatagatattacctgaacttgcaccctggaatattttccttgtctcaggtagtttagttgattgaaagcctccagggtttataacatgtctgtctaactgcctcttgacattataggcttaaagtctatgtgtaaagaatccacttggtggagggcaactttcttttgggtgtgtattttacaatcaaagtgagatattccaaaatgcaaaggaaaatatatgcacagaaagaaacatgacactgaacaaaattggacaggcctgacaaaaaataggtgtggataaatgaaaacttgaacctggcagtgaagagcacatgatttggagtgggccaacactggctctaccatttatttgctttggaacactggggaaagtccttctctggtcctcagtttcctcacatgtgaaatggggataataatcgtctctacctcatagtgtcattgtgagtcacaaatgaaacaaatgcattgaaaatcattgtgcggataacatgaaataatatttatctagtgcttagcagatagaacattggataaataggggcagttatcactattatcctatcagacaggttgtctgtgtcagcccttcgttaggatggcatcatctgcctaggaccaacagtggagggcagtgtagaggcatgattttatttgactatttcaattagtaagtgtatcaggttgctagtgctgctgtaacattgtactacaaaccaggtggcttaaataacaaacatttattgtctcatagttctggagactagaagactgcggtgatggcagggccatggtccatttgaagcccctaggggaagatacttccttacattttccagattttggtagccccgggcgttgccgtagcacttcagtgtctgtcaccattgtcacatgatattcttctctgcatgggtgtgtgtcgatgcccaaatttccctcttctcataaggacatcagtcatattggatttagagtgcaccctactctagtaactgttcatcttaacctcacaaattaatctgcagtggccctgttcaaaaataaggtcatatacacaggtaccagaggttaggatttcaacacatcttttgagggtgggaacgcagttcaactcataacagcaagtgtctgttaaggtcttatagtatactaggtgctgatcttgatatggaaggactggtcagaagggcagaggaaagagggctttaaatgagggaaattgtgtgagttctggttcaggaacaacaacaacaacaacaaaaacccacaagattttgttcagcaagtaacactgtgttgtcagagtatggatttcccagtgagcatggtgggtagagttgctgagaagacaggctaagtgacacgtatccacgccttctgatatttggggttgcactggctctttttttgtcttattccccctcttaaagaatggcccttccctccactcaggctcgcaagaactcgaccagcgagaccttgtaatttcctacctcttctcatcttcatgtgagatgtcctctttcatcaatcactgtaggctgtcaagctggcctgtgcctgcatcattactgcttggaacatggcaatgacttctttctaacttgtttttctgtttccagtcccttctccctagttcgtcctccatactattgcatatctgaacatgtcaacactctgctaaaaactccatcaatgattgtccaacactaacatgatgaaattcaaactccttagtttagcataaatgcctaatatgcctactccctcaattcttagccatcctgcagtgccattacaatgaactaccactgtagcatctcaactgccccaatgtgtgtcatgcctcactacctttgtataccccagtcctctgggcaatgttctcttcctttctctccctttaccatcttgctagctctttctcaagtcttcaccactcaagtattaccttctccaggaagccctccttgatctagtgtctagtctgagataggttctcatttttctcatgcttcatgagtatagggctgtggtcagtcctctaccttgtcatatagcacagtgtaccacagtccctaattaccgtggttttccactccaccacacaatgagaagtgtggcttgcaaaggcctatggctcatgtctctctgtagcccccatgctgagtgctgggcctagcccagggcagaaggccaatttaaatgttcatgggctggacagtagaaaggtagcaggctagccaacctcatggcctgggagttacctctgagatgattgattccctaacgtcctctggcaaaaatgtagatcaaaatatctcttctaccacatacaaacactttgataagggagaaatttaatgcaactgagagatacggagacaaactttctaattatacagctcacgggcctggcatttggcagggatcatgtgaagcattcacttttctccattttaagtcaccatttcccaaagttgaattattgagagcacattaggcagaagatgaggagtgagaataaaaaaaaaaataacttcagtagacaatcaccttgtaaacatcttgagatgaggctggctattaaacaggaacgttcggtaccaactgaagctcaggtgagtttagccaagcaaatcaatgcaagttaatcttccagtgtcagctggctgagttttggactagtgatgaatgccttgactggaaagatgaaatgctggaatgccagccagtgttctgacagctacagatggtgccaattactgccagtggagcctgtcctgctgtgagcccaagatgtctgatttgtggccacaggaaaatgaaaaagaggccttccagctgggcctgtcacctgtccttctgtcctttattgttctgtaaccaaaattgtattcaggtttgaaaacctttttttttctttttttcttttttctttttttttttttttggtgatgatggtgggggcattggacatggggcggaaacaggaacaatgttactcatgttaatcatacagccatgctcattgccaagcgtatgcctgaggaggtgaagcaagtcactaccaaggttggccacttcttcccatcccgttcctagcaaacaaaagactgtcaattaacctgaaacatggagaaaagcaaatgaaaatagccccaaggctcatgatggccatgggattttgtacacataagcatgatctattgtatcttttgaggaggatgtttctgctaggaagattgctgtgcctctctcctatggcagacctcagaactgggttctccttgtgtttaggccatggtaacaaatgaactcaggtacatgtttggagtctaacacccaatggccctctactgtgctcatcctttgagagagtaggctgcactcaaactttagaggtatccaacaatgataccttggcataaattgcataaattgcatcctcattataagagtaacaatataaaaaataataaaatcaacaacaatatctgcagtcacattcatttattgagaacttatgatgaataaaatattagaccaggtcttttacctactttgcccttaatcattttaacaaaattgcctgagagatattactatcccattttacaaatgaaggcactgagtaacagagaggttgaatggcttgcccaaggccacagaattactgagtaatgccacctagatttgaacacaattctccaaatcttacaagggagtacaaccaagaagtgaaaagaatactattactttcatgtcatatagttagagtaaggtgttcaatttatgttgcaatgagcataaaggagctaacgctaagcgctttagtagtagtggaatagcaatagggaggacagaagcaacagcggagttagtaattaatacatcatttagacttttactattattactgttagccaagttttgcttccagtaggtcaccactgaatattatggttctggtcctagataatggatagataatactaggcacacgggtagttttttttgtgaagcaggcaagcatatagggtcagctggtacccagtttgagtcaagaagagacatcagcctagtctagttgtcaagccatagggtggcatttgactcttacagcacacctaaagaaagccactctagccatatccatcaataattccatcagtccttggagaacccttcggaggcagtgtgaggaatggaaaagtcagtcccaaaagccctacccccacagggaccctgtgagcagtgtcactcctgcatggcctaatcttctgctccacatcaactgaactctcttaacctggatgttgtcctgcatccagtgtgatttcctgggaggtggagtgggttctgggatcctcttaccaggatttggtctggaagatcaggtactctaataaaagaccatttcctcctttaataaaacatggagcacaaacaggctccagtgccctctgagaaaatcccaagacaacacagtttcttaaaaggcacttcctccaactttgtgggcaagcagagattagagtttgggtcctaagaaaacttagcttactaagatatggctggtgcctctagaacacttttacttctctgacataatgtccgtctttgataaactttcagtgcatttctcccttttcctgttctcttactcaacacaaatcgtcattgactgcacttcgacatttctttctgtctttgtcgagacatctgtgatctctaattgattttttctccaaaagacaattgattataaaaacttaagtgactcaaaattattttacttgtaatactttaaattattatggatagtatatcttggccactttagtttgcagtcctggcttttcaagatggccaagagtttcttgaagaactagcaacaaatcagaatgattttttagttttaaaagaactttatatttttaaaaaatagagtgttgaagggctataggccagttttcctcagtaatttccatgtggcgattgtttaggggttttccaagaccacccagtattcattgacttgctagaaggacttgtggaacttaacatgcagtcaaactcaagactgagagacacaacaagaataaatattacagcaagatcaataaaggaaaagacacatcaagaagagtcttgaggaatccatgtgcaggcttcctatgctctatccctgccatgaggggccgcacagcaagctctcaccatagcaacaaaaatgcagccacatacgtgcaatatttctttccaggaaaatccatttgagacttagcgtccaaggtttttactggggtctggtcacacaggcccactctgcctagcaactaccaaaatttcagattcccagagggaaaaccaatttagggccccaggtgggcaaaacagtcttgtcacggaggggaaatttcttatcggtatagggaactgtttaccagtcaagtgcccagacttcagccgaagaccaaccttataaaaaagcctttctaaggagagcagtctcaggcctgccactttaaactctgttctgcacataccatccttttgtcccttggccaaggtatctttatagcaaaatcactatcagtatgaccccatttggcagggtgagactaacctgcagtattgatctcagtcgtgtcttttaggggtcatggatttagccagttaaaacaaatcccaccaatcacaaaggtctgtgttaaaaagccaggtggcttccttcttaagtttttgtatgaaccattttgatctggcctggggtattgatttaggtgtagcacagctctggcagtgtgttggcagttgacccaaaaaccttgcaagcctgaagtggtatccagatagccagggcacacacaagaaacacaatcccccagggcacacatggtccccatgcagacacacaacttaacaattgttagggcatcctgggcagtacagattaacagagcccccagtgtggcctcccacccaaaaaagatgtggcaggcatcctttttcttgtgctttctgaaaggcggaagcaatgctttatagtcagatttaaatgtttatttatttatttcaaattaataatgacctataatcattggctttatttaagcataataaaatggaaatctgctttttttgttttagaattatctgactggaataacctaactgctaaaagcttctaaattaagatggacaaattttttttttcattttattaaatatgtcctataggaattgagctattttgctctcaacttcaaacacaaatatttatcaaattttaagattcatttaacaatcgaattataccagcagacaaatagccttataaaatgaccctcagcatctgggaagcatgtcacagttgtgcatgttgtatttccaccatatcactttgcagaattgatagtttctgctccaaatgactatgaatgctaaattgcactctcttaaatgggaaattggcttatacattagaacttttggaaataaagataaatggagagagtgaaaaggaggtcaatgatgatacagtgctttacactttgcaaaacactgtctcatagattctcacaattgtcctctgaggttggcattctcattgccactttaaaagtgaaaaaaaaaatgagtttggaacacgttgaaaatcactctaaataaacgagtagcaatgtatagaattaaagatagatattctgactcccaactctaccttttgagctactattaataccacaaggctagctagcttttaagccttcagcctctcatcttgcttcagcatggaaattgtacagcactagagtaagcctagctgacaatttgctagtgttctttatagccttatagtgtctcaaggctgatgtttctgttgcagatgttcctcacttctttgattcaagatcaagagagttccgataaaaagatactgtattttgtatgttttctgtaattgatggtgttgatgtctttggtgttaatacatgagtgcttttgaagagccattagaacagggaaaaagttgcaagacacaaatctcaacttaacactattccgagacactaactagttaatcaattgactgtacataactagctgagcttgggcgtggcatgcaattctcactccaaaaagagctgctgccacagcgtcatcgggtttactgtccattttcctttgttgtaggctgtttcacagcaaatctttagccttagccttccctgggactggcttcttgttaaagaaatctctgctgtctactgaactcattttcatttcctgccagcaagaagagaggggataaaactggtgcaatccataggccataggccccaagtggacagttttctgtagagctgaagcagacgatgggtgggtttatgtaacattaaacccaggtgggtacttacccactttgccttggtgcaacatgttttggacttggcacaaattagtgtgtttgtctttcattctacttggctactagccagcaaggatactctattttcattttgaaatttcacctggcagatccttaaaagtcaccagaggacttttcctgagtaataaaaagcaacttttattgaaaactaattattttttccgatgaatatgccagctgtttaaaaatgctgcagtcatgttaaagcacattttaatagtgtacttgcaaatgcagatccaggcgtgaaatgctttttgacagtaacttgtaagcaccttattccaatatacctctatgcctagttacatgcaggtctggaaatctgataaatgccaaaaaatatccactaggtgagtaaatcagttatttgaaaatgggcacatattataaagttcactatataactaacaggttccccctgcttaggaatgaagactgacagaagaaatgcataccattattcatcgagcaattttaagcttttagaagggagtaggattgaattacttgggaaggttgcggttattctgggtatacttgggtttgtgtgtcactctgcatctttgcctgtgtctacacacgtagttgtgtattccctgtgttctgggctccacactaaccactgagatatgtatgaaacactaaaatgaattaaacattgtctttgcctgccaggaatttacagcttcatggggtgaatcagaagagagacaagaacagaaatgtaaacaagacagaattatgcacgtgtgaaatagaggcttaagggatatcttggacttacacaaagcctggtgtacattctgacttaagggaccaaagaagagcgtgataatagaggtcccatttgagctaggtcttcaaggatgaaaatggcaatgattagtggaatgtagagaaaggacatttttcattcattgaaggaataataacaaagacaccaaagaataaaggggcatggtcgggaagggagaagagcaaaggagatgaggctggatggagcagatgacagaaagtctcaatgtgacactacagacgttattttcttttctgtttagatttgtgagagggagaatggatttgctctctgttgagtctaggcctgtgaaaagggaactggcatacccaggctttcattctggtggtgagtagaaaatgaattggagagacagggaatagacaagactagagacagggaaacagaccagttaggagctataacaatagttcagggaagggacgacaagggtttgaaaggggcattaaaacaattatccagtgaatttaatcaatgcagagagtgatctcgctaattcggggagttgggaaggaggcactttactctcaattgcttgttttttattggcttgacttggccagataattgtctcaactttccactttgctatgcctatgtcaccgccactgtatagtttggacaaattgcttagtatctctaggtttcattttcaccagctgtaaaatagtgatgataattcttgctaccaatggtaattacctcataggaatgttctacgcatttgtgtgagtggtagcatatctgtggcatgcaataatcattaataagatttctaatacttctactaatgtgcttgaagatcttctgaaaagtcaacacacccaaatactaaaacacttgaagtgataaaagggtgactccatttgattaagcaataatccctgatggcctctctttaatttgcaaatcctctctgatttaattcaaaaattttattttataacataaatgtaatatccaaagttgtcttaagaacctttctaggatttttgcagcagattggaggctgctttccaccagctccaaagccgttccaaacaccaaagatttcctagatgatgagtttgcctgtctgtctgcaggtaacagttgaagtccagaggtgttttagagtttagcagtgtcctttattgatgacctaaggacccagtgacagaaataagttttgttatttttctaaatcatgatgaaaactttaagaaaaaaaatgcctttgttgactgacctcagattattgtagagtgttaagaaaattaggggaagatttagatgacatttcctttcaggaagtcagcctactcctcccccaacatctactccacaaaacaaaactgcacattcatgagatgcacatgcattgacatgatccgaactatgtttttcagaacatctgggcttggttggccagtattagccatacttacaaaacaaaacacccaaagccaatgttgcatgtcagttctactactaacaagcaaacaagtgaaaccattcctggggcttaaaactagttcaccaggaaattcaggcaagtgagaattgagctccccattgccagtgcagctttctgatggtggtgtggtctcaggaagccaagctgtggaagacagaagctccatttcagctattaacagcctagatgttgaagcatgttattccaggatgaggtgtttggcagccaggaagattgtgtacataaatctgggcaagactttaaaggcctctgtctcagatcagctctttctgacaagtcatttcagtgagaccatttcaaggtatggcatccagttccttgagtgacctaaatctccccgatgctgctctacccccaaaaagatcccaaagaattcatttctatctatgcctagccaagtgtcttagaccaatttatagagacgagttctgctgcacgtgtccacacctcagagtttagcagtagcaagccaggctgtatgtatcttttcccagctggtcttggcaaagcaccagtcccaaaggacctaaactgaagtggcaacgtttgatttatctaaatgagttgctttcataggaatgggaagattttctctgtgagtgtgtggggctggccctcacttgatatctgactacaggttcactttttatactccatccccaagcatctgggaaattgcattttccttcaaagtgcaacccctaccttttctcagaaataacagaagaaaggaagcatttcggacaaagcacttactttagaacaaggtagaaaactctaaaattttagaaggaagagtttaaaaaccactggatacagagtcaaaaggctcattgttcaagagaaaattctgccattttaagcacagcaaaagaaactaccctcagagtgaacaggcaacctacaacatgggagaaaattttcgccacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacatatgtttactgcggcattattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaaccatcattctcagtaaactatcgcaagaacaaaaaaaccaaacaccgcatattctcactcataggtgggaattgaacaatgagatcacatggtcacaggaaggggaatatcacactctggggactgtggtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaaaaaagaaagaaatacaagcagatgaaaaaaaaaaaaaactactgtgattttggggtaagtcacttcagtattctgatcttgtttagcttcttatgtatagaatgggagtacctagtacctgcttcaccagcctctcagcattgcttagagggccagaggaggtgatccatgcactcattctttgaaaaatataaaggattgcttatttggaagtttctttttgggatgtggtatgctttatgagcaaaaggcccataattgtccagattaactacctgtcactagaggcagaaataattcaataactcagcagccaactctcttattcaaacaacactgaatgacatgtttgtggcttccttttccttgtatataaatagcaccagcttcaaaatgatttgatctttggtcaagaggttattactgactctgatttagagatacaattaacttcccatcaataactgtgttcaacctaaaataattataataataaatattattttattggcaagatttttgtctggaggtagggttcactgttttacccttgtaagtgagctgctgagaatgaagtaataaaaattagttattttgactactcatgcaacattgtctgcctgcttggcgttatgtgttaagaacatttaattaaggatgggtgaaattgtcattcatttatttattaaaatatttgtgacacaacacccacatctccagtactgtcatcttaggtactaagtactgtaggatttttctgccctcacacattgtatccctttaaatctagtatacttttccttcttttgtgcattcattcattcattcatcctttcattcattcatctccttaataaatattggaatgaaccctttttctgtctgagaaactgtgttagtgctctggaagttggaactccgtaggcttgcctatgataagacacctgacacaaaggagacaataaagtaatttttatgaaaaataaaaaattgaaatattactgatgagcaaaaatacatattttatccaagcaaaagccatactttctgaaactccacgatttgtgtttttgtgcttgtacgttttactttttttcctttacagtgctgccactgagttaacatatcaatagatgcacaacccaccagtggatataattaatgcttggaaattgtggctttcagaaagtcccaccaagcacaggaaaatgtcttaatttgacagtgggcctgaccaaatgctagtttgtttggaaagacaaaactagccagttatgcagtgtatggtctataatctgacagaaggagaccaaaacctacctagctatttccatccagtggccttggttccaacaatagtgccatttacagcaagactattaaatatccttgcatggcatcaccttatataaacatagtggtgagggaccagaagcctggggacagaacatgtgctgcagccctcttgtccacccagtggggaccttccaggccacattagactcacacagggagggtgatgaagtgcttgctctgcactttatttgcctctagttgttgtctatggattcctttcctgtaataggcacttgtttggctactgtacttgagctattgtatgatttcagctcaggagtttggatgcagtagccggcgaggactatgaacatagtagtgagagaccagccattaaaaatggaagaggaaaggaatagttaataggcatatattatgtgcttggcactctgttaggcctttatgcacattatctcatgtgtacctcccaacaatactatgaacaatactatgaagctagtattgtatccctactgtgttgcagagagaacagccactttctcaaagccacacagtaaagcatggagccaggataccatcccaagtattccaccatatgctttattcaattcgccacactgactactacattatcttcctttgttgaatcaggaaatgacgtatatgatatctactgaagatgggtcattctcttgtttgtcttaggctaaccagtgtcacaattttgaaaatgttaactaaaaacattttaggaatcttaaaaagtctatctcaatatttatgaataagagtcccccttcctcaccacttccaccaaataacagaggcagtgaaacccaatgtctactaaatggttctttataaacatgttttttcataaattttgtgcatttgtattttttgtgtaccttcaactggtttgagtatgtacggagacacaggtgtgagaactggaagaacactgaaagatcatctagcatgtctgacagatgcagaaatttagatccagagaaggagactgttattctctccaaaaatcacccagcaagcaagtgaaaacactagaacttcaccttgaagaaaatgtcattgtgtgcctatagctataaattaggtcgcccagacttattaggcatcgattcatataagaatagacccttagttttgcagaggtttgacagatatgcacaagtggcttgcttgggaattacatgtatctcaggctttaaagcaagagatggcatgttatctttgatgctggaaagaccaaagacccaggaaaataatttttcatccaagaatgtgcaaacaaatagtttctcagattctctgatgcacagttctctttgagagtctgtgtatatttatgcacatatccacctttagttattctttctttcaatcctatgtttagcttttaggaatttaaacaatgtgcaatttttgttttgttttgttttgcatttcattaaggcacatgaagactatgttggaacacttgggctaaaatgtggttctaccatatagtttatcaattttaaacaggtaaaatattggtacatatgagaatattaaaatttgtttttctagtacctccatcttttttcctgcttatgtaaacaaatgaatgcaattcattgagatttctttatagtaaaagtaagtgaattgtacaaataagtttctgtttcttttgagtacctaaatatttattttattttatttttctttaagttattggggtacaggtggtatttggttgcatgtgtaagttttttagaggtgatttgtgagattttggtgcacccattacccgagcagcatacactgcaccctatttgtagtcttttatccctcacccctctcccactcttccccgcaagtccccaaagtccattgtatcattcttatgcctttgtgtcctcatagtttagctcccacatatcagtgaggacatacaatttttgtttttccattcctgagttacttcacttagaataatagtctccagtctcatccagatcagtgcaaatactgttaattcattcctttttatggctgcatagtattcaattgtatatctataccacagtttctttatctactcattgattgatgggcatttgggtttgttccatgattttgcaattgtaaattgtgctgctattaacatgcatgtgtgagtatctttttcctataatgatctgttttcctctggttagatacccagtagtgggattgctggatcaaatggtagttctacttttagttctttaaggaatctccacactgttttccatagtggctgtactagtttatattcccaccagcagtgtagaagtgttccctggtcaccgcatccatgccaacatctactgttttttgattttttgatcatggccattcttgcaggagtgaggtggtatcacattgtgcttttgatttgcatttccctgatcactagtgatgttgagcatttttttcatatgtttgttggtcatttgtatatcttcttttgagaattgtctattcatgtccttagcccattttttgatgggattttttttttcttaatgatttgtttgagttcgttgtagattctggatattagtcctttgttagatgtatacattgtgaagattttctcccactctgtgggttgtctgtttactctgctgactgttccttttgccatgcaaaagctctctagtttaattaggtcccagctatttatctttgtttttattgcatttgctttgggttcttggtcattaaatctttgcctaagctaatgtctagaagggtttttccaatgttatcttctagaatttttatagtttcaggtcttagatttaagttcttaatccatcttgtgttgatttttgtataacgtgacagatgaggctccagtttcattatcctacatatggctagctaattatcccagcaccatttgttgaaaagggtgtcttttccccactttgtgattttgtttgctctgtagaagatcagttgggtgtaagtatttgggttaatttctaggttctctattttattccattggtctctgtgcctatttttatagcagtaccacactgttttggtgactatggccttataatatagcttgaaatcaggtagtgtgatgcctccagatttgttctttttgcttagtcttgcgttggctgtgcaggctcctttttggttccatatgaattttagaattgtttttttctaattctgtgaagcatgatggtggtattttaatggagattgtgttgaatttgtagattgctttcggcagtatgctcatttttataatattgattctacccatccataagcatggaatgtgttttcatttgtttgtgtcatctatgatttctttcaacagtgttttgtagttttccttgtagatgtttttttctcctttgttaggtatattcctaagtattttattttatttttgcagctattgtaaaaggggttgagttcttgatttgattctttgcttggtcgctgtggtgtatagcagagctactgatttgtgtacattaatcttgtatctggaaactttgttgaattcttttatcagttcaaggagctttctggaggagtccttagggttttcaaagtaaatgatcatatcatcagcaaacagttgacagtttgactttccctttaccgatttggatgcactctatttctttctcttgtctgattactctggctagggcttccagtactatgttgaagaggagtggtgagagtgggcatccttgtcttgttccagttctcagagtgaatgctttcaacttttccccattcagtattatgttggctgtgggtttgtcatagatggcttttattacattaaggtatgttccttgtataccaattttgctgagagttttaatcataaagcgatgttgggttttgctgaatgctttttctgcatctattgagatgatcatgtgatttttgtttttaattctgtttatgtggtttgtcacattagtcgatttgcatatgttaaaccatccctgcatctgtggtgtgaaacccactagatcatggtggattatctttttaatatgttgtcggattcggttagctagtgttttgttaaggattttagcatctatattcatcaaggatatcggtctgtagttttctttttggttatgtcctttcctggttttagtattagggtgctgctggcttcatagaatgaattagggagggttctttctttctctatcttgtggaatagtgtcaaaatgattggtaccaattcttctttaaatgtctggtagaattctgctgtgaatccgtctggtcctggactttttttttgtcggtaatttttaaattaccatttcaatctcactgcttgttattggtctgttaagagtatctaatacttcctgatttaagctaggagggttgtattgttccaggaatttatccatctcttctaggttttctagtttatgtgtgtaaaggtgttcatagtagccttgaatgatcttctgtatttcagtggtgtcagttgtaatatcttctgtttcacttctaagtgaggttatttggattttctctcttcttttcttggttaatcttgctaatggtctatcaagtttatttatcttttcaaagaaccaactctttgtttcatttatcttttgaatttttttttgtttcaatttcatttagttctcctctgatcttggttattttctttctcctgctgggtttcggtttggtttgttcttgtttctctagttccttgaggtgtgaccttagattttctgtttgtgctctttcagactttttgatgtaggtgtttagggctatgaactttcctcttggcaccacctttgctgtatcccagaagttttgataggttgtgtcattattgtcattcagttcaaagaatttgttaatttccatcttgatttcgtttttgaccccatgctcattcaggagcaggttatttaatttccatgtatttgcatgtatttgaaggttccttttggagttgatttccagttttattccaccatggtctgagagagtacttgatataatttcaattttcttaaatgtattgaggcgcattttgtggcctatcacttggtcaatcttgaaacttccatgcactgttgaatagaatgcgtattctacagttgttggatgaaatgttctgtatgtatctgttaggtccatttgttccaaggtatagcttaaatccattgtttctttgttgactttctgtcttgatgacctgtctagtgctgtcagtggagtattgaagtcccccactattattgtgttgctgtctatctcatttcttaggtctattagtaatcattttataaatttgggacctccagtgttaggtgcatatacttttaggattgtgttattttcctgttggataaggccttttaccattatataatgtccctctctgtctcttttaactgccattgctttaaaatttcttttgtctgattctaagtatagctaccccctgctttaccccctgcttgcttttggtgtccatttgcatgaaatgccttttttcacccctttacttgaagtttatgtgggtccttatgtcttaggtgagtctcctgaaggcagcagacagctggtgacttcttatccattctgcgtttctgtatcttttaagtggagcatttaggccatttacattcaatgttagtattgaaatgtgaggtactgttgcattcatcatgctccttgttgcctgtgtacttttttttagttttttcttttcggtttttaacttgtattttcgttttataggtcctgtgtaatttatgctttaaagaggtgctgttttgatgtgtttccagaatttgtttcaagatttagatctccttttagcagttcttgtagtggtggcttggtaatggcgaattctctcagcatttgtttgtctgaaaaagactgtatctttccttcatatatgatgtgtactttcactggatacaaaattcttggctgataattgttttgtttgaggaggctgaagatagcgccccaatcccttctagcttgtagggtttctgctgagaaatctactgttaatctgatagatttgccttcataggttatctggtgcttctgtctcaccactcttaagattttttccttcatcctaactttggataacccaatgacaatgtgcctaggtgaggatctttttgtgatgaacttcctaggtgttctttgtgcttcttgtatatgcatgtctagatctctagcaaggccagggaagttttcctcggtcattcccccaaatatgttttccaagcttttagaattgtcttcttcctgaggaacactgattattcttaggttcagtcatttatcataatcccagacttcttggaggctttgttcgtattttcttatttttttttctttgtctttgttggattgagctaatttgaagaccttgtctttgagctctgaatttctttcttctacttgttcaattctattgctgagactttccagagcatttcacatttctaaaagtgtgtccaaagtttcctgaattttttattgttttttatttaagctatctatttccttgaatacttctcccttcacttcttgtatcattttttggatttcctttcattgggctttgcctttggtccttccctgattggcttaataactaaccttctgaattctttttcaggtaaatcaggtgcgtattattggtttggatccactgctggtgaactagtttgatatttgggggtgttgaagatccttgttttgtcacattaccagggttggttttctggttccttctcatttgggtaggctctgtcagagggaaggtctaagggctgaaggctattgttcagattcttttgtcccatggggtgctcccttgatgtagtactctcctctttttcctggggatgtggcttcctgtaagccaaactgcagtgattgttgtctctcttctggttctagtcacccagtgaatctacccagctccaggctggtactggggattgtctgcacagagtcctgtgatgtgaactgtctatgggtctctcacccgtggataccagcgcctgttctggtagaggtgatggagggtgcaatggactctgtgagggcccttagctttggtgatttaatgctctgtttttgtgctggttgacctcctgccagggggtggtgccttacagaaagcatcagctgtagagagggactggtagtgggctgggccctagaactcccaagattaaatgccctttgtcttccactaccagggtggatagagaaggaccatcaggtggggtgggactaggtgtgtctgagctcagactccttgggtgggtcttcctgtgactgctgtgggggatgggggtgagattcccaagtcactggagttatgtacctaggagtattatggctgcctctgctgagtcttgcaggtagtcagggaagtgggggaaagctggcagtcacaggcctcacctagctcccacgcaaactgaatggtcagtctcacccccactgtgcctcccccaacagccccaagtctgtttccagaggaagggcgagacggacttgaaaacttgcccgaggctttcctcctctcagctgctgaagaaaagggctttttagttcttcaccctgcctgtgaagtctgcttgcaggattggcgccctcccctgggttctggccaggaggcttctcaccccattcaaattgttacaaagtccagctaaagaattccttctccctatggagttttacaccctgctcctctggccaatctctcaatggatccctgtggtgtcaggcaagaatgggctgcttggggacccagcgagctctcaggacctttctgctgcttcctctacccctgtatttcacttggctcggctctctaacttgactcagctgcaggtaaagttggaaacttctcctggaaacagaccttcagcttttcctgtgggagtgtgtattcaggagaggagggtttccctttcctacttccacagttgaggcactcacagtatttggggtgtctcccgggtcctgcaggagcagtctccttccttcagagggtctgtgggtcctctcaggattgctggtttgttcttgcattcaatctggagctaaaattcacaatgctagcctctgcatgctgctctgtctggagctgcaatctagtcctgcctcccacccaccatgatccccacaagtaagtttcaagtagtgtccatgagttacaatcaagatgataactccatacacttcaagccaagacttctattaatcttttatatattaaaatacaaatcataatttagcaatgtttactgaacatatttctgcgaagaaatctcttactagtttctggatgaaaattatacttgattgtgtcctcccaaaacttggacctacccatgtttgttaaaataggaaaggagaaagtaagattttggtttaatcattctattatgtatgagtttgtaggaggtattagacattatctgtttcaagtacaataaaaagctctaaaataaatgtaagcatttcagttttagtttgctgaggaatatagcatgctatagtggagtaattactgcatcagagtcagaatccattgaacttctgtttttctgtctataaagtaaaaaatgggactaatagaatccctaaaattctaccacattgttggaaaacttgcatgtgctttgcaggtaagggatttaagaacgatatttgctgtaaaaaatgtgagatgagtattattttcccgcaggaataggatgaccggttgctaaatatcagtgggttatgttctctattcctagacttcccatttccttcataaactcttatcagtccatctttctgcaatcactcaagaggtctgtatgtgctttccaaatttcttctcttggcttcagaaattttatttgggttttgttccagcttatattttatttgtttatgtaaaacttgtctctactcctcttcctttttacttctttttgtgatttgctgctattttgtgtttcttgacagaggtaagtcatgtattgttcacctgtttatagctctatttctagccagctccttctgtctaaacgttcaggctcactttctctctctaaaactgactttaaaactaatattttcttttcagcttgcagttcagtatgtctgtaaagtttttgtgatactattttctcatggaccagagataaacaaatggtattacattataatgctctaatacaatcaactgttgcatgaatgaggtgtttttcaatgagtaacaatatttgtcaagcaggtataattccattctgactaatggaaagaattttgtgtccttcaattgatgaaagtgaagattttacagatcaaagttttaatttaaaaaataactactgaaaattgcaatgcctgcaagtgtttaaatatagcataggagcttctggagatacacatacacaaataatttttcttattatgtacagatattttgttcttcatggcttgttaaacaatgaaaatgaacattcggtaatgatatttaaattttgtttgatgggtgggtatgtttgtgagtgtgtgtatcgtgatggggagtgggtgagtgcacttgatttatttcctattttcttcttgtttctgctccttgcattttgctggaggaccctgaatgctttattttctcaaccatgtctactcccccagtgacaaagaacattgaggaactacatgaatagaaaaggcaagagctctaatgaggtctttaaaaaggactccattgggtggtcagagtagggtgtaatagttatttgatttaaaatgaagtccttaatggcgtctatcactaatacattctgaattgattatgggagtgtggaatgcttgcaaagaatggagaaaactgccaaatacagactgaatttgtttgaaaggcttttaaaagagggggcagaaacataagtaaatatgtgtatatgaaatatatagaaggaaatgggtaactgtgtgcatatgttactattttctaccatggtaggatttctgtatagaaacagcccaaggaatcatatctctaattttttacgttatatgccgaaagaaaggtgtaattaatggtgctaagaatccaagcagaatacccttatatttttcaaattgataccttctacctcatctcatttaatgctcacaataggcctgtgaagtagaggctcctgtgaagatagagatcctgagtctcagcacggttaagtagcaatctgccttggattacacaaccaatgagtggaagggctgaggataaaacatggcacataaccaagtgtccttgtctattttttgtaataaaattgtattattttattatgataatttagttaagaatcttgcatgtatgtaaacgtgtgaagaagaaaacaagttaaggcataatgtcatcacgcagcaatatcaactactaatgttttggtttatttcctttcagatgcatgcatgggtagacagaagacaagaattgaggttatcattgcaatcagagttttgcgccttgttttcctccttgtaatacaatatgagcttttcatcatgtcattagatagtcttcagaattataattttaagctcccaatgcctttctcctggttcatgccaccccttcttaaatgaattcatccatcattggtgacagtccaaaatggaaagatgacacatgccagcgatctaagagccttctaatactcatgatcatattgtcatggggaggtgtcactttagtgagttttgttttgtttttattttttgttctgtttcatgtttttcacagacggatggagagaaaggcctctaagctgttaggttttaaagcagaccctgcttccattcttaatcctagacttgtcatgattttctctctgtgatttatctataaagtaggagtgcccctcactggtgagggaaggattcaatgaagattcaggatcccttaatatgtaggactttggctgaggaaataaaggataggctaggatttttcaagttgtctctaccatggcacagggaatagtgagtcttgtgcctggctcccgagttaggtggatgtgttggtggattattgctcttgtaaatatccttctgtatatatcctttggtaaattaacaggtggtcagcactcctaggtttccatgttcctttaattctcattgccatataactcagagccagtcatttcctcaatgtggtttcatctctaaaatgaagatgttggattagctgatctccttattcctacaagttctaaaattgttgtacatctattgtatgctgttcagtaaatggatgaccagacatgagccctctaatgcagctccacaggcagtgatggggaagtagaaaacattttctaatttccattaaccccttcccccatctactctatctccggaattatatttttagaagccaagtgcttcttgactttttgcaaaacaatattttgatgacttaatttaatataggtcagcaacatatggactctattttacttgaaatgtccactggtttaaaaatgaaacaaagattttggcaaatgtttttaaaagtatcttgaaacttaacccaggttttccgtgcctatgcctttatatgaatgtgattattgttcttgtctctttaaatactgaagcctgcagtgcctattacaattacatgtccactaaagaacaagtaggcatcagctgacaatcatactgcatttttattattattattattgttattatttttagacagagtctgactctgtcgccaacgctggggtgtagtggtgcgatctcggttcactgcaacctctgcctcctgcgttcaagcaattctcccacctcagcctcccgagtagctgggactacaggtgcctgccaccacgcccggctaatttatgtatttttagtagagacagggttttgccatgttggccaggctggtcttgaactcctgacctcaagtgatccacccgcctcagccttcctaagtgctgggattacagttgtgagccaccgcgcccagcccgtagtgcattattgaaagggaaaaacgcctgcataagcaagcacagtgtagcttataaattaaaaaatagtagccaaagcaaaaagaagaaatatcagttgaaacagctactttattagtaatgtgtgatagtgctataggcagacaaatagcaatagtcttctacttacatatattcttaattaatcttgaaaccctgacaggcttttcactgaaaattccattttgctcctttggatatcagaccctgtttgtaagatgctatttagttttctcctagctacagcctaaccttttctctctcaagccttttaaaaatgaatatttcatagcataatttgccttcctttgtaactagagtgttttggaaagctacaaataagaaaacacaggttgcaaagccaggcagaatccctcctcttacttctattgtatcaatcagaatgttggtttttctaaagggatcaaagccatttatctgttggagcacattaaacccctgcctaaaggatttaggctactgttttctcttccagaaaggaattaccacaaccatacaagtcagcatagtaagaagctaagaacattttgtcaattctcccattcattcattcattcactcattctacgtttcctgcaacttcctatcctgggcaggagacagataagtaaataagcagtgatgataccaagctttctaatagagggatgatgcaaggaggggcttactgccatcaggcaagttttctctagtcaattcctttctggcagactgagggccaattcactggtagagactagttgggattgacataccaatgaggtagaaacagattgtaccaaagcatggaaatgcaaaatgatctggcccactttggaaagaaattcagcatgtgtagtcattgacatagtggcagagaggtagatggactggggacggggttcctagatacagagaagcattagatatttgattatttctttaagaaaaatacaaataattttcaatgaccccatgatttctacatgaagctctcctgactcacacacccagagacatttatatcaataaaggttattgttggcagtaaccaagactcctcatgaactcctattcacccttcaagacctagcttaaatagcacttttgtaaggaagcttcccttgatcctgacttcatgtcccctctcagagcactgctcaaacatcatcttttgcgctaggctgacttgcctatattgctcaccattgtatctcaaagttcaacatggtgcctggcccctagaaggagcttgacaaataatttttgaatgaacaaaagaatatatattatgcccattaaaactctatgaaggatacaggtacaaccttgagcactcacgcaaaaaaaaatattgtagctaaaagagtaaatggaagtaacacaatttgaatctttattataagacatttaacttaaaagcaccaagttgaaagtttttggtttttgattcgtctttcaaagcccagagtcactttccaaataatctgcctgggactgttttgttgtttacacatctctttattttttttcctgctgttattttcattaacaacaaatattttaatatcatactaaactgagctacattagatcaactcgaaatcttttagactctcaaaagctgggcattacatattcaaaacaggacctaatgtttcagagcttcatattctactataattatatggttcaatgcaagtgattatatctcttcttcagtaacgggctgaaaagttttggtttgctggttccctcataatttactgcctaggtataataggccagtcttgcggaaaaaaagatgataaatgatgctggctaggaatcatagatttattaaatttctatcaaacagtgcaacaaaaaaaaatctgcttaagttagaaatgggctcaaattttttaatcaaaattcatgagtcctgatgcttggttcagtaggtccaaggaaggtttgaattgaagactgattaaagaaaataaaaggcttatttgaagtaatttttcaatgacggcttttaattggatgttaaatcaaattcttatctgcctttctgcagatagcacattatataaaatacagttagcggcactaccactgtaacggatacactgaataacaattgacttctcactttacactgagagggtagaagggctgtgtttgtcagcctgtcagaaattaagtatgtaaattaatgcttaagtgtatgaatatgaatatgatttacaagaggcttggagtattgttggggaaaatactgaggtttttctttccccttcaaggttaacaagtactcagtgacctttacagacagcgtgcagccatgagtgtgttagtgtgtgtacccacgtgtgcattttgccagtgagcttgggctgggagcttaaatactcccgaagagcaaataccggactcattctctaatgtccctttctgccatccatgagtgtcagcccataaaagcaatttcattagcatttcctcattttccaatataagcagtcagtgtggtactaataatgggtccttatccatcctttgcagaggatgggtattgtgccctgtggagggaagatgggctaccttgactggggggctcagagagcaccctggccagcatatgtaagcacttgagaccctatttgggaaaaatggttggcattcctgaaaaagtgcttaaccttttgcaggccatagtggggacggggatggaacagattcatctttcacagctgactgagatgaggttggtttgcaagagttaatggaacttttgttaagtactgaattaactcccaggatagcgtctgcagattgagggaatggagtttgcatagaatggttttctcacatacatttttaatggtagatctttagtagacagctcattaatttcatgattcattaccatgaataatatcctttaggcttgggaaaattttctcccatttttattctaatttttggaggaactgtaaaagctgtgcttcacagaatttaaaaaggggaaaccccagtacatagtttagttacaaatacatattagtttctctgttgccctaaacagaatagcttctatgttggctttccatgtttgaatacacacaatatcatcattttgctgattgagaattattatttaaactagtgaaatttacgttgccttcctaaatagtcttttttttttttttttaagtttagaaacagagtctagctccatcacccaggctggagtgcaatgacgtgatcatagctcactatagcatcggactcccgggctcaacagatcctcccacttcagccttccaagtagctgggacttcaggtgcatgccagcattcccagcttgtctgttccattgcatattttctttaccacttttagagtaaagttattttaattgacaaattctaaattgcattaataataataatacctacatctgctatatattgagtgcctcatttggatcaggctggttacttgatattgatggttaacagcagcttgtggtgagtcctgtagcgcctgaggaatattccaaggccatatggtcagaagtggcccagcaggcattgcagccccacttggattgaccccagaccctacgtgctgcaccataatgtagcatgcttctctccgtcaaatcttcacagcacttgcaaggtagttggcattaagcatcttttacagatgatgaaactgaggctcaggaatggtaagtaatccagaacacaattaagacattggtgagacatttgagcaaaaagtatttccatttctacccttcacccactgcctcctcctcaccttacaccgtgagcactttctccaccatgatgctgagggcctgcaccctttatttatttatttatttatttatttatttatttttaagacagagtttcactcttgttgcccaggctggagtgcaatggtgaagtctcggctcactgcaacctccgttccccgggttcaagtgattctcctgcctcagcctcccgagtagctgggattacaggtgcccgccatcacacctgactaatttttttgtatttttagtagagacggcatttcaccatgttggccaggctggtctcgaactcctgacctcaggtgatttgcctgcctcggcctcccaaagtgcttggattacaggcggagccactgcgcccagccgcctgcacccttaacatttattcagagactcctatgcagtcgtcttttctgggacctcatctttgttggttttattttctggggggaatagcatttgacattttcccatccttcttttgaagactcttgacattgtattttcttggctctcatcccgcctgtctgtctgtgatttgctgtttttcccttccatccctcagcatgaggtatcatttcagtactttaactttgagccttttcagtaatcagatgtagtcattctcttatccagtcatttcttactgtgccatctctcccagactgctgtctcacacttctagccatgctctacttgtgtcagatttggatttaaatctggatcctatgcaaccctggaaaagtcaatgaacatttctatgtctcttcatttgtaaactgggaataataatagtttttcatagtgttaaatgaagtgtaatatttatagggttaaatagttcttgcaaagattaaaaaaatgagatggtgaaactggagaactgagtacagtggcttgcacataataagcagtcagcaaatggtaactcttgttcttgttactagcatccacttttgggtcacatggcacaacttgccttgcattgtcattcttaatgaccatatcttgtctccgtgagagaccatgagcaacttgaagctgtagatatccatatatcattctgcctcaatcaaaaggtatattcttgtcttctcttttgataacaagcatttagagtggtttattttcattctgtgagctgagtataacaatttatacttatttccaaattctccagtgtttgctgactataattgaaaccacataaagatactctgtttaaatcccataagtaataattctgtgctaacaacatttttgaatatttcaaggaaatagccagtttctccagagaattgctagtatcaccaacatttttggtgaagtttctgtcttagtttgtttacttttgtagccagtttgaaatgctagatgtggactgctgtggacagggtaaaaaccaacaacaaagttctctagctagttcattaccttcattatgatgtatgtgagagctagattattccctctatgcaatagttgtgttttctaaattagggagttgctttgggaatgaggggcctgtggtacttctagagcattcaggatttccagatttgtaaacagttatgcacaatcttatgatgccctactcaccatgacagagaacatatggccagactggcctttctgtaggagaaagcacattacaggataagagtgtgctaagcaacctctagtagacagggcttgttctctggagaaatctgcctattgtgattgtgtgggcatgtcagtggacatgaggagtttctgattagaaagcccatcttgtcctgggtagccaaatagcaggtgcttaaaaaatggtggtattgacagccatcaccatttcttaactaggcctcatggattctgcctagttaatttgcctgctttctctgacatgatttatttgttcactctccgtgcatgttgcttatttcaactggggttgctgtaacaaagtaccgtaaactagaaggcttataaacattaggaatttatttctcacagttccagaggctgagaagtcccagatcacagtgccagcagatttgatgtctagtgatgtcctcttacattcttagtatcttcttgcggcaatcctcatgtggcagaaaatgcagaaaagcaaggcagctctctgaagcctcttttatcggggtaccaatcccattcatgaaggaggagccctcatgacctaatcacctcccaagggcaacatcttctaataccatagtattgagggtgaggatttcaacatatgaatttgggggaatgtaaacattcagactatagtacatgtactattcccactgccaggaataccatcctattttccctgctaataatcgactctacctttgacaacagagcaaacaagttataatatgaactttgttagtcattgtcttttatctgctgctgggcttttcacctacctttgtatccagtacttaccaggatgtcctgaacccaggatgagctctcttaatgtctgcagaaggaaggaagacaagggaggagaagtgggcaatttagtcaaaccactggggaatcaaacaacttgttaataatcccaactatggagtttgtccatctagtcctagccctgaatagcatcccaattttttaaaaaatgaatttcaagtgagagaatgtcatgttcacattagtattgaatgagccacagcacgtccctgatttatttatgttgtgtgaaaatttaagtagtgatgtaagaacatatcactttggggacatttgctgttttttaatttaacctttgtggcagcagaaaccatctcctcaatgaagacccctaatgaaagctggcagaaattcgtgtttttattttaacttcatggaagaaaaatagtatgttacttacataatgtttctaattatagctttttcgttatactattttaattgtcttcttaaatgcaatatttgacatgctgccaggaacttctcaatgatttcttcattgagcaaagggttcttagacatcagctacgtttcttaaaactgtacactttcgcaacattaaaactcaatcttttctcccagagtcatgttgcatcttatattcctcccttcccaggacacatcatgcccctttgcataaatatggagggtgaggtagggagaacttgagcagccatttgtaaggctcacttctttttaagctttaagaccttggggatgttgtgatgatatagctgtttgtctgtgggggaggaaataggattaaatgaaatgaaaccataccagaatcactcaactccacatttttatagtatgcataatctgctttttttctggaagtcatgaaagatgttctttatttcttgttttacaaaaatagctgcctctgggtatcgataatactagtttaaattcttcaaaagaatccatgaattgtaactgctctgatagttctgcagctattttttaatttgtatttttgctgagaaaattataagctgtggagtaaattttaagtgcaattatatacccctggaggaaactcttgaggcagtatcataaatggacttatgaggcaacctcctgataatatgggacagctgattccataacatatgcatctggtcttacatgctttggcacattttcatttatctcattaaatccattctgacacatttttcatgtaatagcttttctgataacttcggtttgtaaaacattaatattgaatcttttgggggaagacagtgatgtctctgttttaatctcctgtagctatgatgtgtatcctgcactttaccgagtggcagaaggcacagcttgtcactgttaattgtgactgggatatgttgttgatgctaagactctatccaatgtcctgaactgaaaagttttccgtagaccactgacaaaaataggccatggagtctgtgttccttcagtttagttctacattccatgaaagccactactacctggcctgttgcttagcctttcagacatctctcccattccttctgaatacataattggctctcaatcttactacgtatgtctagctaaggggtgcagaatacaaactccagagcctcccaatatttaggcaaattcttttgcacttgagggagcaaggcggtaagtgggggtttgatcaagagcttcccatccaatcaatcatggctatgatcaaaagtagaccacaaaagaggaaggcataatgataagattccaaatcactgaacctactaaaactattttccaaatcctattagaagagcactaacatacaaaacacattgattatacaatagatgccattatgccacatacaatatgcaataaacacaagtaaccatgctatgtaacactttttatctctactaatctaataagcaagctctaacaagcattaattcaacagtaagtaccaataattgtgttaggcttcttagaatcctaagaaactttggaggattgatttggttttccatgtatttttaaagtctttttttttttctctgggaaacaggagctgataactgttttcttcccgtcaatacatttccctgtagcaaagaccatcaggaaggcatgaagagggcaggaaatttatttgctttgaggatccagaagctatctatgggcttcttctagggatccaaacatctgacctttcttaatctcaactaatggaacgagtcacctttcacctcttcttcctgtgtggcccctcccactattccttttccctacaccaggaggatagagtcctgttacagaatccattcaatgtttggatgttgattatacattgttgaaggaacaattaaccattgttacaaggggatgtataaagtgctgaaaagtggtgacttgtgattagaggtgttccccttctttcttgttgagagactgttcaattcaactgtactattaatgaacacaagaggaataatacacgtaacccctgccctccggaagctcataatctattatgaagactaagataaatatacaaaggattacaatgaaataaataacaggactctttcttataacatctttaaggattctgaataagttgaatgaaggcatcaacatgctgattgagttcatgcactcatagatgggcttttcatgttgattgtagtggtgattacgttttgtaactgtcctagcgagtgtaggagtcaaagagatagattaatatttgaaacttcctgattgcttttcatcttggcatcaggttatcattttacttgcacttataccagaaactcccatgttcaaacacttccttccatattatgtatttagccttatcttgattatgactgaagctgcgtttgtcacttttgttttcaaatcatcgtgacgctgagacagttcaatgctttgtctgtgcttaattatgatattgagttacagaaaaacgtttcccttttttttccaatttgccttaatcagggccttaagtctgacctagctctgagtcatgttgtatttgctcctcagcgaaatagcaaagcagtccctgttcaggttacactaaatcacaaagtgatgcgggggcgacaggttctgcagcaagttagaatcacatgctgttaggtttttgcctgtatggatcaaattctaacagaaaaataagaaaaggtggaggtcactgcatatgtccagatactctgaagtgaaatgacagcattagagtgacagtatcttattcttcagacaaaggaattatacagaatttctaattagaaaatcaaaaatactcaaacattatttaaattatcatacggtaaaatatccagtgattatctgttatctatctatctatctatccatctatctatctatctatccattcatccatctttctgcttctgtttactgagccatcatatgagatgtttcataaattttgcttggaacacccaaatatcttccctgaaacaaatatgctgttggtcatctgagccctttgctccttcaaggaaaattagtggggcagaacaactgaagttgaaacactggctagttttaatgtttataattagagattgtttacaagcttgatggactggacctgagccaggaaactattaaaagaggctgggcccacatcattgtggagcaatgtaggataggggattcatataaaataggctttagaatataacagcctgcattcacattcaggaactgtctctttctagctgtaaggaagatatttaactgccctgagtctcacttccattatctgcaaaatgggaacaataatagtgcctaccttagagggttctttaggatcacatgaaataaaccatgtgaagtgcttagcacaaaaattggctatgctgtatatgtgctaacatttatatagagctggcttggtgtaagaatggcactggctaagattggtgggaggtaagaacagttagcaaattaatacagtgagcttctctccttgtgctgtgtaccttgaactgggaatgatctcatatgaaagacttaactgtgctttccattttgctggtgaattatgagaattctgaactttatgattttggaatgtgaacatttcatttgatagtggtgatttgtgtcctttataatctgcaaataatcaacctatttatttgaaattaaaaagaagacaattcaagaattgacttatttccctctgacatctcagtagtagtacatttgaatcttcattcattcaccatgtctaactcacataaaaacctgcccaagcatgatgaatgaaggtatagttttgaattttaaaaataaaatatatgaaacagatgtttgcagcaagcttcctcactttctggatgattagatatacatggtgctgactgaatattttgtgggctcatctggcagcttaagcacaaagtgcatgcttgcaagttagcaactagaatataagaagttgagacacataaatgtagtaagtgaataaaagtagaacttttgatttctcaagtcattacatttgacctgttgacccctggtcagggtgggagttcataaatgacagagaacaacaacataacatgagcacatggagtccaaaaaaagggtcaggtggggaacataatatgaggagggtgaattttaaaatcatattcaatttaaattcattctgatatatttagaaaatgttcagttctgtaataatcttacctcaaggtataacatagtactggccgccatggccaggattgtattaaagttccatttggtatagaccaggagcttacaaattacaaatgcttgtttttacaaataaagtactgtcagcacacaaatatacccattcatttacatattgtccatagttgcttttgcactgcaagggtagagttgaatagttgtgacagagaccatatagcccacaaagctgaaaatgtagtatttggtctttcgcgggaaagtttgctgactgcgattttagaggaacaagaaaaaagttatcagatacatatatgcctatatgtgtgtctatgtatatgtgtgtactgtatgtgtgtgtatacccatatatataaaaatacaatttaaagcaccgtatatacatattaattagaaaattataaagagtactataccatgctactagcatggtagttggctctcagtaggtgcccagtgaatgagagttattagaattaaaaatagtctgcataaaaaataacctagattagatctttaaaaagtgttttggatcagcaaggactattttataaagaaagtgaggagcaggaagacttgttcatttctggtaaaatgagaactaaccccaatctttactcttctttgccaaaattgagcacaatcattgacttaataagacttaaaaatcctcaaaccattttaaaaatctatctttcactcttatttttgttcttatgctttataattattcaaaaaggttaaactctcatgcatctctctgctttataagctgggaagagaaccagcaatatcaaaaaacaaaagttcgttctcataacaactgtaattttgtcaaaacatgcaatgtcctaaatgctaccacggagctcattcggagtaaattcatatatttagatgaagtcaggtgacattgataactatctgagtaatccattttccatttggcctgctgttattaaaaagtacatatttgcattatttagcatgatcctatgtagggcaaagcctcacactgagcaatctggttgattcctgtgtattgtatttgagcaaaagaccatgtaagtaggggcagaatgcaagaagcagagtatgaagctcttgagagtaatgtatagaacaattttctgaggccaaatgttagcttggaaaatttgagagaagaactgtcaacgtaaatgtcaggttatttgaaacaacatgattcttaagacacagaaacacgtttctcaaatattggatagctgtttttgtgattttgcttgtttagttttaaggttggccctttggcagacatttcctgtaacttttttaaaataaaagtgatagaagttgattgtggaacattgggaaactgcagaaatgaataaaaactagaatgaaaatcacccataatttcatgaataagcaataaccactgtagatagctcggtgatatctatgtctctatctggttatttatctccccaaaacagaatcataatgagtatgtggttttctgtcatgcctttttgagcattttcacttatcattaatttttaaaacttgaaggaagaccttctataaatattatagaacgtgattacatttttgatttaacatttccccttttgttgaacatttagacatttccattctttggtattgtaaatagagctgcaataaacagcattttgcatgaatcatttcatgcatatttagcttttctcccttaggataaaatcctagaagtggaatgattggatcagagagtatgaacatttttaagtctattgatacatatttcccaactgtcctgagattcccaactgagctgggattataggggtccgccacaatgcccgactaatttttgtatttttagtagagactgggtttcgccatgttggccaggctggtcttgaactcctgacctcaggtgatccacccaccccagcctcccaaaccgctgggattacaggcatgagccactgcacccagccaagaatatgttttaaggagtaccaacaacagtcctgaattttcgatgctaaactcggcagtcctgggcagatgagaacagttggtcattctattttgctttgtgtcgcctagacataggacttaaatcccggaaatgtcacgactttgggtttggaatttgagagaatctttacagaaagctgcatttctgtgggaaagtcactcgtttagttcacatgatcctagaaaatatgtacacaattataaaccattctactttctcttaggtttttgtactagacttaactatgtgcatgacattcagggttctgatttcttttgaattatgaaataaacatgtttatacccaaacaagaaagaatgaagagttgtatttcccaagaaatattgtagaatgagttcaaggattattactgagataagaaaggttgaatgcagtgtgacaatgaaggcccagtgaattcagagaagcaaaatggttctgaaagtgacattttctcacatagtcctctctgctgacattattgtaaccactgaatgcacagtgcaagcatggtgttgattttaaatcacagtcagagaaattggggctggacacatttttcattatgttttgaggatagaaggatcattatgttatcctaggaatagttttgttaatggaaatgcctctgattctccctagatctatcataaatagattaaaatagcttcagcagcatttatcctgtgcttcatttcacttccacgatgtactgtgattatgacaatgcctgaactgtgtctgagaattgtaagttacattcagcctggaataagaaattattgtcccaccaagtaaatccagtaatgccatcaactttttaggcacattgtgaaagcaattgtgaattaatacttgctttgagccacagtagacagagtagagagtggacaattcacctgaaagagctttttcacttttctaacaaatgcatctgcccaaaagccattttgactcttttcataatattaatgttttaaaattaaaaataaaacattgaaactaagtcatttgtgattttctttgttccaatttaccatagttggaattttcatcagattggaaaaataattcacgcccaaggtaacagttactatgccaggtttaataaccaagctttgaacccacccaaatcaggatttagaatggaaacagtgacacacctcctgaaagctttaagcagcattgaatggagctgcttaaaaagccagactggagttttctatgggccttcttaaaaagaactccaatccctgcctggttacagaaagcagtatacaagacaaataagaaatactacctttctttcttcttttctgacagaattcacaaaaatttcctcaagctttcaacagtgtctctgtcagtggctcctcaggaagaaggatggccttcaggcatcatcaaatattcacagggaaggaggtttttaagaattgtagtgccaattgcatgctcacagctggactgactcaatgggttatgagacaatggaagggcaagtttttagtgatattgaggagaagcaaaatcagtgaaaataaattggaaatttccgttgtgtaaaacagtgaagtatgctgaggtatagaagtgcatgcctagagtttgtattgttcatctatttgaacaagtgccttaagtgaggcattgttggatagtttgtcaatataataaatagtatacacagcttttattaaaacatgaagtcatgtccttagaatataactaggtaagattttaacatattcctgtgttaagctgacattcaatgccaagtctaaaaatattgaacataaacacctctatttgccaatagatttaagtgcaactcttctgcattgggctctttccatgttacctcatctatttatgtggccctagaaagaatgtgtgaagaaagcagtcttacatttaagaacactattcctatgtattctgacctcagtttccttatatgtaaaatgaactttatatctctactatttaatgaatttgttgtgacaatcaagggttatgatcaagggtaacattgatcctgtgtttcactttacttcctcaatgtacaaaaatatagctggacgaaagtatgggtaggtatagctttgaccagaatggaaatatctggctatttggaaacattgagagatttttctttctttttttattgttttaaactactatttagaactattatgtaacattttacagatagaatagttggggggaaaagtcactgtacttgtcgcttaggcctgtgggtgtatatggggaggtcatttacaaacaattactaaagaggtagatgattttgatggcatatcactcaactgtcctccagttttttttgtttttttttttttttcataaaaacttggcccattattttgccaattgaaaacattcgcaatccagtctaccttgattttctgggtcaactccccatggctgattagctctttagactgcaaactcattcatttgtttattcaacgaatgtttacagagtcctgactctatgtcaggcatgatatcaggtgctggtactacagcagtgaacacaacagacaccttctgtatcctcatggaatgtaagctgtgtgtcttttctgttgtggctgcccaaatgcctagcatagtgcctgttgcatagtagatcttagtgagagtgagatttgctgatgggtgacagatgatagagtgaatcagtatattattaaaaaagtgagctacaatagttccctgcaagtgtagactttgtaagctccaaacactattctctgccaataatgaacctcactatatatatgtgcatgtatatgtgtgtgtgtatgtgtgtatatagatatagatatagatatagatatagatatagatatagatatagatatagatagatatatattttaggagaactgttgattatttttacgtttttaaaatttcaataggttttgggggaacaagtggtgtttggttacatgaataaattttttagtggtgatttctgtgattttggtgcacccatcaccgagcagtgtacactgtacccaatgtgtagtcttttatccctcaccctctcctaccctttcccctgagtccccagagttcattgtatcattcttatgcctttgcatcctcgtagcttagctcccacttataagagagaacatacgatgcttagttttccattcctgagttacttcacttagaataatggtctccaattccatccaggtagctgcgaatgccattattttgttcctttttatggctgagtagtattctatggtatatatatatacacatgcacacatatatatgcttagtgatatatatatattatgtgtgtacatatgtatatgtgtgtgtgtgtgtgtgtgtgtgtgtgtatataacattttcattatgcattcattgattcatggccatttgagctggttccatatttttgcaattccaaatgatgctgcttaagctagatctgccatgcatataacatctcattgtgaagatccaggaaagcaagttccctcagatcgctgaggatagttgactgattctcatttcgtgtaccccatgcatcttataacttctcaggagcccctctgtgctctggctgctagggaactgactgctctttgtgacccacttggactaaatatccaggctctctaagaaagtacttgtgctacttaatcttggcctgatctcaccatccatatttcttacagttttaaacattattgtattgtgtttatatccacaaactgcctgacatctattttgtgacagaacaggattgaacatgtaaaatataaaaatgcatgtggcacgaggtcactgatcttacagcccaggctgacgacactttttctgaatagctaacttctagaactctgtgtttgctttgctgaattactgtatattttaaaataaatataccatgtcccttctcaaaacaacaaatattgatttcaaaaatctttttttagttttgagaatctcaatgcattttataggttaaaggtatctagacttgaccatacttttctgctaaaatttatccagcagtacttgacattgtgttgagcactgataaagtatttagtgaatttaattatactccatattttacttcctgggcttttccacgggagtacaaatcaaaatcaaaatcttagtctctgagatatgtgtagaacatgttaatcgagtattaaccctcaggttggctttcatctctgcatcctagaaccagtattagttttgggatgctatattccaaacactttctactttgaaggaatgggaagagattgctgcaggggtaatttcttatcttccacctgatttttttttttttagagagaagtaggtgatatggcatggtgactctagttattaacaatgtgttgtatacttgaaaattgctaagagacattgtaagtgttctcaccacaaataactaatacgtatgtgagataatacgaaaaaatgaaagaaagaatagaaaggtaggtggaacataaaagaacaacagccaacattgaggaatatagaaatccacctgattatttttatgaagtggcacagtagaaaattagtaagataaattgaggatgaatgcaaggatgctccagttctggacctccagaaggacagctttgaatctcaactgatttttatttctaccactgtttctatattggtgccagtcggaagcatagcatgcaaggtgtcacccaataaatgaatttggccagggaataaactaacaacgataacgttttcctggaagctaagggagtaattagagcaatgacttttagagacttcatttcagaaaagttcatgctttaatattcaaataattacattaatctgtagattagtcagctgaaatattaaattttttggcacaagcttaatgaaaattgtcataatggtgccaaaaagaaatcttatggctgccttttaaataccaaagaaattctccattgttgtgataaaatacagatgtggcatagaaagaacttgcatggtgagcagaaatagaatatataattagaacaaagagggcttaaatcaaattaatcttcatctgacaggaacagttacatttacatcattgagtgcaaagtcatagccaaaattgaaattagaaacagataattatgataagagaggacacttatgctgacttttctcatgcataattggagagcatacaaaatgcaatgctggttctaattagaattagcattaaaagatgccagttttgatgaattctgggttttgccataaaataagttgtctaaataattgaactatggacatgcaaatttgtttgcctgtttgttgtttgttcaagatacaactttaatagtatcagtgatatgaatgctgttaatttcttttgtcaatgtcatattgtaattttgttggctttgttttatttctatttttcttgagaatctgatttaattcttaaaagtccatcattcatttctgtctgcaaagtctcttttcgtacgtgtacttacatatacacatgccttataaaaatacagagtttaattgttcacttggcatgtatgaaaagagtgtgtatgacagtttcagaaatgcagatgtctaaagactctgtgatacaatcctgcttttttcaccttggagttcaaatgtgctatttctgaatggttgtactcaaagggaaaatgcgcatcccattgacaaattctttttgaaatatttcttcccgaattatttactagaatcaaccccttgactgggggacttttccaacaatcctagcagttgagaaaagcaggggcaggtgttggccatcatcttggggcttcattaattcatggtaggtgcttcacaactctgtagtctttgcttttctttcattgttgtcatttttaaaaacttttatttatagagatgggctttcgctatagagttgttgcccaggctggccaacaactcctgggcccgagcgatcctcacgcctcgacctcccaaagtgctgggattacaggcatgagccaccatgcccggccaatcttagcttttctttacctcttgttctgttactcttttcttattttcttttttcttcttcccttttccttctccaaggtgaagcttccagtctcttcagtagtagtagtgggtttggctgtttaactaaatctccaggggctcttgggagcaatttcattcttttccattaaattcattctgtcatacaatgatgcatattattgtagattgtgaaactcctaatttcatttttcttggaactgcatgagtttctgtcaggagaagtggacccagaccaaccaatgaaaatgcatttcaaagctccttaattcttgattttggataaagagtttttctctgcataaacaaaatagatcttagttgtatagcatacagcgtttctggctagggtaacattgaatgcctttccacctagggctctttaaaaccctgtgaaggattagattaaaaccttgtgaaggttgtagatttccttcctaagaaagtctttatttatttatttatttatttttattttatttattgttattatactttaagttttagggtacatgtgcacaatgtgcaggttagttacatatgtatacatgtgccatgctggtgtgctgcactcactaactcgtcatctagcattaggtatatctcccaatgctatccctcccccctccccccaccccacaacagtccccagagtgtgatgttccccttcctgtgtccatgtgttctcattgttcaattcccacctatgagtgagaagatgtggtgtttggttttttgttcttgagatagtttactgagaatgatgatttccaatttcatccatgtctctacaaaggacatgaactcatcattttttatggctgcgtagtattccatggtatatatgtgccacattttcttaattcagtctatcattgtttgacatttgggttggttccaagtctttgctattgtgaatagtgccgccataaacatatgtgtgcatgtgtctttatagcagcatgatttatagtcctttgggtatatacccagtaatggaatggctgggtcaaatggtatttctagttctagatccctgaggaatcgccacactgacttccacaatggttgaactagtttacagtcccaccaacaatgtaaaagtgttcctatttctccacatcgtctccagcacctgttgtttcctgactttttaatgatcgccattctaactggtgtgagatggtatctcatagtggttttgatttgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgtagattctggttattagccctttgtcagatgagtaggttgcaaaaattttctcccattttgtaggttgcctgttcactctgatggtagtttcttttgctgtgcagaagctctttagtttaattagatcccatttgaacgtctttataagcaaggaggattctgatccatcaaggattatttagagtgatgctgcctgaggtttctccaattctatgaccctgatcattgtcagatttcttgttgatttagtgttctctcaaaatttcccagtactcagaagtgccaaaagaaacatcaaagtgtggattctctcttgaatcttggttgtagtatctttccttagctttcacatttttctttgaattgtatttttatttgtttggttcattttggtctaagggctggggtaaagggcaaaggagaaagtcatttcattttagggaccacagtagaatgatacttgaaatgccattttaatataacttctcagataactgttttgtacaggtaaaacagttgttgccaggatgaattatataaatgattcatttattgtatattatgttaaataaaagtaacatggaagagggaaaggattttaaacatccaaataaaaataataatttatcataagaagctccagtttttattgttaatgtggttggatgatgtatgttaaataattgttgattaaaaggtagttgtaaaagctaaacattaataacttaaataacaggattttagttgagaagatgatgtcatggaagagagtgtgattgtgatgcaacaagtggcatcaatgtgaccatgtcaggaagatttttgtttctaaaacgcaaacaaagcatttcaaatgatagactcaaaagagcactttcaattgagatatttagtcatataggctgatttgcttcaacctgaatgcaaagtttctcagggaatttgcccctgaaagccactagcaacctaaagctcagtcttaagacagaaaggcatcctaaaccctgtgatttcataatatccttgtaaccacatgctgaaaaactaatttgctaagaacttaaaagggttgacaaacaaattacagccatcttgatagggggtgattattggcattaccaactcagttgggtattcttaatgaaataagacagctttattttcacaacttgccttgaaatgtaggtgaaggatatttaatgcttttaaattagcaatattatgtagttacatagcacttcacatttgcacatattattgaagtcaactctatttctttttccttcaaagacttctgggaagtacgtcaggataaccaggcccattgtatggaaggcataattgtaacatgtgctctatctgatgagccttgcctatgtaatctgaactcttacatactatggccatccgccctgggaggctgactggtgcctactgccgccttatgcctcctccatgctgtcacttctgcttggaatacttgactgtttccacttacttcctctgcctggtgaacttttattcatcctacgagagactgatcaaatttgtctctcttctgaagtttgttctgccccttttcagcccttttctgaacccctcaatcaccctcacccccaaatccagcagttagtccttccctttcctagttcaaactccctctgttctgttcttatggctactatggcatctatcacgctgtaatatagtgatctcgtcacatatgcttcctgcacttggctggcctgggacatgtgtccaggttacctgcaaatgtctcctctcctgaagaagaaaactaagagtccttaattaaatgcagttcacacctccttgacgtcacttccaggccttcagacgtgaagcctgctgttaactactcctgctgttcttgctgacaattttatggaggatctttaagggctttcacactgggccaaaaatgtgtgcatatgcatacacacacacacacacacccataaacacacatatttgcaagttaatgtgatctgcaagacctttcagtttgagaagaataatagctttggctatagagaagctattcccatagctatcacatagagaataaattaaaattaccttctaaggcacagattagggagggaaaacagcattttgggatcattcaccaaaaggtctttgctgtggcagaaagttatgaggacatgtttttgttcattgtttttctcatttgttgtacaactggccattaaattgcaggtggttcctcccagccgacagtcccatctgtgtcctggatggtggcaagtttgtgatggttcaagatcaagttcaagattcagatcaagaatcagatcttgccaaaatgtcacttcttttttatttcaacttttctcatttaattcctttgaagtagatgttattctttctcatttaaaggtgacaaaattgagactttgaagggacaaggagcttgacatgtgtacagctagagttttatgcccattggactgagccttgaaactgtgcaacctctcatttctttccacagaatggagcagggaccctgcttgaagaaaacttggtagatgaaaaatgatattataagacaagtacattagaatttttatttttaaaaggcttactatagaagtctttacaatttggacttgctttgtggaaggcaagatgtgccttccttctgaagaggttccattgaatacattgggtaaaaggcagctatagtgtcatgaaggctgccagcaggcatggagtgtgagtggttttcatgagtgtgagtggttttcatgaatagcaagaatacaaacctgtaacagaagaaactaaggtaacagggtaacaggcagcagggacaatgatgtatttttgttccctatcgataaactgttgaacacttttacaatacactgttctttatgttcctcagaatgtgtcactgggaagctcagttagaaatgtagagccatttcttagtacataatggactaagacctcagtcttgcccctccatcctcaacttggctcctgtttcgctctggggtctttagtttcaatgagaatccagaacagacgttctgaatgttttgggagagagccagagccgctggagtagtatggaaaatgatgcttctcagactcaggactctaaattaatagaacagattccaaacccagaccccttctccttaacttgatattatatttcagactgactcccaggaagaatccccagatttctagctgctgaaatgggcagttacagacaaagaagtgcattttgcaaaccaataaaaatggttccatagcattctgatctctgctgctgggggcagagctttccatggaaaggtatgccgtctttagaagtccagttatcagcaatttcacaggggccaattcaaagcctttccagattattcagtcttccatccatctgacatacatttgctgagtgcctactatatgcgagtactgtgctaaacatcagtgatgatgtgtgatgggggaaaaactgcaaaggacaaacatttatcatgattggattagacactgccttggtgtggcttgcagattaggagagaaaatcatgcgtgtggcatgatattcacacaagcatctatagctcaaggtagaaactgctaggagaggtgtagattaactccagccagtgttgctggggatggcttcagaagcagaagattatatttgagaaaaatcagcagctcattctatacgtggacatcctgaatttgaaaactgatattttcttatatcaaatgacacaaataaaattgttactcctagatacactttaatcctgtttggcagggtcccacacacttgaaatatcagtgggatttgtaattgtaaagttgggggtatcattccaagagcaggaggtactacaaatggaggaactgttaataaaaacatggacaaagaggtagaaacttgtgcaaatttaaatcacataataagtgatattgtacagcagtccataatctattgataagtgggagggattttcctggctcctgtcgtctggaagggcctcacacaagtcttcaatagaacatatgaagagctgggagaaagcctctcactcctttgtgaggatggtaaaacatgttttaatgcagatacttccttgatctgcttatgatgacctttctgttgctgaaattatttgcagcttaatatggtgtaaatgtatttcactgcaggagtattggtgcagaaaagagttaacattgcagtactgaaactgtagtttcctgaagcgcctgcttacaagattggcctgtggctggcctctgggaatatggctttgaaaatgttccctaacggaaaaaatgtggctcactgtgcctcaattgtttgtacaaatgttgtgattcatgctgaatacctgctttctttcacaggatctggaatttttgtacatgctgggcagaaggtgcctatgtggctagtcccaaatgaaaagattcagtgctaattctataatgcgcttccatgagcagaacttctcatgagatggagagaacacaaggaagcccgcatatggattcctccagactctgcctatttcttttttccttattttcctatcataagccttagtcgtgagtgaactatatgttgaattccatgggtgttcctagtgattctccaaatgtgtgggtggtcttatggaccctgccaaacataattaaagtgtatctaggagtaactatcttctttgtgttatttgagagaagaaaataccagttttcaaattcaggatgtccaattatagaatgtgcagctgatttttcacaaacagaatcaagacctgcatttcctccttacattcattttctccttctcttttccatgtgtaattgcaagagaatggcccctgatttttatattgaactgcctagtaatgagcattcctccaacacactgaattctcagaaaagaagccctttcaggcttgtgaccatcttgtctctgttgtgattggcagtaatccaagtaaagacagtagtaaatatgttttctcctctcacaccaggtgatcctcagtgaatctgattgttgactcatttgctctctcactgtaacagatgttgcttttggagatggaaatcaatgttacaaagtattaacaaggggagaacttacaagaaagtgaacctaaatgattctttgctgatttaatacagcctgatcttggcctgttatgtcagattttgcaaacagattttaaagggtgtaattttaagtaggaaattagttctgtgacgtgtatatatgcatcccagatagccaagagtagtgaaagtaggaagacgagaccccagtttgaaatgtaaagacagatggaaagtttacttgaaaaagaaacctgcaagattcatgcaagactggatgtaggcaggagactattggccctacaaatgtgttttttgacccataataggttacagcctgatttaataggtcacatttcactgcctttatgggcatccttacatcttcttttcagggtaattatctcaacacacatctgatgtggcaaggtaattgactcttgcttttgtacagttataggttaatgaaccagactgacttttttagaccaaatcactcgttttgtttctgaaatgaaatagaaatgtatttagaaggcaatgtttgatacattaaaaattctcagatggctgacaactttgatttctcatcctttatgcatcacagtgtgtagccatgaagaaaggattatagaggcatctgaaagcagcttggatgtttgaaatttagaatccaagaggaaagaatggcaaaatgatgcttttgatgagtttaacgttggctgtatagaacaccatgtgattattatagaagagtggcttacattttcaaagttgtttttttttctttcttttttttctttctttctttctttttttttttttttgaccagagccccctatgattttcaggtataatatgtggttactttaaattttcagttaaagttctttccaaaagtctgtttcagatgcaatttgtttgtcctctgatgaagctgcataaatatttctttattaataatttctaagtggaggcagtaaagatattgaaacttagaattgagattgagaaaacaaatgccttatcatttattttacattgtcatggagttagccctatggaatcaccaacaaaaaatgagcagcaaataataactaataattcaaccattgataaagaagcaactcattatgtatagcataatcatttttgtttaaaaaatgcttgaataacatagacacagagaggggaacaacacacaccaggacctgttgggagagggaacttagaggtcaggtgcagcaaaccaccatggcacaaatatacctgtgtaacaaatctgcacgtgctgcatatgtatcccatgtttttaggagaaatgaagaaaaaataaaaataaagataaaaaagaaagtaaaaaaataaaacaaaaaatatattgcatttgattaacagaaagaaaaacacttgaatatataaaaaatactagaagaccatacaccaagatgttaaatctagtaatttctaagtgaagaagccatggattcttcttttaaaatatatttcctgaatcatatttagatatcatgcaatttttgttataagatgaaagaaaatatatgtatctcttttaaaaagtaataattagtgcagggaggtctgaaaataatagtgactatatatttcattgtggttacatctttttccccaaatcttcatgagaagaaagtaatcctccaaagaattctgtttccagctcttattaactagcctcttaaaaccagttgagggccagggcaatttaacaagcatttgtgaagagggtagcctcctgagtagtaaatgagattcatcttggaaatatgcaaaatttgggagagaattaatcagagtgacaaatgcaaacgatgagtatgctatagagatgtaaagctgctgttcaaaaaggaaggaaggaaggaaggaaaggagggagggaggaaggaaggaaggaaagaaggaaggaaggaaggaaagaaagaaagaaagaaagaaagaaagaaagaaagaaagaaagaaagaaagaaagaaagagaaagaaagaaggaaagaaagaaagaaaacattgtcaaaggtttagtggtagaattagctctcatttcaggagcccttaaagctgggaagaagaggattccaaatgtgcaggaaactgggtctcttatagaagatctgagctacaagttgttcattttgcaaaatgtcagaatctaggagaagtgtgaccaccatgctccaataagttatttcatagacattcttaagctttttggagaacaccaccatttccaagaatttcctctgaatgaagaattagggctcatcttgagttattacaagtataactagcagcacatactcatcagaaatgccaagtcagggtgactgcctagatcctataattttaaactcacttgccattattagtttacatgccaacttttcccaaaaatgaatcaggtcagccacaaagttaaaataatgtcagcaaaaacaattcaaacaattcaagtaaatgattaaagatttataaaaaattatttagcgcaagaggaaagagacataccaggaacctcacatacaatcaccatccaaagttgagtacttaatttagcactggtaatctttttagcatgagatagatgtcatatcctccttgtatgagcacagactgacgtggaagaaaacaagagttcggaaagatttgtctaacaccctatagattcatactggtttcctgtgcttgatgagcactttaataattttatctcttcctctccttttccctcttcctttccactctgctgaattcatattctacattcctctcttatttatcagcctctctgtgtgtttccccggagatatacataatttcactcctgctattctaacacacatggccgctgctctaaaaaaaattcctaatagcaacctgtgcaattcttccagaatactcactctctccgtcttacttatatttttgtgaatatgttggttttgcttggggaaaattttgtttctttgggctcagatcagtacgtagggactgcagtttatagctaactggacaggctgttctctgtaaaacagtagcccaatgctgtgcttattctttggtcaaatggcagaaaagattaaaaacaatgattgttttatcatgtaatgaacttatgggatcttttgagtgattaaaatgagtgaggtggactttattggacttgaaccggcagagtaatttttattaattgtgtagttaagctcttttgcttgattatttgtaattatgcataaccaacacatccttattttgaatgtttattcatgcaaatggatacacctttagtgaaaagctctacaaagtagtatagccctctttcttcatttagatacgtttgataatcaggggatatatttgttataaaaattgattaggtggccagcaaagagtcttatatctatcttggtttataactttttacctataagttctgtgtaatatgcatgttttacctataagttctgtataatatgcatgttctactctggtatctgaaaatagcttataaaattagaactatcgaaacagacaagctggaataataatgacctgtgtgctggcatgcactttgccttctttgacagcacttggtaagtgctatataaatgttagcatttattgtttttacttaaacttttcacattaaatctgtgaggtaggcatggttagccccatttgccagtgaagcaaagtgaggaccaaggttatatagtttctctatggcaagtgtaacaaattaccaaaaactgggtaacttaaaataacagaaatttgtcacctcctagttttgaaggttagaagtccaaaatcaaggtgactgtggaactttccagaagcttttggagagaatctttccttgcctcttttagcttctggtagctgctggcagtctttggcttgtggcctcattgctccaatctgtgcctctatcttcacatcgatttcgtctctgtatgttttgtgtgtcttctattcttctccttgtgtctgtccccaaactccctctgcctctctcttataaggatatgggtgattatatttagggtctaccagataactcaggataaatgcatcctctcaagatccttaacttttttttttcatgtactttaagttctgggatacatgtgcagaacatgcaggtttgtcacataggtatacatgtgccatggtggtttgctgcacccatcaacctgtcatttacattaggtatttctcctgatgctctccctccccttgccccccacaccccaacaggcctgagtgtgtgatggccccctccctgtgtccatgtgttctcgttgttcaactcccacttatgagtgagaacatgcagtgtttggttttctcttcctttgttagtttgctgagaatgatggtttccagcttcatccatgtccctgcaaaggacatgaactcattcatttttatggctgcatagtattccatggtgtatatgtaccacattttctttatccaatctaacattaatgggcatttgggctggttccaagtctttcctattgtgaatagtgctgcaataaacatatgtgtgtatgtgtcattatagtagaatgatttataatcctttgggtatatacccagtaatgggattgctgggtcaaatggtatttctggttctagatccttgaggaatcgccacactgtcttccacaatggttgaactaatttacacacccaccaacagtgtaaaagcattcctatttctccacactctctccagcatctgttgtttccttactttttaatgattgccattctaactggtgtgagatggtatctcattgtggttttgatttgcatttctctaatgatcagtgatgattagctttttttcatgtttgttggctgcataaaggtcttcttctgaaaagtgtctgttcctatacttcgcccactttttgatggggttgtttttttttctcaaaacttgtttaagttccttgtagattctggatattagccctttgtcagatggatagattgcaaaatatttctctcattctgtaggttgcctgttcactctgatgatagtttcttgtgctgtgcagaagctttttagttgaattagatcccatttgtcaattttggcttctgttgccattgcttttggtgttttagtcataaagtctttgcccatgcctctgtcctgaatggtattgcctaggttttcttctagggtttttacggttttagttcttatatttcaatctttaatccatcttgagttgatttttgtatacagtttaaggaagggggaccagtttcagttttctgcatatggctagccagttttcccaacaccatttattaaatagggaatcctttccccattgcttgtttttctcatgtttgtcaaagttcagatggttgtagatgtgtggtgttatttctgaggcctctattctgttccattggttatatatctgttttggtaccagtaccatgctgttttagttactgtagccttgtagtatagtttgaagtcaggtagtgtgatgcctccagctttgttccttttgcttaggattgtcttggctatacgggctcttttttggttccatatgaaatttaaagtagttttttctaattctgtgaagaaagtcaatggtagcttgatgggaatagcattgaatctataaattactttgggcagtatggccattttcaggatattaattcttcctatccatgagcatggaatatttttccatttgtgtcctctcttatttctttgagcagtggtttatagttctccttgagtaggtccttcacatcccttgtaagttgtattcctaggtattttattctttttgtagaattgtgaatgggaattcactcatgatttggctctctgtttgtcgattattgatgtatagaaatgcttgtgattttcacacatcgattttgtatcctgagactttgttgaagttgcttatcaacttaagaagattttgggctgagatgatagggttttctaaatatgaagccatgtcatttgcaaacagagataatttgacttcctctcttcctatttggatacactttatttctttctcttgcctgattgccctggccagaaattccaacactatgttgaataggagtggtgagagagggcatccttgtcttgtgccaattttcaaagggaatgcttccagcttttgcccattcagtatgatattgtctgtggttttgtcataaatagctcttattatcttgaggtatgttccattaatacctagtttattgagtgtttttagcatgaagcagtgttgaattttatcaaaggccttttctgcatctatggagataaccatgtggtttttgtcattggttctgtttatgtgatggatcctgtttattgttttgcgtgtgttgaactagccttgcatcccagggatgaagccgacttgatcgtggtggataagctttttgatgtgctgctggattcggtttgccagcattttattgaggatttttgcatcgatgttcgtgagggatattggcctgaaattttctttttttgttgtgtctctgccaggtttttgaatcaggatgatgacggtgtcatagaatgagttagggaggagtccttttttttctgttgtttggaatgatttcagaaggaatggtaccagctcctctttgtacctctggtggaattgggctgtgaatctgtctggtcctgggctttttattttttaattttttggttggtagtctattaattactgtctcaatttcagaatttgttattggtctattcagggattcagtttcttcctggtttatgtgtccaggaacttattcatttcttctagattttctagtttatttgcgtagagggttttatagtattctctgatgatagtttttatttcagtgggatcagtggtgatctcccctttatcgttttttattgtgttgatttgattcttctctcttttcttctttattagtctggctagtgatctatctattttgttaatcttttcaaaaaaccagctcctgaattcatttatttttttgaagggtttttcgtgtctctatctctttcaattctgctctgatcttagttatttcttgtcttctgctagcttttgaatttgtttgctcttgcctctctagtttttttaattgtgatgtcaattttagatcttcctcactttctcctgtgggcatttagtgctataaatttccctctaaacactgctttagctgtgtcccagagattctggtacattgtgtctttgttctcattggtttcaaaaaacttacttatttctgccttgatattgttatttacccagtcatcattcaggagcaggttgttcagtttccatgtagttgtgcggttttcagtgagtttcttaatcctgagttctaatttgattgcactgtggtctgagagtctgtttgttatgattttcattcttttgcatttgctgaggagtgttttacttctatttatgtggtcgattttagaataagtgctttgtggtgctgacaaaaatgtatgttctgttgatttgaggtagagagttctgtagatgtcaattaggtccacttggtccagagttgagtttaagtcctgaatatccttgttaattctctgtctcattgatctgtctaatattgacagtggggtgttaaagcgtcccactattattgtgtgggagtctaagtctctttgtaggtctctaagaacttgctttatgaatctgggtgctcctgtattgggtgcatatatatttaggatagttagctcttcttgttgcattttttttgctttcaatttgcttgataaatattccttcatccctttattttgagcctatgtgtgtctttgcacgtgagatgggcctcctgaatacagcacaccaatgcgtcttggctctttatccagtttgtcaatctgtgtcttttaattggggcatttagcccgtttacatttaaggttaatattgttatatgtgaatttgatcctgtcgttacgattctagctggttattttgcctattggttggtgcagtttcttcatagtgttgatggtctttacattttggtttgtttttgcagtggctgctaccagtttttcctttccatatttagtgcttccttcaggagctcttgtaaggcaggcctggtggtgacaaaatccctcagcatttgcttgtctgtaaagcattttatttctccttcacttatgaagcttagtttggctggatatgaaattctgggttgaaaatccttttctttaagaatgttgaatattggcccccactctcttctggcttttagggtttctgcagagagatctgctgttaatcgaataggcttccctttgtgggtaacccaacctttctctctggctgcccttaacattttttccttcatttcaaccttggtgaatctgatgattatgtatcttggggttgctcttctcaaggagtatcttagcagtgttctctgtatttcctgaatttgaatgttggcctgtctttgtaggttggggaggttctcctggataatatcctgaagtgtgttttccaacttggttccattctctcctgcactttcaggtacatcaatcaaacgtccgtttggtcttttcacatagttccatatttcttggaggctttgttcattacttttcattattttttctctaatcttgtcttcatgctttatttcattaagttgatcttcagtctctgatatcttttcttcagctttatcaatttggctattgatacttgtgaatgcttcacaaagttctcttgctgtgtttttcagctccataaggtcatttatgttcttctctaaaccggttattctagttagcaattcctctaaccttttttcaaggttcttagcttccttgcattaggttagaacatgctcctttagctcggaggagtttgttattacccagcttctgacgcctacttctgtcagttcgtcaaacttattctttgtccagttttgttcccttgctggcgaggagttgtgatcctttggaagagaagaggcattctggtttttggaattttcagccattttgcactggtttttcctcattcttcatggatttatctaccttcagtctttgctgttggtgaacttcggatggagtttttgcatggtcatcctttttgtggatgttgatgctattgctttctgtttgttagttttcttctaacaggcccctcttctgaagatctgctggagtttgctggggttttccgccagactctgtttgcctgggtatcaccagcggaggcttcagaacagcaaagattgctgcccgttccttcctctggaagcttcgtcccagaagggcacccgccagattccagctggagctctcctgtatgaggtgtctgtcaactcctgctgggaggtgtcagggacccacttgaggaggcagtctgtcccttagcagagctctaacgctgtgctgggagatccactgctctcttcagagcctgcaggcaggaacgtttaagtctgctgaagctgcgcccacagctgccccttctcccagttgctctgtcccagggagatgggagttttatatataaacccctgattggggcttttgcctttcttttagagatcccctgcccagagaggaggaatgtaaataggcagtctgactataccggctttgtggtgctatggtgggctctgcccagtccaaactttgtggtggctttgtttacactgtgagaggaaaactgcctactcagtcctcagtaatggcatcccaggtcgacttcagactgctgtgctggggcagtgagaatttcaagccagtggatcttagcttgctgagatccatgggggtgggatccactgagcaagaccacttggctccctggcttcagccttctttccaggggagtgaatggttctgtctcgctggcattccaggtgccactgggatatgaagaaaaagctcctgcagctagctcggtgtctgcccagatggccacccagttttgtgcttgaaacccagggcccttgtggtgtaggcacccgagggaatctcctggtctgtgggttgcaaagaccatgggaaaagcatagtatctgggctggatagcaccgcccctcacagcttcctttagttaggggagggagttccctgaccccttgcacttccaggatgaggcgacgccccatcctgcttctgctcgccatccttgggctgcacccactgtctaaccagtcccaatgagatgaactgggtacctcagttggaaatgcagaaatcacctgccttctgcattggtctcgctgggagctgcagaccagagctgttcctatttggacatcttgcctggggagtctttaagatcctcaatcacattttttccatataaagtaatataagttaatgttcacagattccagggatttgacgtggacatatcttttgggaaccattttctgatcttccacaaaggatatccaaccaataagtgacagagctgagatgattaactgaaatttaggtatcttgatagacaagcctgtgttcttctaatcctgtagcaaactacccctatctctgctctagaataaatttggagaccagtcaatgttacgtctacattttggaagttaggaactgagtccccaaaaggagagatgttttgatatctggttaagaaatattaataacaaacaaaaagacaaatcagattcacagttaatatagcaggatggtttttcccatttctctttaaggaattaaggattttgcttggtatattttattttaaagacttctggatattgtttggattaaactaagctaaaaataatattttattttattatgcattttagtgagcttattatcagtaatatgtttagcataaaatttattagtgacatgccctttaatttagcctaattggtactaatttagttagattgcattaaattacaccatttaatgtagttatacgtgggtcaagaaatttatttcaagaacttgggtaatgtttcatgaaactgaacagtaaaaaacggcatctaggtggctgaaaaatgcaatgttccaaaataatagttttcctgaagtcttgttagaaaggcacacagatcttgtcttccatctctactcattttcccaatctgtaaaaattagctaaagtataaatcaggaaaaggggactgacgctcataaggatactggaatctttacagacgatccttgctccagccttcatttctgattcactgtgttagggagcaaataacattgaaaaagagaaagaggctgttttctatcctcaatctttatgtcttcctttttggattttgttggttaggtgatggaagtatgatgctattgatatttccccctcggtggtataaagaaaaaagccaatttatgttcagaaaacacatacacaaaaacaaaacactttgccaatgtgaagcctgagccattttctcagactctgctttaaccaccatgaaccaccaagaggtttgggtgaggttttatgaagacataaagatcaaggatgggaaacaaccattttttttttatttttttgatgttatttgttacttaacatagcaaatcagaaatgaaggctgggaaaaggtttatttgtaaagattccggtacacttacaagtgttaatctccttttcctgacttgtattttagttagtttttacaggttgggaaaataagcggagattgtctttcaggggatctttccttgcccacttgttcctctcatttctgttaactctgtcagttccaaacatctcctatagacaactaaatggttgctgtaacactactggagctcattctagaacttaataaccatcccaagatatgatttttttttagcttgtctctagaaggaagcattgccttggtcttgaggggaggtggatctgcaataatcctaatttgacccataggtggctttttctgcagtttgccttcagatagctaacaaatgagggcagacttgcagaagtatagacagatttgacagagacagaacacttctcttaaggggacctgtgagagtacaggtgaaccaagcatcagattctacaggccttttgaactaagggggcatcacacagtattagcagtagccctgggtctctccatgtgtttgcagcacaattgagctgctgcctctcctccttagctttctatagttctgggagcaaatgccccacagcccaactggttttgccattttgcaagttagaaactcaagccttcagtgaatttcctctccagtggctgaggagataccaacatggctagggggtgacaggagttcagagtagattaaggaaacttccctaatgccagagaacttggaaggtgtgccagccattgctgtcaatgtccaacaatgctgccacccctaagcagacaggctgtgagtaccacctggttactgccactgcctttttgggtctcttccttgccagaggcagctgaggtaatgtctttgttcagcccctagtgctgagctcttgtgttactgaacccacgactcaagaaaaatgggacttaattaggaaaagctgcagggagccatcaaagtgtcagcagcattttgaaggagagacaagaggaagttggggatactctggagtcggaaaggccaaaggatagtgtacaggctggcagcattatggcaggggtgcctgtgttggcaaaaccccagggctgaataccttgatgaggtgaagcgttccccagtacctaatgctacggtgcattaaggatgagatagttctcactgagtactgttccttgtaataataaaattaatttgaccatttggaacaagatttataatgggcctcatccaagcctctaaatatgcatattccactttggaactgtacataattgctcaattgcacctgcaaatcatgttgttcgctcactaattattcaaatagtgggggcaattccacaattgtgtatgtaattgtgttaattgttaatgcagttaggtacaggtgcaccgtgactaattacacatgcagaagcggctcccaaacggctcactgtctccatgcacgggctgcccctctcggagacagacataagtgggtgacacaaacaaagccataggccatcagtgggggtccatctggcaagcctttcacttgggagccgcatatacatttgggaaacaatcaggtctttgactgaattcagctgtttttgctttcgcttctcttgctcccccccttcccccaaggcagtgagaggcttggggcaccgggctcctgagcttgtgtgagtatgtgtgtacgcatgcgcatgcacatatacacagagtcacacagaaactagtttgtagggctcgctctactcatctttttgctgatagttcccttgcctgatgagattagcttttagtcctggattttattactatctttctctgtcatccatatggtttcaggaatcaagtttatctgtacccagtatcaggatattaatgccattttcagggtaagagatgcagcctgggaggtgaaatttaggtgatttctgggacattcttatggcttatgtcaatgggaccagaatagggactgctgccacatttatactttacctatttcctcatttcttcacccaggtcggcctcattttgtggcttggtgcacagcattagtaacagccttcctggctacaagacatgtctgaaaactggtgaagtagctcttctgtgtctgtgggtcaggggctggttgcatatctcatgctgtggaaggtatgctatagatatgttccccaaattttaagactgacttctagcagccatcaacatgtacttattgttttgactttgtgctctgtaagcctagctctgaggaactggctctctcataagaataccctccctgctataaggaaggcaggtcagctgtaaaaaattaattagcactggcttggaagctcaatgccaaaaggaaaataagccacacttaagacaaatcagtctgtgactaaaaaaggagaatattttgagggagcactgaagttacgagtaagggaatccacgcaaattggcctcatacaggtagaagcaattcactctgcatcactgttggacaaggaacagaattgactcacttcgtacccaggtctctgtcccagcaaggtgcccaatgtaacatagggataatgtagaactcacatcacaggatcgttgtgaatgttaaatgagataatctttgtagggcacttagcaccatgcctagcccatattaagtatttagtaaatgtgactgtatcattactgtcattattgttattgctgtaattatttctactgttgtccttttactcaataaatatggaaaattaaccctgcactgctgttgcctccccaccccaccctggccagtcattaactctgccctcctgccattgagtattgttcatgccttcctcttctcattttctatagtctgccttgtagtacaggcattcatgtatttgtcttcacccactaactaggctatatgactgaattaatttgctagggctgccataacaaagtaccacaacttgggtggcttaaacaacagaacttcattgcctcacagcctggaggctagaattccaaggtcaagcttttggcagtgttagtatcttcggaggactgtgagagaaaatcagatccagatctctcgttggcttgtagatcgccatcttatccattcttgtgtccgcatatccccttccctctatgcgtatctttgtatacatttctacattttataaggccaccagttatattggattaggtcccagcctagtgaaatcattttaactttattacctcagtaaaggccctataactaaagaaggtcacactgtgaggtactgggggttaggaattcaacatgaactttgggggaactcaactgaacccaaacaatcaccatcaacaatatagtctgcattttatttgtgtttgaaactcctacaatgatgtccagtacagtgcctggactatatttgaagaagcaatgggcctgatgtggtagaagttgacaggcctgggttctaatctcttttctccccacccacggaccagttagccagtctgagtctaattctctatctaaatgtgaggctcctcattcctaccttaatgggagtaataagcactaatgattatatacatgcaaagtacctgcacatattagatgctcagtaaagttagttattactcaaatttttgctgagtaaactaacgaacaaataatgtctgtaggagtgattgaaacctacatatctagtcacaactgttggccagaattaagtttttaacatctttcttaagttggcctctttttcatttcctttcatggttttttacctagtccgtgtgtaatggaaagaaattaatgcactggtttggaatggtgtgagcagccagccaactttatgaaccaattttgtgaggaacaatcaacattgcggctgtgtgtgtgtgtgtgtgtatgtgtgtgtatacatacgtttatttggacagtccaagttgcctttttaggtgtgatatttaatttgtgaattggaaaatccagtttatcacttcaaattaaaatttgtctattaaacttcagaaatgtatgtaatttgtaagaaaatattcccaatgacaacactatatctaaggccatgatgtccagtagttaggaaacagaaaataggcacttgtccagaaacgaggagaattcaaagttcacattgacattgttcttcattatagtttcagttcagtaacacaagagtgtcaaaatcaaatccaatttccttttgcctgctcgtctcaacattgcaacagtggcttaatgtgcattatttgctacttggttgacatagatgggaaaatcagtaacaccaaacagccaacctcataatcactgattttttcacactgtgtcagttgcagtaaatcacagagatatagatacgtatatttgtcatgttgaaggtgattaaaagatgttgaatctgtaatcactacaatgaaagagattgtcatcaataaaaagactctagagcaagggagttatattgatctgagcacaggaatttgcaaactctctttctcagtatcttgcccttccagaactgtaaaagatacagtagcacattttgtggaagaaggttcatattttagttcagagcacttttttcattttcagcttccaggtcctaatgtggaccttctcagtggatggctacattgtcattcatgttatctaaaagttgatctatatctccctactaagctcagcttccatgcatttggctgcacatcctaactgggttaggcatcatggaaaaatcatttggaggagagagggagctatagagactgtttattttcattcagaattatccactggctgcaattggtttcatactaattctataaagcagtatagaattgtgagtaaaaatgcatactaaacaacttaatgcaataaaaatgaagcaagaacactgtacttacattaagttttctcttttcagcagttacatagagccacgtatcaagaacatatgtctgtgtgggcccccattaatataaaatttgcattattgcaggtcagagggtccatcgctatttatattggggcctaagccaacattatgtgtgccaagtctgtgcaccttcccactgtcctgcctctgttctcaccaccctcttctttatgcttgggtggtcatattttgaaatttccccaggaccagtttatcatgcagtcacgtttctcatcacatctgaaggatgttgtgcttcgcatggtaatgaggccctctttgtttcagctgctgcactgctctcagtaactcccatcagttcctgcagtctgagggctagtgctgtgatggtagcgtgtggagggtctctcagggaaaacagcttgcttattacttggttgggttttctaaaacagatttaaatcagtttcaggttttaagctgttatgtttactctggttttttaatgcatgaaaacaatttatgagcatcagttgcaagccttgggtggttatgtttgtccagattattgtgcccatgtatacaactcactgcatattttcaaaagaggctgaaccaagttaccgacactcacttgaacatgttctaaataaagaaatgacactcctggatggcattaatttatttacggatctattaactgtgatagtgtatttctcaccagaattgctgaagaatattattttctgtcttctttcaaagtgattattatttggtttcaaattgctttaaattgcatccaaagaacatgtttcctccatagagatatagtctgtcaattttataaaatatgtgcccatgccttatctcagctaattaagcatctagtcctgcaattcttatctagacccaaggaaattatgagaatttgatgcagtaaaaggatgacaggattgagtttgttttcccattagctgattataccacgattccaacaaaatctatgtcccctgaatttggacagaaatactgcctattaccaaagataatgatttcactgaaaaactctctgagatcttatgaatcacacttgtaaactcatataacatagaagccagaatagaccaaatacactagagagggaatcaggacccttcatttcatagtgaggagactttagcccagagagcataggtgattcaccaaaggcacacaactaggtaaattaaacttgatttaaaaaatggaccctaactgccagaataaatagagaggtatggtccctgtaatatattttgaggctgtcaaaggttgccttgacagaatggagaatgcttgacaggccaacatttaccaagtgttcttaatgaaggaataccatgttcccctgaaaggaatcatcaattgtagagtattataaaatgactttctcttggcattgttaatcggtataatcaatacattttatctcaatttacagtcttacacatctgggaggggtgcaaaacctggaatacctgcttttccagccttttcaattcataggtgaagaacctgacagagatctaaagagggggaagtataaccaggatattctgacctcagctgctgggctctttattatgggtcacccctcttctttcacagtaaacctcccatttaaaaaatggcccattatgagatttacttattgtccaacttagcactctgaaaacagagagctgtaagaataagtccattgatatgttgaattgcccaaacagtggtactggttgtcaaatggttagcttggccttgctggtcagaacggcaattattaaaaagtcaagaaataacagttgctggtcaggttgtggagaaattagaacgctttaatactgtttaatactgttggtgggaatgtgtattttttcaaccattgtagaagacagtgtggtgattcctcaaagatctagaacaagaaataccatttgacccagcaattccattactgggtatataaccaaatgaatataaatcattctattacaaagatacatgtacatgtatgttcattgcagcactattcacaatagcaaagacatggaatcaacccaaatgcccatcaatgatagactggataaagaaagtgtggtatgtatacaccatggaatactatgtagccataaaaagaaatgagataatgtcctttgcagggacatggatggagttggaagccattatcctctgcaaagtaacacaggaacagaaaaccaaacactgcatgttcttacttataaatgggagctgaacaatgagaacatatggacacagggaggggaacaacactcactggggcctgttgggggtggggttgggggagggagaccattaggaaaaatagctaatgcatgctgagtttaatacctaggtgatgggttgataggtgcaaaaaatcaccatggcacatgtttacctatgtaacaaacctgcacatcctgaacatgtaccccagaacttaaaataaaaataaaaagattgagggagcattttaaaggagaccaaattgcaaggtctatgcactttgaaagctttgggagataatactggaaagagcaggttttctctcattagagctaaatggaaccaaccaaccagtagttagtccattagacagaactcgtgagaaatgcagcttttgaaaaattaagctttaaaattcccataaggaggacccattttaccattaaattgtcaattgcaggtcaatacatattattctatgtatactctcacatagactttcacatatgcagagagaaacactaaagttgctatattagtctgttctcatgctgctaataaagacataccccaaactgggtaatttataaaggaaagaggtttaattgactcacagcaccacatggctggagaggcctcacaatcatgatggaaggtgaatgaggagcaaagtcacatctaacatggtggcaggcaagagcatgtacaggggaactccccgttataaaaccatcagatctcatgagacttattcactgccatgggaacagcacagaaaagacctgtcccccatgattaaattaactcccaccaggtccctcccatgacatgtgggaattatgggagctacaattcaagaagaaatgtgggtgggcacacagccaaaccatatcagttgcaaattcagaaatccatagcaggtcaattaattgttttaaaacttccgctcttgaattacttgtctttattcaacagcctcaagataatcttagcttctcatttgatttaatctgttatgcaaaaaatagcacgaagtcctcttatggctgttttaatcagttgctttttgagattttataaaatagccaattgagctccacattgtattttttgtatgattaatttgaagtgattgtattggccatagtggttatgaatgcaaggaaataataatcttatcttgcttatgttactgagccgggtgtatataactttatgctcatcagagcaatggacaaattgggctcatcgaactgcaacttacattttcatgatcattccattgtattatattggtacaacaaaggaattttgcaaaataaaaataatgaaacatcttatatttcagtagtggctactagatttatatatacatataaatataaattcctatttgataatatagttgggaaccagtttttttgtacagtgattaagaacatgggtttgaagtcttacagacatggttttgtttcttggctttatcacatattaactgtggaaccttgggaaaattactgagcctctatgaacctcactttcatcatctacaccatggcgacaataatgcctgtagcttagagttgtcatgtagaataagcaagttaaaggataggcctggtacacctaaatgctcaaaaagcatgtcctataaaaataaccatttatatacaaaaattagccgggcatggtggcacatgcctgtaatcccagatattcaggaggctgaggcaggagaattgcttgaactcaggaggcggagattgcagtgagccgagagcgtgccactgcactccagcctgggcgataagagcgagactccgtctccaaaaaataaaaataatatataaccattcttatgactgttttaacacaaaagtgataacaaagggccttgctgacacaagttattttcatttttgtaccttacctttaactcagtatactattaatcattcagttgggaaaatagttatgtaaaatggcagtgctaagagggtctttatatagaattctgtgtgccctggaggcatttgtgaaaaagtgttttctctaggatggactaagcctgaaggttactgttaggctatgatttggctgatggcatataccacaatgcctaattagggaaccccattgaaagcgatcattttctctttgatgtggcctttccatttaaaggttgaatattagggttacatgaatgaaactagacaaaaaaagaaagaaagaagacaggaaatttcctacactttcagaaacacagctcacagacaaccttaggaaggaggcatgcctgggtcctttacaggagtggggcatttgcagctgctctaatgtatatctccccagaaattaataagtactattattttctgcacttaaatcataacttacaaaataggtttattcatccaactttctcttctcaatacttccaaattgctagcattatattttctcatctccttgttttgaacatggctatgacctcctacacactagctaacctcacctctacagctaaagattctaaggaggagctgcagccctttgcctaacataacatacctggcactaggcaaagctgtattctgacttctggatggtccagtctttggcagggtgggtgggggagggcagggcctacactgctgggtaactggagagcaagtgcatcaaaaaggtgcccacagactttgcctcccttttatgtaacttctgttcttgctttcacactgcttttttggacatctttttgtcacagctttaacaattaccccatcatcacagtatttagaattttttgaagagatactatgttttcagaagatactgttttcagaagtaaggtggggcacaactcctctcctctcctccacccctgctgcttcccaagagaatacagaagagactttgtaggacttccaatagaagaagctcgattagagcttcttgagttgctgaattaaatcgtaatcaattcaatggaaccaaatggaatcatgaagtaacaaatcccctgtcatgagagtcatgtcagcagtacttgtatgatatgatgacaggacttggattgatcagatggtttaaggttaatcccataccttccattcacatggttatgtgaccttgggcaaatcatttcacctctgtgcactgtatttgtcctcatctttaaaatgggacagaaggtagaaggctggagtatataatccccggggccttttctctgtcaggagcctgtataggagatgagagtatccactcatttctggacaagcaactcaaaagtattccattgagaatgaacaagcaacattagctttgcatgtgaatgatggcacatttattatcagatttatttcatgtattacctgtccttcccctccctgtcttccaacagatttagtagatctcagtcagttttaatgctttcggcctctgctgcacctgtagtaactgtctgccagaggcagccctttttcaaagtccctatcttactgtaagtaaaccagaatttctaaagatggaagggttgcccctgccaactctatttcactgtttctctatttcttgaaaggagcaatgaaagggagatggtatcccatgttgaataagcaagtgtctgccttcattccagccttgtcatggctccagtaagctcatttcatcacaaatttatgactcctaaaatcaatattgactgtggatgttggggggaggacaattttgagggcacatctgaattaccagtgaacccataggaattcccttcagttgggtgaaaaatgatcaagaaacaaaagctaaaggaggagtcaaggagtacagcatcaaggtgctgaactcattgttaaacctgagtccttagtgcttagcaactctgaagtcctggatggaggaaagacttggtctgtttgtgataacagcaggtgctttccaaggtacagactgtctgagtcattgtagaggcaacattctctcaagatcttcttcactttcaagttttcaacatgccattttgcaggttcctttttagactatcagtattttgcctttgatgttgatggtcagcttggaatttgtaataacattatttaccatataacagggataaataatctttcatcttgcagaggcaggggtggggggttcatggcagtttatcaaattgtctcctggattgctatggctctagtgggaactacatggataaatctatgttaaacaacagcagcatgaaatagtggaagaaacactggattgtttagccaaaaacccaggggctagtctccaccacctctgactagccataaaacttcagacaaatcatgcaaccttttgaagcctcgcttctttttcatcttaaaaaatgaaactcattttatcttatttgtctacttcagaagattgttgtaagcaacaaatgatactgggagggggataacagatggagacgatgtgaaaggactttgtaacctggcaaggactctaaatttccaaggaatgatttctattagcgatggtcttagtagcagtaattgaagatattctttatatcatcctcatatataaattccctcattcccctttgttttcatatgccaccagggttctgttcttaaagttttgaattaaggggtaaatatcttcactttaaggatttaggagatgtctctcatggggttagattatcatttataaagaactgaaactgaggatctggaaaatgctaattgtaaagcttatcattacagagtagatgttagatgctgccctgaaactttgtagcatcctgataaggtataatgctttccttttcagcatagattgcaaaatgaagggtaaaacatttagaaattaataaagcatatttataaaaaatatacctggccatgctcagtagatcatgcttgtaatcccagcactttgggaggctaaggctggcagatcacgaggtcaggagatcaagaccatgctggctaacacggtgaaaccctgactctactaataatacaaaaaaattagccaggtgtggtgacatgcgcctgtagtcccagctactcgggaggttgaggcaggagaaccgcttgaacccaggtggtggaggttgcagtgagccgagatcccgccattgcactccaacctgggcgacagagtgagactgtctcaaaaaaaaaaaaaaaaaaaaaaaaaaaaaaaaatatatatatatatatatatatatatatatatatatatatacacacctaagtgtcagactagataatttcaagattagtgtgatcataataaatttttatttaccaaataccctcagcctagagcttttcaggtaaccaattaaatgcacactaagtattactaattgcattatttaaattggtatactattttaggtttagaaggtccctcttcttcatgataatgcattttcatgaagaaagaccttaaagctgattctaagatcttcaaataacacatcatagtgtagtatatgttggtgagtttatttatcttgagttgggagcttttatagattccagctatatgtcttcaccacaaatcttgttgttgttgttgtttttgtgctgatggcatgagtgagaataaatggaatttgtggagtctgtgaaggccactggagggaaatttcccaatctcctaatatatcagtgtctcttcctgtctgtttctgatggggtcctacagcaggtcaacatccttaggtaaagaaaagcttcctaagagttagcagcagtcattgaaagtaaattaatgaaaccctgcatctgctgatctatttgacaagaagaaattctggctgccaacagttagaaaccactagaaataatctccattggaaaccgggcttcgactttctgccctgggctgcccaaagtattgcattagacaatgcgaaagtaagttgaactttgaattataatttcaatgactgtctagcgaaatggattcatgctctgacactgcacctttgaggctgtgggttggttcacataagataaaaatctgtctggcctgacagttgaaaaggtcgcaagaacgcttgatgtctgatggtctcagtgtattgccaaatcttgattaaaatggaagacttaggaacaattatgtttttttctttcaaaataatcttttcaaacagagccatttctacatgttttggcttgaaatttattgacttagcaaagtatcgattatattttcactaccatttagcaataacctcatacttaacatgaagctctcacatagttgagatactttggccttggggcaacaggttatttttgaaaatgacatctaattgtcattgtagtatgtttggtattaaaaattgaactatctacattttaatgcttccactttagctctaaagcacgttgcctgtcgtctgttttcgttatgaaaatacttgcaggaatggcttaacatttttacttctgtagatcatgcaggctctgtacctgtgaaatgtgtagcttttaattttagattagagacttctactagctagagattaacacaagttgaatctttcaaattaatctgcttttgggccacagattgacagacttaacagacacgagtcaccttaaagactggattctaagccaacccgcttgttttacatctgggaaaactgtgacttgcccaaagtcatacagtttgtcactgaaccaatagagtttcttcaagacagtcagttcaagtatattaaacagtatctcatgaagtgctaaaggaatcctgagggcagggacaaagtgttacatatagatgtccaccatactcagaggaactctgttcagattaatctaccacattttctgttcttagccaattacatttcactatgccaaaaataaagtactttcaggaaactactttctgtcttttccaaatgccaaagtcactctctatctgaattttttctcttattcaaagttaaggtcctgtcttacttccttgcttgaccaccagatccatggacagtttttcctttcgtgactttctattaaagttattgtcagagccatgaatctggctttttaaaatatgatcaccacataaactggatttccaggatagccctgatttcaattcattctccccataaattggtattctagaaattcccatatttggccatgtaaatcacgtcatgcaagctgactttggtacccactgaaagaaaattttttttctgccaatgtgcctcatttagggatcaaaaaaagatatctgctaacatgcactgtaattcctcactttagatatgcaggtcttgtctactcgtctatagtataccctccctgtcttagtctgtcttgtgcttctataacagaatacctgagactgggtaatttataatgaacagaaatttattggctcacagttttagaaattgagaagtccaatatcaagatgtcagcatctggcacaggccttctttctgcattataacatggtagaaggcatcacatggaagaagttggaggttggggagagagagagagagagtgagagagacagagagagaagcagaaacaaaagagtgccaaacttgtcattttatcaggaacccactcccatgataatgacattaatttattcatgagggcagagcccccatagcctaatcaaccctaagggccccacctctgaatactgttacagtggcaattaaatttcaacatgacgttttgaaaggacaaacattcaagccatagcactccctgtggacagccattgtttatcatgtactgcattttacctaatgcttagcttagtgcactgtgcatactgagggtgcaatgcatatttgtcatttgggattatttcctttacatgaacagattttccaaacgccaaatttagaagtactgcaacacattaattctggtcaagagtaggtctggttagttcattaagagtttattttatcagtaatgtgttgtgcttgtacctgaaattataaatgcctgccaggtatctgtttatcctacatacttccacaactcagaaataatcaataccttgttttcttgtggatgcgagaaaagttaggatcactgatgctgggtatatgctgtccacgttaattggcatagaccgttaggcttcataaaccatggtacaccatgtatcactccttctttgatcttcagcataaaattcaatgggcttgagatgctccacagagctggcccacatttaatgtcacagaccctttatgacacacactatgtctatttcaggggtcagtttttgcagagtgattttctggaaaagtgccatgcccttccatgagccaagaatttcagtgtctcataaatggtggacagacaggaccttggggccatctctccagctaacagaagatactaagtaaggcccaggggaagtttaagaaacaaacttcttgtgtttgttctattgattttcttgccaacaagaagtgtaacaaattgtgatgtttccaaataaaaagcatcaggaataagctccaattttattgagtgatttcctggacacacatgcaggtgcattttggaagaggctggatatagtcagacacaggtaacaaagccaggtcacttaacaaagcaggaaagataagggccacggttgcaaatcattatttataatcaaacaaaatggtaattttgccaacactcccttctcaaatataagatcatcatcatggtaatcaaactattactctgacacagtttacttatcaggagaacaatctgagattgatgacctgaaaatggaggttgtctttcaattcatttgaaatgcaaaccgagtggacaacctatacctactgtggcatatttttaaagcaaaatcaggcacctacattgacctcctatttacatttctttgagaagaaaagaaaatcacataaaagctatcaagaaacacatttcacagcaggcaaattaattggttttacagtatttgaatggagggtttgtcaaataaaacatgccatgacagttaatagtgtcatttagagccagaaaattattggcttatttgttattggataaaaggaaggcaaacattttgtattagaaagttttaatgtgtttaaaatcctcattagggattaatggacatgcttgcttagcatagcgcctcattaatttgaggctaaacagttacttctgtgtttcaatctcagtgttgtttcttaacattttttttttacttctctttaattagatcttgcatttgagtttggtctctacaccattggagatgtagatttaattaatgagatttataaatctaatgaaagtgagttattcttagctatcgtttcattttagtgagcagttaaaccacatgtaagtgggcgcagatctaagagatttcagaagtacagaaaaaatgtgaacttccctgaatatatttagctgtgtcacttggcattaatagataaaagtgttttaattagagtcataaataataggggagctggcgaggattcagttcccatgcacatggcttgttctttaggatcatcactgtcaaagaagagcaattgtaactctgtttctgtggaatttcagtgtcatccactggcaattaagacaatcctaagtgcggagtatagagagtcaataaggcgccaagttcgttagaggttagtacaaaagtagagccactttctatcaagtgtattctgttgtcactgttttattgagggcatctgtgggtacgatttataaagtctattccatttacattgctttaagaggaatttagttaaaggaaaaactgatatctgagtttttggttttcaaaaagacgtttaaatcattagttatttatttgtaagaagaccattgtagtttctttagggcgagggattgtgaatgtcaaggtaagtccttttttttctaaaagattttcaaaaaataagagccaaaggtacatatttaaaagcttcttttttaaacggggttatggaacttaatttaagaccccataatatacctgtggcaatgccttcagaaattaccagaaaaaactgaactcccactttttttttcccatgaggaagtccttgtatcttagacactgtaaatgatttgaagaacttgtcagtccaagacacataaaagataatcgtattttaaaatactacatgatagcaatcacatattaaatgtgtaaaatgcttgcttgaatacaaaatatttcaatgattaaaaatagctcttctttaaacaattcagaaactccgtctaatgttctaaaggaatgatttctctcaggaggatatgagttaatcgagttctctgtgctcccaaagagacagagtagcattcagttaggcccaggggagatcctcaagccttggggcttaaatttggccctgggcttaatttcatctggccttctggataatattacaggagtcactacggtggagtcctggtcattagtcctactcctgcgctttctgcttattgcagtcagaatgaagcctcttctagattagagcatttggagaactgtgaactatggttaattaatcagtgttggaaaaagcagaagctaacagtgaggagcagtgtcaccttcttccaaatcatcagagctacttggcctccaactcccttctttctccccgcctccttatcccttctattatacttccctagcaagtctatgatccatgtttctgttttcgaagacaactattccaacctttcttttctcttccaatttccagtaaccacaccccactctcagctgatgatcttgccgcatacttcatagagaaaaataagatacaatcagacaagtaccatgtcatcttctcatctttaatttctccaacccagctgcttatgtacctaggcactctgccttccctcctgttacaatggaagaagtgtacagaagtgtccatgttcctatttcaggccaacctcttcagttgtgtcttgatcgactccctccttatcaaggactttgcttttacaatcatccagtttctcttttgccacactttttccctcttcactgagttctacgcatcaagtatataaatatatcttaatatcatccctcttataaaaacaaaaccaaacaaaaaccttgactccacatcaccactttatattatttcatttctccacctcctttcacagtaggaattgtttattcactctctccacctctgccccttccactctctcctcaatacacaatcaggtttacatccccaccatgctgctgaaacagctatgatcgaggatacaaatcacctagatattgctaaagccaatggcctattctgcagcctcatccttatttaatgaccagtttttcctggaagcactttttcttctaggctattgtgaccccatgcttgcttccatacacactttaagaattcatttttggctttggaatacatgacatgtcatagataatatgctatgctatgcggagtgtggcctcctggcaaaaggactactacatatagcaaaatacataaaataggaaagaataaagcagagtgttaataaaatcgtagaatccaaaagatgtgtgaaagatcgcataacccggtgaccagcccaaagtgaaagtgttgttattctgtggcaacataagaaaagtaagataatgatgtgtgtgtgtgtgtgccagtatgtttgatgttagcataaatttaactgttctgtattttgaacaaactggcctttattctgagattatgccttattaaccttttggatgttataatgttcttttacaaaataatagtgccaatggtggattttgttttgtaatgcccttattgataaaagaaaaagttagtaatcttatacatatccctcattatttttgtactgttatgtgaaatacaaaacactgggtactcggaatatattctcatgccttcactgtataggctgtttaggctgcaggctggcgagtgaagaagtgaattgtcccaaattacacagctaattagtggtggagcttggacacataactactgtttcctgtcaggttttttcgctactttataagatttgttacctgaaagtgagatcactgctttgtaattgtttactttctctatattatgagagtgtgctatgatctttgaagaggtcaagagcatactacaactttaaaaactctaacatttactctttaattgacagaattcaaaggtgaacttgcctcctgatatatcttttttatatatttagataatgtattagttcaatctagtttgtacatctctagttttgcagtcttctcttttattatgagagattattatgcacctgcacacaagacagtcattaccattaatggcagtacactaagtagggattaagtggaatctagattttgatcctaaatggtctttggttgcagtactaggactttgggacagaagtgggtatcctgtaggccctgaggagttggctgcttacctaggaatttcaaaaggaaaggaccagggccagaagatctgaggattgtagggcaggcaccaaaagaagaaagaaggtcaggaagagcataggcaagagagggcaagcaagtggggtcagagtcacggaggctggcaaagagaagtaggagacagcttgagtctgatcccagaatgatggaatcatagcaagaagcctagagactctaagttggagatctgtccctgtggaaccgggctggaagaccctactcagctggggtatgagtctgggtagctgcagcaacagtaaccagaatggcctcactgactagcccaggggacttgagacagggcatccttgagggaatgtgagccaggcagcaaggtgcttccagataggttcttgatttctaacagtaatatttctagatgtttaccttgtttttgtcgaagactgtaatataccctcattccccccatctccttttatagctcacttttctatcgaaactagttattagaccaaataaatgaacagtgagttaatggctattcagagcccactgaattaagtactcttcacttgaaattccatctgccattaggtactctcagctgatgatgggcctttctgcatatgcattccaccgttgcccatacctaatgtaatcactgaagagatgtcctcataatgaagcatgtcacccacccctcctccacccttctcattcccactctcccttatctctgttgtcatatccacttaagtcccatctccagcctcctttttcacctttaatgagagccagcagatggaaaagcagcctgagactctttacacactgggaccctgaataggattcagtaattagcaacattcataagatgtcatgggagccagtttacaaggcaaccaaactatctcctcagtggttccaaggctcagagtgctgacacccttctaaggacttttgagagaacttagcatacaaagtgctgatggagacttaacatgcaccccctactaggctaaggtacttttataaacctcacttcatttcaacatcacaaaaatcctagaagtggatttttaaaactttttcttacataggtagggatacagaggctcaaacaagttcgagtggcttgcccaaggtcataaagcaagttgaacttcagaaataggattgaaatccagttctatggagcctcaaagaccaggctctttccactgccccttggagcccccagaaaacacagtaaattatctcattcatttgctcaaagaaataaaagttcatggttaccttttagttttatgttcatgtatgattccaaacaaagggtcatttcctgtatttggcttaaaaagacatgtgttaaattattttgatcttcatgctctactttttgttctttttgtacttttctggtgcatattaccttgttttacatgaagtattttgaccaggagacttacttaaaaactggccagaagcagtattttaaagtaaacaccagctctttggatgcccaggatttttgctgtattgaaatgaaattggaagatgagctggttagctggaccatgtaactgttgtgaaatcgtttttgttttgattaaagttatattacccgaggacttctgtctacagcttatgcaatattaactgttcccgtttaatcatagactcatgaatacaaactagaatagggacggttaaggtgaggcaggaagcaagggacagacagatcctaatgtgaactgagtttgtagttttccaaattcattttggaaaactgggactccctggatagagacataggggatttcataatgcatgcaaataagaacttcagaggctgctgtcctctgtttttacaaattaccaacgatgggaattacaaattttaaaaagattgaaaactcatttggtagtacagtatcataacctgagtttttattttattagtaattctgcatcaggggacttctgtgtaccataaatcaatcatggggataaatggggaagtttgttaatgaaagtacaaacggaattagtttggaagccgccatcagtgtctgttgtggatattggttaactgggcccagttatttaatttgcaattaaacttttgatttttaagttttactttgagaaagtgtttgtcaaggtggaatatgcctagactagtggactatgattgccagctttgtgggaccgccctcaggatgattttatgggaaaaaatgacctgtcttctctcacaatcccttggtaataatatactcagaggcatgcattgagctcctctggattaaccatgtgttgatcattattctattaatgttttacgttaatctccatgttttctattagtgatggctgctgcttatgtctctcaatgccactatcagggtgtttttgatatcttgtattaccctaatcgctaagaagtatgctccaaactgattaattccagaatgattaaaacatcctatgcaattcatttattgttgctgcagttaattgaatatttgatgatttaaaggtaccctgattatttcataagatatgtatttatcaccaggcagataatttgtgtgtggtctctctgtggctacatggggtggcagcctgcactgtcagatgcagagagggtaggcacttgtgagggttctcagtaaactcaccacctgcctgatgtgcacctcccttccctggccctcagaggaccacatccgtgcccagcacaagagggtcgtctggggccaggagtgagagcacagcctcccctgtgtgtcgtgcagcttgctttctgctccaggaggagggggcggagagggggaatgagaaaggacgctgcagctctgagtggctaacttgcgctttgtggactatctgaatactcaagagtggatttaaagagaggagaaggtgcctcgggaattaagcagcagcttggcaactcaacgggcagcagttctaatcccagtgccaccactagctctctttctcagtctctgtctttcacacctgtccgagtaactcctccagaattactgcgaagacgtgtgggtgtgtgtgagagagaaagagaaagagagtgcaagagaatagcatttggggccgagccccagccttagctcagctttcttccagtgtgcagagtgaccctggtgcatctccgcagggggctcagtgactgaagtggcctcaggtggccccatcacttctcagccatgtcgaatccttggcctctcactcccatatggagcgaggactacggtggggacctcaacggctgggagcttctgtctgacatggcagtgtcggtgaacccggtaggtaccctttccctggcacttaaatcagacctcctgtttggtcttgtctgtttccccgtaaatgttgtctcctcaatttgcatggagtcttgaaggcagaaatgatgctgcctccagtgtctttaaatcctccctcttggcaccatcctgagcacagtgtgagctcaatcaggatttgttgtctaaagaaataaatgggagagctgatgaataggcggacaggcgaatgaatgcgatcctattacccttgtcatgactaccttacaatgtatgtcccagtgggtttctaattgtttgttttcctatcccatctagacatttaactctgagagaaagaacctgagactccgagtgatttgtattaccaactctccatgctttgcactgtgctaggcacgtaggaaatatttgctggttaattaaaaagcacttgcaggaaggaaaagcacttgcggttcaaatgtggttgtcttacggagaaaacagcagtgggcccgggctagatgaatttgcggaactagtaacttcatgagaatgctggattttagtgttttctaaagaaaaatatctaatcactgagtgtgaatgcatatttatttgactgctcttgcctttagagttctctgtctgtcctgagtgctgccgactccaatagtcagtcattattagatgtgctgcaaagctccagagtccacaactctttctcttctgacagtatttcctcccataaagaagtggatatttatatttcaaagagtagagatgatattttcagttggcaagagtgagtcaaatcttagtttgaaaagacgagaagacaggacttaagaaaagtaaggagaacaacaggacaaggggtaataacttaattcattgtattgggctttgcggattacaaagcacattcacatcacttatttcacaggatgctcacagaaaccctgtgagatttaaaaaggatgggtattactattattctttccttttcttttacatttggaaaaactagaactcagaaaggtacagttattaagtcctgttcccaagtggtagggccaggactccttcccaacccttttgactcatcagcaggtgctcttgctgtgtctgcatatcagtgatatattttcactgtgatttaaaaattaacactgatgtgtttgcgtgggaaaaggcgaacaaagaccttttcatgagactgggccatacatttttagcctaggctgcccactctaatacaatacaacaatgatattgaagatttaagcctttcttataatcctttgacctttgtatttggggaatgtatttgttagaagttcaagaactctcttggaaaatacagttgctgcagcactgaacaatggagtgggattgtatttgcagttgagaattaccagtttagttgtataatcatataaacatgttagaccagcatcttccagtatatattctgcaaacattcattgtgtggaataacagtagttattaattggaaaataaaacaagcaaacaaacaatcaaacaactaaaactaaaaacccaagactgaagccaaggaagttgggaatgtactttattaaaaattttagacaggtgtctcacagctttttatttgcatcatggatctccaaagggggatacaatatgggttgcagcatttcccatacttctttgaacacagaaccttccattttgcataactagtgtccatgggatggtcacctttttgtacttccccagagcttatagttgtgcattaactatgtgattcttcatattcaccttcctattgagcctgtaaactccatgagtgaggaaactgtgtctcctcttgcttcccattgtatctctgcctagcaccaagtggcacagcctttggctctccaaaattatttgttgaatgaatgaatgaattgtgctacaccaaatcaccagtggttctctatatgaaacctgtattttagattctttacaaggtatgcccagccaacttaagtcttttcttctactgtttcttctacctagtattagagtattattgttatcggaaggatgactgtataaatttgtcatccaaactggaggacatttttgagagggaaagggaatactatcaataattacacagataagaagtgtaacctggggctatactgggccatctagaattgatagcccttcattattggtgactgtctcaggctgtctcccctatttgggattttgggcctcttggagcagggacttttccatgtagaaggtcttcaataaatactggttgtaattaatgcatgtacagaagtgaccataatgctgtttgaagatttgctgtattgtttaacttgtagtttttacaggtgaggaaatctagtgccgtattctgttcttcatttacccaagtatagttgagtccatacttaagtctgttggggagttaataatcgtccttgcaagaggcctgggcaatgtcgatgtaacggcagtgctctcttaacaggattgggctttcatctttcaaggcagtgaatgagagacccactgttcttaccagagcaggcaggaagcagatgtgatcggattgcaatcctggagagggtgaaggtgtgaaggggagttaggaatgtttgggggatgcctaaaacctgcacagataatgtagtgatcagcagagatttttctagatggttgcctgactctcaagttcctgatcatgcactgtcttacagctggttgcttattttgttatctcgcttcttgctttcactgactataaagcacctgcaggaaagggctatgggcctgacatggagtaaaccctcagtacatttctgctagtgacttgaatcttgattcattaggaaggtgtcacactgggaaaaatgcatcatgggattcactgagtatacttctgagactttttctaactgccaaggcaagcatgcaatttacacaggccgttatccttagtgttttgtaggtgcctagttggactcccaagttcaaaaagaactcaatttaatcacaaaagtgtttcgtataggccttatatttttaatgaataatatacaaaagtatgtcagagggtcaaagatgccttaaagatcacgagatcaagctctctttggatagatgagcaaagagaagccccaggggatgggggatgggtcagtgcctgaaagcaaatcagtgacagaacaaggagtcactttatttctgcaccatgcactgcgatcttaccgcttcattaaagtaaaacaaaattagtcatttgcagatattcttttgtatttaataggaaaaaaatgatagctagattttcttgctttacagtttgtcctacagagtaaactattatacaagaagaagaagtagattgtgcctaatgttttctgtttattttgtttcaggtaagccttcccagtgatccaagctgtgttgaagaaatcttgcgggtgagtttaaacctttatttttgtgccttttaataatgaagcaatctatctgcttaagctgtttaaagtaattactgttctgtttcaaggagtttcatgatggggaatcctgatattctacttcaagacccttctgcttattccagtggcctcatttcttgcctgtcttctttccattttgtaatcaagctagtcttctaatatcactaagcttctgccctatccattcctacatccttctcagacagagacttaccaccttctttaggaaacgttccctgttcaagcaccataccctaaacctttgccttttacctttctgggatctcagctcaatctcactgctgccgcccactatgtggaacatggttaccgagattgattgtggcctataataaggggaagagatgtgggaatgggagaggaggagaagatgagagacttgaaaatgatggcatgttgtggaaagtgttacttatggaagtgagtgtatgtgtgtgaatgccttgagggcagaacaaagttgaaagaatggctataatctcttctgaagtaaacaatcaaaccaaaagaagaaaccaaagttaagcaagaaaaacatatctgtctgctctctctggccattggcatcataaggcagtatggaatctcaagaataggagtcatggtaatgagctcctgagctcctgtcctggctctaccatttgtcacttctgtgaccttggacagatgactttatctctctgaatctcctttcctcgtctgtaaaagaggacaataatacctgccctaactcccttataggctaccaagtggtatataaatgctggctattgtgataaatgatgaccagtgtagtcatgtaaaaaccatgaaggctttctatctgggaaagaaaataatctatgtgccagtgaaaatttggcaccccctttcctcagttaccaaagtcactccaactccctcctgatccccctctcccagtaagtgccttctcagcagcccagtgtttgaagcaagccctgagcaaatgcagccaaaggaatagtcaagagccaaaagctgtttaccattgaaatggcttgccacccggagtatacctgatgtacacattcgtgcacctgtttcagcccaagaacattgttcttgactattaaagagatgagccagtcatatcactttgatcaacgatgagactatatggattagggcaggggttcccaatcccaagtcaatggactggtaccatgtgttcctcgtgagaatgtaatgccttgatgatctcaggtggaacagtttcatccaaaaccaactccccacccctactcccactccctaccccctcatctgcggaaaaattgtcttccatgaaaccagtgcctggtgttaaaaaggttggggactgctagattaggactatgctgactactttggtaagataagaacccagcaacccctcagtcatctgtctcaggggcccgacgttttgggtggagacgaggcagctgttatgagcaccacaaaaggaatgcacactgggaactcaggcctttcccattgggaaaatacattcagtccttgctcacttgtcaacagccttccttaacagaaggtaataacattgaaagaaatgtcttactctgctctagatagtaaccttgttattcctttcttctccgagtcacaagcataaataaactcagtggcctttttataaactcccaaaggaatgccaggcatatctcaaaatctcactaatttgtcacaatcgaaattacatacttaaaagcaacccagccctggtgcctaggtggttatgtgactaaatgcaggaaggagggtgaacacctggctgaggctggcgacaccagtctcctaaaggagccacttagagaaacaacagaatttcacttacacatggaaagaaaagaagcaggttgccttaataggctcacaaaagataacatgctttgagaaagtaacaaaagtccttctgttattcttgaaagagaatctagagaaatgtctcttttttttgaagggctatagattgtatagaattctttttttttttttccaacaacgctgttaatgagtgggccttcctttattaaagaaagaatgtttcattccccatgcttcgaataaaaataagctttctgaaatttgcgtccccaattttatgactaattgttaaatttttatagaccaccttgcatgtcacaatagagcatgcttgttgggctttttgtcttaattacacattcatgttccttttggtttgagggccttagaggcctgtgacgggttccgcagtaaatttgtcacctcattccccataaacccctttcttagggaaaagtacattttatctttctccctacctctcctggccatgctcgctgcttttcaaactaagcagaggcccaaacaatgtcatctctcctcactgaggggagctatgcagaggaaggagcactagccccggagtggaggagctggcttccagttgctcatgagattcccttatttcctagctgtgttgcttttcagtttcttcatctagaagcatgcgctagttattaccccgcccatctctctacccacctccaatgaaggaatatttaaattatacacattgtttgcatctgcaccatgaaaatctgagtccatttgctctcccaactttcccacctccctgatcccccttttttccctccacagcctggcaagcaaacacatacaaacccacttcatctcacatggggacagacttcttttattaaccaaatgcaacacaaccagcctttccccactctcagcccctcaatcctccaggctatggaaatacttttgccttatgtgttttgttatggccccctttctcaaaatgctgtccaaattcaagccagttggtttctcttgaaagcccctctcaccattcatctggcaatgttctcagctccccttcaaaccagcaggtccacttttctttctttgcccccctgggcaaagtgctataatatgctggagcccaccttgtctggtcttccagcaattttcttcttgccctcatgctctcacagatgcaatcagattataacaggctaacttgacctgatgtgtcaaccttattttcctatagcaggtgacagattgtcaaagcacttgaacctcgttgtcttatttggtcataaggagtaaggtagtttcttattatttcatgaaatcgaagtccagagaggttaaatgacctgcagtccagggtggggctggtatgtggcagaagtaaaatggtatctggcctttgttttctaaatctagtgatctttgcactacacccaactctcaatcaccctctcacaaatctagagtgagaatctctggatgttaaacaaacttgcttcagacagtagctgacatttccagcaactttaagaataccagcaaaccaacataatttgaacagatcttagaaattaattcttcttttttgtcattctttaatattttgaatctcatttcaaataataataaaacaatagcaaattttcttctaataataaaacaactgataatagtaatgtgttgtctattgcatgtcaggcacagttcataagcacattatgtctttgaacctttacaataaccctcaaaaattgtattattagtcatgctttacagaatggtaaagagtgaaagtcagagaggtgaagtaatttgcctcaagtcacagttctccaagtctctgacaagagtcatactatccgttcttctggtcctgttggcttatctgaattcattcttatttaacaggctccagtctgctttatgattaacattatagtggattcaaccaccaattcatttcagcttctgttgtttcctcaatttgtacaaattcagttatgccagaataatttaagtagttttttgaacaaactagaattcactggcctacaacaccttttcaccaaactgaccttctcccacaaaatgagctgtacgaattcaggtgtctttgctccttttcaggcatattatcgcttattgtgaattttacaaatcagaaacttaaaggcagcaatctgtgcaatgcatcccagcttttacacttgcttccgtcagcatgctgtttactctttagagtcaagctaccctcacgtgcaaacggaaatgaaaaataataacagctctggccacagtgatggcattttgcagttacaattcatcaatcatctgagggattcctaggcagctcatctgtaataatatgggtaccagcagcagcttcttttctgagctctacggggttttatggatcctagagtaatcatttctggaagagttaagacaaggagagcagcatgctctaaatgctactagctaaggatggatgctcaatgattatttgttctacagtagtatgatttatttgttcatagaaagaatttactttaaaaaatcaagaaactatgaaatcctttctggaatcaaaaatgcagatagagcatttcttttagatttgatgctaaacagattgtctctcctagcaaagcaccttctgtggttgataatttcataggcaaacatctgtaagggtaattcagtgtttatgagggatgctgaatttgctagctaggatttagggaacttgatttgataaactgtatcttcttacagatttcttcctgccatatggatcaggttggtaaacacctacttggccacctctttttgattacagtatgatctgtgtttacagcattctaaattatggcaattctacttattaggcttgtgttttagttaacagttttagcatggaaaaaaattaccaaatatttacagggcagtgcttgttattttatttttattttttaacagggaaataaatgaaaaagcccatcttgcaagtaagaaaaaaaatggatcagggaacaaaattggtcggacaattatgtctgaaaggaaatttgattatattatcataactatgcagcataatcaagcacctttcagtagaatttcttttataaatttaaccaataattaggcaattgattttatatcctgtcaaattaatgtataaataatgttcaacttggattcatgcaaacgattttctatatagctgtcttaaataggaatccttctggaatgtttcagaaagcatgtatcttatttggatgtggacttttaaaattatagtttcttgaaatagtaatatagtgttccgcccaagaaagacaattcctaaatataatttagactataattaatgttaacattgatggagtcaaatgaatgaactaactaatgatagtgccctttgctaatctgatgactagttcttacctaatggcactgggaaatatgtaaatttgtcagcaggtgaaaatgcccttgactgggtaaattatgtgcagtattcccttttctgaagctaattcaaagcactaatggacttaatacgtagcatgcatatgtgaggtgagctattcatggaaccaaattagctcataagagatattatccattatatgcctcctagtaatcatttcctcttttctcaaacacaaaccaacccagaagaaagatgctaaatttaattataacaactttatgtgaacaatgcaggtaagccatccagtgtgcttccaaatgcacttagaacctgtcaagcagtttaaatatttttatatggaatctaggggtttgcagctaatatatgaggtgaattttaaatgattttacagatgtcattgggaaagtgagtaatatgagtaatgaggtgactgggccagtgaatcatgggaacctgtcaaacatggggagatgtcagggaagagatgatatcaaatagaagtaacttagcaacccagcatttagctgtccagagaatgagcaagagtagcccctttaaaatagctgagtaaatttatcagttcctgtatatcttaggtatgctataaaaataagtctgttctctgtcaacctgtttctttttgtgaatatggtgatttgtgattttctattgaattggatgaaagccggtgagaatttaggccatgtgtagaatttacacctgttttctgtatcttgggtgtaaggagagagtaatgaaacaacacattgttttgccaaaaagcattctaagcttatctgaaagaagtaacagcttccaactgttgtctaagaaccagcatttttgtactagctttgctagtgggattgggctggggaaaggagaagtaatgcaaggaagttaaccattccacttgcatctgtgtaaaggtgaaactcgtgtctctgcaaaacacattgaggaagtagcctcttggaatccatttggtaggcatctcccagttttgaaatgaaagaaagaaggaaagaataaaacaaggcttgtcccttctctcgtttgtcattagaagcattcaggagaatgagaaaaataaactgaaactccatgattgatgtaaccaaagggtatccataagcctgactcacaatttattttgtgaaggtcaaacagggaagaagccaataagtgattcccatggtcttggatttgtggcatagtagatgtaagaaacactgattttcagaataagtggaacatggtgaaaagcaataacagtattagaataatgagaatgggcattaaagttggagatgggagcttccatggaccaagtttgggacacagtctcgagaagtagggaaggcaggactgaatgagaaattacataaatgatccatatttgtggaaggcactttgttagtgaggcaaggtggatgaatgagatgctgctttgcaagtagcctgtagggctgatgtttattgataacagagaagtaaagcctgaaagcatttgggcacacagccttgtattccgaagagaattcctgctagtctggaattcagccacagccctgactggtcctggaagaactcttgacatgaaaaaaaaaatagtaataaaaaagaatcaccacaagatctatgcaaaaaaaaaaaaatacacaaaaaagcatgtgagaaaagtgtaccagaaaaacaatatttttatggaaaaattaaagctgtgaccaacatagtggcatgaatttgttaaaaccatgaagcaattttatctgaaaagacaagaacaaaatcagtgatacaggaacttaaagatgctatttaaaaaatagataaatcaggaggtgtgaattaatgaattatgaacagaaaatcattataattaattaattcaagatccttttcccaaataaaacaataatacaataaaatagatacttggttacttaacgccatcaagaaaaaagggaaaacactaatacataaaacaagaactaataaacagaaataacctcagatacagagaaaactaagagaataatgagtagcaattttctcagctctgtacaaataaatataaaccggtggatgaaatggatggtttttctagtgaaatgtaattgacagagattaactccagaaaacacagaaaatctaaacaggcttatagccatcaatgaaatgaagactctccccaccccttaacaaaagcgtcactcccagatgggatttcgtgaggaaattaaactaaactttcacaaaatatgacagtataacttttacacgacatagaacaaaaagaaaaatttgcaaagtactttttagaaaagccaatctagcttttattttgatactaaaatctgacaaaaatagaacacaaaaaagaaaattgcataatagtatcatttatgattattgttgcaaagctccttaatgaaatactaacaaacagaatcagacagcactttaaaggatatacaatatcaccaagtgggttttattccaggagtgtaaaactggttcagtgttaagaaatccatttgtataatgccttttacaaagagaataaaaaaagaaaaattacacagtcatcttcatttagatgataaaagacacttgacaaaactgaatacacattcttgataaaatagaaataagtggaaacatatttaatgtgataaaatatatccaccttaacccaaaggctagtatcacatttcatggagaaactctcaaagcattctcattatagtcaagaaaaagactagatgttctttataccactatcattttatgtttttctggaggttagccaagacaattaaatatgtaaagaataagaggcattaaagtgagagataatgcttaaaatggttactatttgtacattatacatatattgttttcctggaaaccagaaacaaattaactgaaaacactattatgaataatacacaaattcagccaagttgctctgtgcaaaataaatgtatggcaaaaaatagtctttacatataaagcaagcaactataagatgtaatgggcaaaaaaatccttttacaccttatgaattgatgtaacaagaattgtgtcagagctgtataaacaaactaagtcactatgagagatgccaaagaatacttcaataaaaaggcatacaattcctgaaaaggaagacaatgtcacagacgtttgtgttctccctaagttaatcttggatccttacctcacgccatacaaaaacattacttctagatgtattaaagattaaaaacaaaaacataaaatattagaagtatatatggaagattttaatttatttttaattttccgatcaagtctcataattagatggcagggataagaagcagtcaggggaaagttcagaggttagaggagactggagaatgaaagagtaattgaaagagagagaagtctctcactctaagggaatatagtaagattatgaggcaacatcaaggctccaggtgatattgaagatattatatttatacaggtttcaatctgtagattatataatttcctccagcagtgcttatttcattacccagagaccacaggctaatgggtcgatgacagcctggaggccttagagaggttgaaaattgccccgaatcatatattcatatggttatgaagcagctaacacagaattggaactcatgttggcctgaacccaaagtacatactaatagtagtaccacttacctagcatttttttgtacctggcactgttagaagaatttcacatatagtaactcatataatcactatatcaatgccgagaagcaagtactattatcatccccttgttagataatgatgtggaagtactctgagcttaagtgactttctaagtttgacagctaaccagtggcagagccaaaatttcaaaccaagcagtttttggtgattatgaataatgtgggtattaataattatatacagatttttgcatgaacacatgttttcatttatctttggaatatacctaggagtgggatcgcagagtcatatgcttagagtatgtttaaatttataaaaaccatactaaattgcttttagagtggctgtaccattttgcacttacaccagccaagtatgaaagaccacttactcagcatgtacttatttcccatttgtatatcttttttgatgaagtgtctgttcaaatcatttactcatttactaaatcaggttgtctattaccttataaatgaatcttgagagcttttattgtttctggacataagtcatttgtcagatatgtgatttgcaaatattttctctcgggctgtggcttgtcttttcattctcttggtgatatccttctaagagaaaaatttcttaattttgataaaatccaatttatctttgtttcatgttatggattattattttgctgtcaagtcgaagaacttttgggttaattcaaggtcaaaaaaattctcccatgttttattctaagagttttatttaagtcttcattttggattaatttttatgtgtgatgtgaggtataggttgagatttacattatgttccagcacgatttattgaaaagattgtatttaatctttctccattgaattgcttttgcatttttgtaaaaagtcaattgaccatatttgtgtgggtctacttcttgactctccagtctcttctacttgtctgtgtccttgacctttcactaataccataatgtcttaatttctgtagatattgtaagtctgaaaatagcataatgtgaatcttccaactttgttcttttcctaaaatggtttagctatcctagttccttttcctttccatatgaattttagatatattatttatatttacaaagaattctgcttaaatgttggctagtattgcattacatctataaatcaattttgagggaattaacacctttactgtgtgcatctttcatctcatggatgtggtcaatgtgcctctccatttatttgggttggctactctatttttagagggacactggtaatttataatcccactttagaaaattcatgctatgagaaaaatccaagctcctagaaaaactatgtgaacaaaattattcattacacaattctttgtaatagcaaaaaatgctactatatatttaacagtgggagaatagttaagcaaactcagatttatacattcagaatcataaccaaccattaaaaagatggctttgccggtgatgtaacaacatgaggaaaaattatgagataatgtttactgaaataagcagaatataacattttatgtacttaagtattatatctctataaaaaatgactaaaaagaaactgaaggaaaatattttgaaatgatagttcttattttgttagagttagaattatgggtgagtttcttcttttttatattttctcaatttctataatttatattactttcataaaaatatttaagaggcaatttactcatgtaacaaacatgcatgtttaccccctgaacttaaataaaaatgaaaaaacaatttaagagttatattgctgaactaaaatgcacttagcaaagagtaaccaggatagtgggtagtttccaaactggaacgtctaaagagatagactagattaaacagcagaaaattgaactagaagagggagcaggctgtggctgcctgagagactaccctgtggaagcaagagactcagaggctgcatttgggatagaaggcctcaaatggtggaatccaacttttgaggggcacttatagagggataagtattagggcaatacaagcaagaatgttctggggggtggggcatcatggttaagacagtagagctcagctcttctcccttgctgaatgtttttgggtaaattaaccttttcgtacctcatttacaaaagtgagataatatgccctaattctcagaattatagggacaattaaatgagatgatgcatatgaaacctctggaatagtgcttggagcactcaattagatccttcctttctcccctgttctaattggtagatctgtccaagggtagaaggaggtgaggtctttgtcactgaaagtgttcaatagaggcactgtgctcccccagtacctagaggataaacttccaaacccagatcttggcagtcaaagtccttcctttatgtcaccactcatgcctacctcacatattgccaattctcccaactgtgtgcccttttccacatccactgcagacttctccccctttatcaaatgtgccatctcctcctctgcctctgtgtgctgccccctccctctgcctgtgatctcatccactcctgtctttgtctggtgacctcctatctacaccatgtaagatccaccacagagatcacagatattaatgaattaatttctctatctgtcttctaggtccccatagcaatttttatatatctacacttggcctttgtatgtgtgtatgttggggagttgcctcttatggtagaatgtgaggtccattaggtcatagtctgtgtggaaatccttattctgtctctttggccaattccagaaggcccccccacatacatgcacacaaaggtgacaagtgtaggtgcataaaaagtgcatagattagatgtaatgtgtttattaaatgacttaaatttttagaggaatggttagagaaaatgacctcatagtgttatttccacccaaggtacaataatgatttgattttccatgaaaatattacaagttaataagcagataatagtgcttattgagtagaataattatacaaatattaggcattttaatgactccatttcttatttctccaaatgatatattatcaccatttgtgtgctttttccattgccaatttctttttaagaagggcaaaatgccgcatgcagctccaatcgtttagatgtgtctggattcttggaaacttgactaccctatgttctcctagaaatggaccgtgagagcttgcttggaggttgtagcagggaagcacagctgctcctatacctttgacctaagaaggattcaactctatagataagcagtggtaagagcgagaaatgacacccatctagccagccagatcagttgaatcaaacctgacgttcagtggggtaacagatgtcgcagccagatagtcatcacatcctcaattgcaaattattatttaataccattgttatagtccatttttaatattgttcctcaaaatacaataatgctagcattatcagtgtaaacaaggtactgaataaagacagggccccatatgctactacaatgggagagattttcaaatctctcaaataatgttttggcactattcactgtgcttattatcactgtgatcacaagaaaagagcttccacaagatgtgttttcttccctaaagtgattcctccagggtgtgtgtgtgtgtgtgtgtgtgtgtgtgtgtgtggctgatagcctgtaagttgcttccattaaacactccattccccaaagcctttcattattggaatgaacacactaacacgaacagactcatcctgctcttttcctggcaacatgttaactggaaattgcagaatcataaaataaataactaaggccaatctaaaaccaaggtgtaaaaacagcatcctggctgtctgggcctctgattattttctattgaactcccttactacttctcaggacctgttgcgttcagaggatacccgaaaagctagtctatcctccaactttgcagcctcctcactgctctttaatccaggagctcccagcacatcctcacacccctagtgcttttgatgcaaaagtgaatagcaggtctgacacctggagaatccaccctgatgttagagcctggtctgctcctgtcctgtgttacagagtggagaccatgcagcatcggcctttgaaagaactgggattaagatgaaaacaatgtgccagtgacactggaccagacatcaagagacctcagagctagttctgaccctgccactaccttattctgtgacccttggctagtctcttaaccattgtgtgcttcaggttctccatctgtaaagtgttgaattttttgcactctccagtacagaaacaccaaccacatgtggctggctatttgaatttaaattaattaaattttaacaaaataaaagttcagttcctcatccatttcaagttctcattagttacatgtggccagtgtttgccatattagacaacacaaaactcagtatttccatcactgtagaaagatacagtgaacagaactgccccagatatctcttcagatttgctctaggtttttattctgagttttatcataaaataaaatcaaatattgttttaccttctagactgtgtattctagactgtgtttagagtatatctgattaatttatttcctcctgagtcttatatacaatacattgatcaaattcaactctggttctgagcagtgcccctactatataagacagaacaaaaaataagtctgagtaggtagaaaaagatacagcaagtattcccacaaaagagagaagaccagagaagtttcaggcatacgcctggtttgttgggcaatgcagggacccatgtactcctaactcaggcctcagacaaagtgtctttccctatgttcaataacattaataatgctttcatccctaggctctggaaataagagggtacatcagaccgttgaatggcccttttaggagagaaatggtactataaaaacccaggaattgattcatatttgcttcctctctctctctctctctctctcttcctctctcactctctcttccctgcactcttcagcttttccatctctttagacatccacctaaggtgcatcattaaaggaagtaccacagcagcacttggacagctccagtggctttaattgccccatttcttcattaaggggagttgcttacctacaccttgcacaggggcttgagatctggattattaacgttaaaatggactgagtcctgagaaaagccattcattgtacaaactttcagttatgtagggtaaataaattctgaagatgtactgtattatatactcaaaatttactaaaagagtggaccttaaatattctcacaacatttaaacaacaaataaaggtagctatgtgagttggtggacatattaattagcttgattatggcaatcattttacaatgtatacatacatcagaaactcacattgtataccataaatatatattaataatttattttgtcagttatacctccataaagttcgagaataaaaagccattacttggaatgcattctggtgacaagggaaatttaataaattcgtgcctctccttagggatcggcttatttttactgacttgccatttggattgtgtgaccctcacacttgccattgggttgcgtgtggcatgagtaagggcagtggtttcaaaacaattataagttgggttctgtggttcatgcctgtaatcccagcactttgggaggctgaggtgagaggactgcttgagaccaggagttcaagaccagcctggggcaacaaaaggagacccacatgtctataaaaataagttaattggctgggtgtggtggtgcacacctgtagtctcagctactcagggaggctgaggtaggaggattgcttgagcccaggagttggaggctgcagtgagccacgatcacaccattgcacactactcactctgaggtgacagacagagtgagacctcatctctaaaaccacacacacacacatacacacacacacacaaaatgatgataatgtacttcttataaccaccaaattataatggacttccagaaaggtgagggagctttgttcctgctacatgattggagttttcccttttggaaaacctgtcctatggagtatggtggtgcccaaagcctagagctcaaagccagacacctgggcagaggtccttgagctgcatgacattgtctccaaaactcagttatctgacctatgaaatgagaacaagaaaaactacttctctgtattattgagtggattaaatatggtaacataaatgaaacagtgaattctaacccccaaatacatacaagctcctattggattgttattgtgactcttcttgttattcagaaattccaaatattttcaaagggtcactttgaatttcatatttcgacccttcacagactctctatctgatttggccaaggagtttagattgcccctgtgattttcttgaatattaaatatgtaagctcctttcatgtctttaatagagtagtttttttttttcatttttgaccactccatagttcataaggcacattgcagcttttcaaattgtcaaatttgtttaattagcccagagaccctgcccggttggtttttgtcagctgtatagcagtctctgtgggtggcttgcaaatctctgaccagggttttttttttttttaaatcattttgcacatttctttccttctttaatacaaatcaaggagagactagatgagcaggaggcagtggtgggggtgggagtaggaaggcaacgtgctgtggcactggttgccaactggcttttggacaagagttacaaattgattacaagtaacagttggaatcccaggcctgagagatccaggtttgtgagtgtgttgcgggtggggtagagttctccttgagctatttatttacttcaagaccaatgtttcatttgcacactgaaaccttcctaggtaagggtttgacattgttccctttgaatcttctatttggtgctttgctaaatttatagccaggagtaaacgtattgatctggttacccaaaaagatgttttaggccaaaaaaaaggtagaggtttaaagaggatttagagacatccactggcagtggattctcagagggttattagggaagcttgcaaggggcggggggtgggggtaattggaatgcaccccttccttatggtgagtaaatgttttgaagtacaaatgtggatgccctaaaagatgtcaatgggaaactatcaataaaagaaacttttataatagtcttcttgtgtgattgttaccttttaattaaaaaaaaaaagacttggtagtgaaatccaataatcagattggattgatgtttaacaaatacttagtataaaatatcagatatgaatcaatagctacttgtagcttatgctggcaagtggctgtttatatcaaggcagagagggacctgctttcctgggtttaaaatagaattgaagctttatagcgtgcctgtggggccacatttttgtacataccactggcccccagtgttcatattgagtttagaaagttctccttcttcatcagtcaaatatccttttagaaaaagatatgcctctcacttgtgctgtgattttgccactgttaatatggaatacagatgctatttattttccgttatttggggaattgtagagaaaaacgaatctggggagaggagtccaggcattcagaaatactcaacctattaggggcttggaatacttggagggggctttctgaatcaatttcactgtgacttagtagtggttttgatgttgttaaattcagactactgcaaggaatttgatacctctgttggtttatttttatttttattgaggggtatctgtggatggggggcgggagagagggcctggtgttcagtagttagactgacatcttgtgatagatttgttagttaatttcatgtgaatgggacaaaccagttctctttcctgcccctggcactgtgattctaagattgaaatagctgtttcagaggaaagacaattccatgcaaatcatattggatggagtttcagctgtattagcggcctggtaccttatttttactgacctcaggaataatgagagaccaaagctatagccaagttcttaactggaggcttctttccacgaaaatagatattacttctttattccccagcaattgagcctttgtcccttctaaaagtagttgtcatgaactcctcattaccatttttcttaacgtgataagtgtaaactacaagaaagctatcatgtttgaaaagctacagcagcccttagaaatggaatactaacatgccttgtgtacttctttgaaaggacttagactgaggattgtgtgaaatgtatccttctgcccccctttgcctggagttgtcattctctagtacctttcacttatagcataagctggctttctaaaggactgctgtgttgttgcattgacaccgtatctctccaacaatgtgaaatcaacaaatccctttggcaatttctgaaacatataacaaattgtgcattattctctaaaaaaaatcaactttgatgggcttattttatttctacttcgaatggtaactggtaattgttattaccttactctcattccaattatcaatactctagctacagagagtaccaccagaccctgtaccgggacctagtctagcctcctggctgtcagataccttgcaaggagtagacactcaataaatgttttctgaatgaatgaaattaaatatagattattagaaatgctgctggaggagaagccaatgaaagtgtgtgagttttatcaagttggtttgcctgagctggtgctaaaggagcaaattggaaggtaaccattaagaaacatctcatgctgtgaggatatagcatgtcattccatcttttgaagtgactgtgaaaggaaaaaaaaaacatggctgtagtattatgaaagcctcgcgaattatctcaaatcagtatattttaagtgatggtcattggatgtagttgacggcaaaataatttgaaacagaagagctggaaattcaacattgcaattaaaaatcacttttgaaaagagttacaatgatctgatgtcaaaattagcttaagaatgtaagaaacaatttcaagggttagaaatgttaagaactggccctgaagaaaccccagaatcctcacatacctgaactggaccacttagaaaaagccctctaccttgattccctttttgatactgctctttgcagaacactttctcagtggccagttcttacatttctaagctttgatattgtgttaattttgcctgtaccaaacaaggcaaacaattcagtgttgttcaatctgataacatttcctagtggggtgttcagtcttctattctgactggttcaacctaatttagacaaagacaaaggtcttaataaagattaaaatttacaaggcaatcgtgtttagggaatcaaataccattagttggatgggccgtggcctgaggttgctgctgctgaaaccttttgctgaactaaaaaggtctggttgaattctgcccagtatatcactatagtgttctgttcccttgtatttacctttggagacctttctttgcagtgtttgaatgtagaatgcccgaggagtaactgggccaaaaaaagttgcatgaataggccctgcacatggtcatatatgttcctgttgtattcagtgggtgaaatggaattgattgcatctggcaatggcaagaagatggcttgattgattgcctgattgagtacacagtggagattcagaatactgatcactatacttcccaattgtacattataattagggctctttttcaatggaaccctggtttgggggctgccaggatgaaggcagccaatgtgagctgaactttttgcatgtacagattctcctcctggatccgaaggagaatatttccagattcccttaaacaactgccagcactaaagagtttgaatacagaattccattatttatttgaagaaacatcgccagggtttttataccatgccatttaaatcataagttagtgttagaaacttttaaaagaattgcattttgcattgacccattgttatgccatggccaagaagttatgtttaatgtaaccgttgattttacacttcctctctatgagcacttgcatggaaatcagaggagcaatctcaggagactgtcttaacagcattccaaatagaagaatattcattcaattgaatggaacagagttttgaccactagaaaagcttggcaggaatggctagtgatcaagcctaggaaagtctatggttccactgttgttagattttctaagagttcagcaaacaatcagacaaattgggctgttagctgtctcactgtgagacaataggctcccctcagcatgtttcccccaccccatccctgggagaatgacaaatttccttagtcaatttagtcagccgtgtttatatgtcatgcaaaacaactgctccagattcagttttgcatcttctcatatatatctttgactttacagaagtaaagtgtatgattatctgattaggtaaagcagtacagatgattcacaacacccactccgccaccttttaggaatcccttttcactgctctaggcagaggacatttcgccttcagagatgaactgctcactgccttctaagacagtaggctccatgattggaaacctcaaatgattggaaattctttagtagtttgagctaaaattggtcccctgataactttacccatacagccagtcctaaactcttggtccacaaagcaggtctcaaatctctttcatgtgaaagactttcatggatttaaagacactcctcactctcccttttctgtggactaaactttccctgtttctttaatgtctatgtatacatgagatgagctttccaagctcttaccattcagatagctgtcccttagaggtattgcagtattcccatgcccccactgagatgggacatccaggagagcactctgagagggccctgagaggaaaaagatcagtagttcttcccacatgccctacttccctctaagggaatttcgtttggaacagccaagctccctgaccctgagcaaagggcccctgtccttccgaagcctgcctgagggggcctagtaggagaaacaggtaagttcctgtgtctgtagaggctgcacagcagcctggctacattctggcacaccacactgggagcagcagcctgtgcagatcacatccagccccctgaatccttttacaaatggctgtgtggctccctccatgggcccatctattgggggaacctgcccccaataattcatcattatttcacataggttcttttctatttccgtaagtgtcggcctgtctgagaaataaagggaaagagtacaaagagagaagtttttaaagctgggtgtctggggcagacatcacatgtcggcaggttccgtgatgccccccaaactgcaaaaccagcaagtttttattagttattttcaaaagaggagggagtgtacaaatagggtgtgggtcacagagatcacatgcttcacaaggtaataaaatgtcacaaggcaaatggaggcagggcgagatcacaggaccagggtgaaattaaaattactatgaagtttcgggcatgcattgtcattgataacatcttatcaggtgacagggtttgagagcagacaactggtctgaccaaaatttattaagcgggaatttcctcatcctaataagcctgggagcgctatgggagacccgggcttatttcattccttatctacaactgtaaaaaaaaaagacagactttcccaaagaggccattttagaggcctccccttgggaatgcattctccttctcagggatgttccttgctgagaaaaagaattcagtgatattttcctatttgcttttgaaagaagagaaatatggctctgttgcacccggcccacaggtggccagactttaaggttatctcccttgttccttgaacatcgctgttatcctgttcttttttcaaggtgcccagatttcatattgttcaaacacacatgctctacaaacaatttgctcagttaacgcaatcatcacagggtcctgaggcgacattcatcctcagcttacgaagatgacaggattaagagattaaagtaaagacaggcataggaaatcacaagagtattgattggggaagtgataaatgtccattaaatcttcacaatttacgttcagagactgcagtaaagacaggcataagaaattataaaagtattaatttggggaactaataaatgtccatgaaatcttcacaatttatgttcttctgccatggcttcagctggtccctccatttggggtccctgacttcccacaacacccatcttaaccctactcctgctattgttgtccatttcctattaacacccccactgctgctgcagataagggtgctaatgccctgcctggctttgctctcctatcagggaggagcagagcatcctacaggctggttagcaattgatagcagattgaaggtcaaggaaggatttgtttgctgttctcctgaaccctagccccagggcagccctttctaggcatcctaagggcacttgcgccttattcccttgcatcctggtgcttagctgcttcattcccccttttctggctcctcacagaactgtcaggaaccatggatacaaagggtctaaatcattcattcaaacaaattaggtttttctggtaagtcattaacacctcctctatacacacacacatacacacacacacatatgtgtttttgtaaatgcataaggacctttagataaagaaacagattcagcagtctaataacaagacctcactcacataaatgttttcaggtttaatttagttttggtgacggaaagatgctgatgtttcttcatccttagtctgtggtgatttgtaaagctactcagtaggataccttttgggagtacactatctgtaaagcaaaactaaaaaataaaagaagaaaggaaaagaaaaactgaaggaaggaaggagggaggaaggaaggaagcaaggaagggagggcccctccaatggaagtcagacaccaaggttagttaccatgactcagttaccatgacttgtgagtcatttacttctgatttcctgtgaaaatattgataaacttgaacccgattttgcagatgtattcttctattcaaccatatttttatttgagccactcagctattcacgcttattcttaatcacaagaatttgtgaatacttccaaaattgcatttattacgttcttggtattttagtagagggaagggagaaaggtgtatgcaagctccatcttgagccttgggcagatcccaagctgcctggttgctaagccaaggcatgcaggctcatactgacaatgccatagccatacctgtggggctggtagcaatgagctttgaatgtgtacaacactatatggtttacaaagcccttacacaattattcatttgcttccccttatgccaagcctgtgaggtaggcagaacaggtagaatcagagatgaacggtattgctaactgggagaactagaagccatccaagtcaaagcccacatgttgtaagcaggaaagctgaggcccagaatggacaagcaacttgaccagggccacccacatagcttttggcagagctaggcttgagttaagttctccctatcttaatacttagtccatgttgcttttggggctctctctgactataacaacaacaatgaaatatgtgaactatcatcatcatttgcattcattaaggtggtcatttgaaaaatcgccctaatcatctcttcagtttgagctcttttacagtaagtaccttaatatttatgcttaacctaaacacactatttgagcagctactatgtgccaagtataatgatagcctgtaaaagggatacacacacacactcgcacacacataaacacacatgtgtgttcaaaaacactgctcctctcacttcaactattgaagccttttccaaatgcctagcacagtgactttccccaccaccttattctctgcacctttgctcattcccctctcaaggtgattcgcatgtcaggcagtgaacgcttcaaaaagaggtccttgactttatcatttccatgtcctagtgactggcttataatggctacacacgcctgtaatcccagcactttgggaggctgaggcagactgatcacaaggtcaggagtttgagactagcctggccaatatggtgaaaccctgtctctactaaaaaatacaaaaattagcctagcatggtggcacgcacctgtagtcccagctacttgggaggctgaggcaggagaatcgctggaacctgggaggcacaggttgcagtgagccaatatggcgccactgcactccagcctgggtgacagagtgagacgctgtctcaaaaaaaaaaaaaataaaaaataaaaaattagtagaacaaatgcaaagaatccaccaaacagatctgccatttgctgtgtgaccttggacaagtcactttacctctttgtgcttcaattccttgtctgtgaaaagggtgtgaggctaatccctgcctgtttagtttctggtacaaaaagaccaaccaattacttactacacactaggcaggagagatacaaaggtgaataaggtgaggcttgtgacaacatactagttacttgagataacagctattcaggtagctgtgtgttagatgagtacaggatccatttgagattagcaaagcctggaacacagactgtcttctgtccttcagcctgtggcatacccagctttcgtgtctaaattgggcaaagcaaggatacctgcaagtggttttggatttgttttgagtcctagccatgagctattgtttggataatatggtggaaaattgagccttttgtgattttgtggggtttgactttggagtcttcatatcacattaatataagtgtcttcctattattagaagttatgtagaatgctctatcacttatgaaatccattctttgccaaatactaaaagataaaacagtattccttagtcttttcttcattatccatgttagtcagtcttacagagggagacatatttgttatagtggaaagtgtgcactcttgtaccagtaatcaaacttcacttgctactaaatgtaaggctgtgtataagtgacctcacctcttggaacccccattacctcagttgcccgttgggaatatgaatccctgctttctgtctctctctgtctctctctcaaaggatcaaaggatcccaaacataaagcagtgcttccttgtggaagttcagaccagtctcagatgtgtgtgtgtgtgtgtgtgtgtgtgtgtgtgtgtgtgtgtgtatgtaacttatttttgttaaaagagaagtgattcttggtgttgtgtacaggtactcatcattggatcctgttataaagctgtggcaacattttgggagcaggggctcatccctacctgatgactgggtgaaggattagtaaagttgggtaagaatgcataggtgtcttatcttaggaatagcaagaacataaactagattaatatccttcaagtgttaatgaaaaggataacaatggaatatctgctgtgagtgtgccacactttacaagtctaattcattttgagaagtgaaagagcttgcttgctccaaagtcctttgaggaagatattctttcaggaaattatattcctttcaactacatcctgcctactgtaatcaaatgcatcagtggtaacatggactcagtgtgctgtttcatgaaatttcacattttcaaatacagtttgaaatcagttgtaattgaaaatgtagaagtttgtgcagttccatgtggattagctaacagggcagtgcactccactggtaattcaagataatcagattctgcctccgagtaaatacagaaaacctaggggaaaaggtacacttttgagaagtgactttattcttcccggtgtctgaaacaccttttaataaacccagaggcacacctctaaaatcagtggtgaaaggggataaaactaagcctctaatcaatttaggcatacccagtagttgctgaaaacagacaacactcctttttctggaagagacttacctgctgttttattgactctggctaaatatgaactatattttatttattttgagaaaaaaattattttaattgacaaaaattgtacatacttatggggtaaaacatgatgttttgatatgtatatacattgtggaatgattacatcaagttaatttacatatccatcacgtcacatactttttttttttttttttttgagatggagtctcgctctgtcaccaggatggagtgcagtggcacaatcttgacacactgcaacctccacctcccaggttcaagcgattctcctgcctcagcctcccgagtagctgggactataggcgcgcaccaccatgcccaactaatttttgtatttttagtagagacggggtttcactatgttggccaggatggtctcgatctcttgacctcgtgatccacccacctcgggctcccaaagtgttggaattacaggccaccatacccagtccacctcacatactttttttatggtgagaacattcaaactctgtcttagcaattttcaagtatacagtacattattactattaataactatagtcaccatgttatgcaaccgatcttcagaacttactccttcaaactgaaactttgtactcttataccaacagctcccccatcccaagctatatattttaaatgatctgactattttggagaccagtcttaatcaggaaaaaccatctaaattgtaaaagagatcactgagtatttttaaaactcagagtaattagaattactgttgtcacatatatttactttgcagccagttttgatgaatacatgagtaggatttgtcatgaatgttatcaactggatacaaatgcacaactcaaaaacacttggaagtagtctatctcttaagtaggttaagcatctcctctaaattgtgtatgcatttttaatgtagttacctcctcctttttaaatagtgctaggtaaaattcaatctttgtcagaataatacttacaaattctgcttcagcagtgccactgtgaatgaatctgtgaagtatctccttgcattacagctcttcatacatcaaagactctttttgaactgagtaattatagaaggaaaaaaaccttgttttagtgctacctgagagttcttattaatattacctttgaaatgactaattatgttacttataaagactggaaaaaaacaagtattatgtaacttactcattaaaaaagactttcataaattttgatcccctccatccttccccaaatccctactttatttctatcatgactttttttttaatgcttaatggttctatatgaaaatgatgactccaacacatgctgactccctcctgcttcacaaaacttatcatctttctgttgctgggattttgagcatgtgattcaattatccttgctcttagcgtaaagcatgttggccacatgccctaagactcaagtaagatttgaacagcacctctttcaaactgagtatttgaaagagctgagagggtgtccctgctgataacacagggtgggagcctaaggggcttttcctgttttgagacttgaactcacagatacactgtctatgtgtatggctgtgtggaaccgagctaccaatcacatagtaaccttctctatgaatgagaaagaattcccctcagcggcttcatctttgcatggaaaaacccacagtatgtgcatcatgggtcactaactgttgggctgtatcaagagaagatgagtatcagaaggcagcgacagtactgtcctcccttgagctgacagatcacacgtggaacaggataccatgagttacaagagccccaggcaatctggagttcctcctggaagcaccaacaatagtgacagtgtacagaaattgagcattagaagaaaagttgaaggttcccaataaatgaatgaacaagctgagaatgtctcagcctggagaagagacgatgccaggggataggattactatcttccaacaactgaaggcttgtcattcaaaagaaggagaagatgcattctgtgcagctccaaagtacagtctataagtagaagttcctgggggacaagtttttaactcacaaaaaaggaagaatagcctgatgatgctgtctcaacatggagcaggctacttcaagcagtagcaagctccctgtcactggcagtttgcaagcatctgctggatggtccaaatgactttaaattcaccttaagtattaggtcagttaagttaagttagtatttataaaggacctacactgtttagtgctaagaaagggcttgattttttaattgccctgaaataaagtttctttatttttcctcattaggagatgacccattcctggcctactcctctcacttccatgcatactgctggacactctgagcagagcaccttttccatcccaggacaggtcagttctcttccttcctgcatttttgtttgtcttattttaattataccaatcttccaactggattctcagtggcaaaaatggccttggtcttctagtgccataaaatctagactctcttgcccctcagaatagcaatataaaaataatttttattgaaagtgagtctttaaaacaaaatacacacagataccggcatgcgtgtcttactccatagggtgttgccactgtccaagtcgctgtgcctagaacagatgagacagagattgaataactcatcccttaagaaatatcaaatagatgatggaacagcaacgttcaagattttaaagttacaaaacctgtactctttaatgaactgattttcatttttatcaccttccagttcttgctcacaagcagacagatctttacaaaacaccacatcacactgacagagctttatcttctacagttctattgtcaaatgtttaatattatttttatttaccttctctcagcaagagttgctttattgccatcactttttaaaatgtctagacatggctattctaacatactttaaaaatatatataatgtcttcctttcttcctccattcctttcttccttccatccatttattcagaaatcatttactgagaagatacagtgggcttaaaggtaggggtgaagaaaaaccgtctacatgctatcacatagatcacaaaacaatgtagtaaatgtcttcatagagaagacaagactcagagtcgtatctaacactcccctggggagttgaggaagtgctcaccactgaggtggaaacatttaggggatgattaagactctgacaggtgaagaaggggccaagagaagaataccgcatgcataagactagtgtgagcaaggtcatgagagatgagggatcatgctgtagtgcatggtgatataaggtctcaagtggcaggattaaagtttgtgtgatggggagtggaaagagaggaaacctgggcaaataggtgcatatttggaaaacgccttggataccacctcaaggagtttggactttatttgtagaaggagaaacacccaaaggagaaacccttagattttagggtcatgattttgaaagtaacactgatctaaactttgcttaatgatcttccttcacctatgaaagaggtcagaactaaacgaacagctaatctcactgtcccagtatgggtgtgtgctattcctttttgcattcacacccaccctttttaggcttctgttctccttccccctggcatctccagcaaagggagttatccatccagttcaggtccaacacttgtacagcaattgcagtgttttcaggtgggttctccagttttgaagataatttgtgcaagttgcaattttgacatttgcaagtgtatacaatagaactgttgtttaaatgggcttttatagttaagtgcacactttgaaatcaggcacagtttgcattttctgccaattatctgtgctaccatcaaccccatgacaaaggtagaagcaagtggactaaaatggtgaaagcaagaagtctacacacccactcctgtctcatttgattcctgccaaaacgttggtttgaaagaaaagtacactttaaataacaaccaacacatacaatggcaccatgtgcctcacgtcattctaagcacttaatatatagtaaataatttaatccccactacaacccaaagagattggtaattttactaccccagtttacagaggaggaaacatggtagttaagtaatgtgctcaggattatccagttaataaataagggaaccagtacttagatccaggtgttcctggcaccagcggtcatactgtctctctgtatatcttttatcacacaggcccactgatgccccagttcaaattctatcttccaaaacatggccatccctatatgtaacaaaggtgatttccctttcctcagtgcttccaccagaattaggtgacagcatcctttcagaaagcatcagtttcttacatccatgacagagcttgcccagaggaaagagtgctgtcttaagagctgccttcccagctgcttttaatcctggcactgccatttgcttgctgtgtggtcctgttcaagttcctctaaacctctgtttccccatctgtgttggggcatggtgtgtgtgtgtgtgtgtgtgtgtgtgtgtgtgtgtgtgtgtatgtgtatacactatataatcccaatggattttctaggtaaaatagttgatgattctgtaagcttactaaaacaaatacagttgaaaattctcaacttacttaagcttacttatcagtttcaaattgaaaatgccatgttttctcatagacgatgaaaaacctcacaaggaagggagtaagtgcatgccaagtagaattgagagaataatcatatcctcaggagaagtttaataaagttttcctggaggtaaacatcctctagaacagaggttggcaaactatggcccataggtttttacatctttaaagggttaacattttcaaaagaaaaataacatgttattatgaataatattcacatgagtgtggaattcaaatgtcagtgtctataaatcaagctttcttggaacccagtcacacccacttatttacgcattgtccatgactgctttcacactacaatggcagagtccagttaattatgacaaagatggtatgtctcccaatgcctaaaacatctactgtctggccctttgcaggaaaagttagctgacccttgctctataatctagatcctttaggaacttctgattttaggattattgtcaaggctattgcttaaaagaacctcatataagtttgtgaaaagaacttggcatcattatattctactgcaaaaattacatatatgacatgtctatgaaagaaatgcataaagcaaagtcaggcatttaaaataaatttgtattatttgttgtgcattaacaattactgtgagaactgtgcagattatttctacaaccaagctatttccaactggggctggatatgtatgtaaagtaactttggtgatatacaaaggagtttcatttgttttgatttgatttgtagtttaagaaatgtgaaatccaatgcataatgatcaaaacatcatatgtacctcataaacatttacacctactatgtaccaaaaaattaaaaattaaaaaataaagtaaaaagaagtgtgaaattcagtttaacattaaaaattgtatcaagaataaatatcagttactccaattcagtgaataacacaatcttccagtttgctgtatgcattgttgcactgatggtctggaagaactgattgtttaggtgtaaagtccaaaacatttggaggaaggttaaaaattcaggcataagaccagtacaaagacggcctgcatgttttactctctgatcagatatttggcttaattgactttggaacttgtcatttaatttcctggaggtatacaagcccaaactcatcctgtacctttgtaatgaaatcccttaaatagtaacagataaaaatacttgtatatagttacagagatatacatggttaacaagtcatttatttgacactctggaaaatgagatgttctggataattaaaattattggataactgaaggttattattctataggaatcatgcagtataaattattttgaagtgtaattaatattttcctgacttcttttaaagattatatcaagcatgctttactctttcttgataacttatatattatgatgagtgtaagttattgtagtatgtgtaatattatactatgctgcaattatgttctcagggtctattaagacaggtgggaatgcttgcctctatattaaatgactgtagattcttgtgctttttaagttcagacttttctgtgtcatttttgtgggctcctttgctattggttttcacctgtcaattttctcagtgcctgtgcctctagaactatttccccttccttgccatctgtgatttgaaaatgagtgggaatcatttgagtcctttgtcaaaagacagttctctaccagggagagcacagaagcctctgagcagcaaactatatgggctttgtgacagacagttctttctctaagaggccttttctgcctcttgttgagtttgtggtaatcttctggagtggtgatcttgccagaagacaaatctcttgagcaacagaatcatactaaatagatgggaaatttcacttttgattaaagcaaagtgttatagttcttgcttactttttataaaagataatgctgtgagcctagttttcatctacagagggtcaatattaggcttaataaatagattacttggaacaatgattgatataactaattcttgtatttacttgaattcattgtctccagtttctggaatgcctgtattgcggtttgtaccatttctcttccatccacacagtgccatgtgtgccctgaacgttactgtaatgcttttgccttcaagttttgtcagtatccacacaggtgtgccacactccaagcaaggcagcatgtgcaaatctggatttctcaaaacagtgaatgaattgtgtatagtgtgactttcaaatcaaatttaaattcctttaaataacacagtccactaacatttcacattgctttctatacttcgacagacttgcaatgtagttttaagaacacttcttatatataaaatgaggtacatctgtgcacatgtgtcatagaaagttggatctgtttctataaaagggaaaaactgggcagatctattaattatcattttgtttacagttttacaaaaaacatgatcatctgtttgaaccaagtcctctttattcttttagaggcatcgttttccagctaagtgagaaattatacacttcaatttcacacatatgggtcatttgttcccatgttacacacatttccaaatagataccagtcttacttataattttgattaaatggcagttatgatcatgttgcataattttgattaaatggcagttatgatcatgttgcagcaggtttggctggcaaatgtttatccttcaaatagagctatagacaaaagcctaattaatggaattgttaacagcagcttcctatttgcaaacattagtcaactatatcttcagcaataattaatatacctcttactctccttgtgtcatttaactaatgtttgtgtcatatatattattccttataggaatcgcagcatctgaccccaggattcaccttacaaagtaagtggttttgaaaatccttcttagtccaaacatccatgtcctctgctccctcattttttcctttttcctacttaaaatcattaaaacatgaaagaacaacaataacaaaaagttattttaattgttaatttttagctctcagaaataagtgagaagatgtaaagtttgtctttctgtatctggcctttttcacttaacataatgacttccagtcccgtgatatatctaactggttcccccccttttttttttttaatctgttacttatctcaagaaggtaactcgggggactgcatgtttggagatcaatttaattcagaataatcatttgacagtaggaacatgaacagtaattgtttatatcttttcttttcagagtggaatgacccaaccaccagagcttctacaaagtcagtgtctttcaaatcgtgagtagttggatctccaaatcaggcctttttggggatatttggcaaggaaacagtgcctcaatgctgatctaatcttgttctctcctctgctccttgaaactatgaaccttgactcataataatatgtagtttggttggggtggggggagaatcaaatttcccattgtcttagtctacttggactgctataacaaatactataaacaacatggcttataaacaatagaaatttacttcccatagttttggagcctgagaagtttgagatcaatgcaccagcataaagggtatcttgtgagggaccatttcctcatagaaagctgttttcttactctaatcccacatggtagaaggggtgaggggtctctctcaggcctcctcttataagggcagtaatcccattcatgagggctcaactctcatgtcatgatcccctccccaaatacccatgtcctaatactatcaccttgggggtgaggattttagcatattaattttggagtaatacaaacagattataggacccataataaataaataacagtaaaagttaatgagatcaccattaagttctctaagtttgtaaatacagaccaggtcaatacctgggatacgaaaacaactgtgatttcagtgaaaaaataaatctctagatggcttgtttcccacattttaactagttcaaacactgtatagtatcagctaaagacattattttacacaatattcagtcaccactgactaggatggacgagggaatctaagcagccatgattggacatgaaatgttgagtggattgctatggccagtcagcccaagacctcactatttgcaggtcatcaggcacctgtatattaaagacaaacaagggcatccaggaagagccggaataagatattacatgatggtagtttgaagttcagaagccagggccctgcaattcattcagcactgtcttcattttttattaatgctaactgaaggaggggtttggagaaaccaatttcctcatattaactattgtagattttctaatatccatttgtccaagagagtatcaagggagtattatttctctcacaacttctttcatacctaataatagaaaatggaagtcgatttttttgtgtaataggcacatacttggaatttttcaaaatgaaataatttatgacattcaagtggcctaatggcacacttgaagtgaattgctcaccttttggaagatcatgaataattgcataaaaaaactgggaatgactcccaaatagactgaggatttgagaaagtaagtggcatttctacgttcttggtgcagtgcagtagcaaagccccaaagccctgaccccatcactggtccatttatttgcttttctagactgatctgtgccttctaattcaaagttcaatttcaacaaccaagaattctcaattttaagaagcaagaaaaaacaagagaaggggataataaaaccataatcccgatttaaggaccgaattatatgaaaacacaaaaatcaaaatcatctttgatgctgtatgttttagcttttccattaatcacattttgaattgccctcccccttgttattctaggaaacaatagatctaatcctccctgctttcactcctgcctcacttcatccccattaaaaagtcaataagattcacacacatacacatacacacacacacacacacacacacacacactcacatgcatttaggaaatcaacacaagtttccaaacttgaaaaaaatataaaaatagattttcctatgtaaaattatcttactcctaaagcaagagtattaggctcccactgtgaaatatgctgctttccatatataccatagaatgcaatgtttcagtagtttgtaactaacagaaataaactcgtcaattgtggtttatagttagaggctgcatttccagagaacagcacttcgtagcacagtaatatatagtgtagccaatacaactaaaatactctatatgaagcatcagtaaaactagaagacactgagtccattttatgaatgagctcctctctttttgtctgtttgatctaaagtccaagcaccatccatcagattttagctgcaataagttcccttcttactgtagggtatgggtttaacataggacagatcagaattgtaataaagttatttttatttttagcttccaacttatcggcttagccattactatcattctcccacatttaactacagtgtgctttttaaaccacctcctaggattttccatttggcagggtaatcctccaggtgattaagattattctgagtgcagacagactgctaatgcctgcgccttggtgagaagcagcccgtaagtcagccgtgatgcaggaaagacccaaggccagaaagtgtcccaagcacactcctgacacttagtgcagtaaagagagattagagtcttgtaaaacagaatcccttaattactgggacacttcattacttttcctcatcttggcctgttttccctagttgacaaaatgcagatcttccattggagtatgcattgtttataaggactatacacatgggcaccaggtctgaaaacattggccacagtgtgcctgagtataaacttgcaactagccagtctccctctttctttttgacaattactgctgtctctgagcctgaccccaacaatatgactggctttttggaaaactgggtattttccttctcagtatagtgcattggcatacagtgctttttatcagtgtccattcatgccatgacatcctacctgcttcagctggaactctgaatgcttatgaggcaagagtactgaattggggaagtttggagacctaggtttaatcccctcctttgtgtcagttgtgttattgtgggggaaagcactgacctagtatccagaagatatgaggttaaatcacaggagaatttatttttattttaaactatacagacagagtctgttaaagggaattaaacaaattaatgagtatatgtgtctacacatgcaggtacaccaacaaacacttgtcagtgttcaaatttaagcagttatactttttagtaattaaatctagcaacataaaaatacatttaactttaatcattaatactttctggaggagaaaagaccagaagttggtctcccacccctcagcctctatgattctgtgctatgttacagtcttggaacaggccccacctaggtcttcttaatcaaacggagtttctaatctcccccaaaaatgtctctgtcccaaaaaagagggtgaagcgtgggcataagaaggtgaaattgtagttctcagggctgtggagttgtatgtttacacagtaatatcatggctgtctattctgtctcaaagagatctttttatttcaatgacaggattcagactgtgaatggactcaccagacattgtgttgctttgtagtttctctttctttttctttgtttttccccaagatagagtctcgctctgtcccccaggctggagtgcagtggcaggatctcggctcactgcaagctccgcctcccgggttcacgccattctcctgcctcagcctcctgtgtagctgggactacaggtgcccgccacctgtagtttcttaatgaagttattaaagagcagtgagggagaaaacagaaaccaaggtgaagaacttggattttctttgttcagttggattgattcatctagtgtattataaatcttgccacttacctgtcagttcagtggccttcccaaatgcatgaccttgttggtcttttatgggacatcatacataggaatagataagatgttattaagttgccccgaaaaggactttcaggcaggttccatgaactcaagggtgtacatccagttagttcttaacttcagttttgtgaggactgttgaggagatggcagctccaaatatcaagctcctttgtaaaacttggttgttagcatttggactatgtccaggtggaaaccatccagacccccatttaactgagcagctcctgtgttttaaaccatgctgtcgagaatgcctggatagtttccataaaatcttaatatagccataatgttggttttttttaataaaaccagtttgccaacttatggtattaactatatgttttaaaacatccaaactctagatccagagagttgatggaaggtcttatggagacagattggttgaggccagcctgagtttacatgtgggtggttgttatgcatgtcacatgaagacatccttgattgtagcaatagttaggaagagagggcactatactatcacaggaatgacagacacaaataataattattgtgctgttgagaacaggtgccaggtgcttttatgtacattgccttattaaacttgccaggcatcgtggaggtgctccaaattattcccatcttacagatgagcaaagtaaagctagaataacagtccttcctcctgaagtgtacacagtccagtaggaagacagactggccatgcccacttattttgaatggatattttggctacaaacatacagaagagccctctgagtcataatgctcctcagtgagaaagtttgaatgcaggctaagggccctgtgagttcaaagctgtctctcatcctgctgagttgcctttcctcacgggatttgataagttcagggatttagtatgccaaagttttccttttgtacctggacacaacattcccacaacctggtgggatgtagtcccacaagaaattataccgctctgttttcgatgacacaaaactgggtcaaaattgttttatgtaatgaaaatgtcattatttctaaagttttctgtaagtgctatgaaaatttcattaccaaagagaatagaaagactgtgaggatgttttccagattgctataaccaatacaggaattacattatttttagatcaattttgaaaatatttttgctaaaaaacaattgatattcattacaaccctggccatccttttaccaaagccttcatcactggaaatgtttccttcgagattttgatttgaaatttaagaactgcaatgcattattgcagagcaataacccactttctagcaatttcatatattcttccccatgtagatgtttgatctgctacttggatgcaatttcggtagcaaattgactgtgtaatggggcaaggaagaaatgactgttattttcttaatcagattaattcttaatcagaatacatgatttggtacttggaatttaaaaatactgctaatcagtttgaggcttataaaagccaaactaactctcctgataaactggtaatcttggtaactttactagttgcagacattttggtttttaaatcaagaagtataccaactcttgcttttaacttgtcttgtatgccctgcatctctgagcttgccaaattttcctaaggacttaatatatttttggaagttctccactgcatcaggggcagccacctgggagcagagaaaacaaaatttggcagcctgttcaagctgtgaattaaaggtaattcacagtttgaaatgaatcagcgtgtggtccttgagaagagtaatcagacatcaagaggattttatgttgaggattgtatattggctaatgtgacaacaagcaatattggcatttggaatgtttgcatcaagaagcactgaagctgccggggcttgatgggtaccaagatctaaaatgggggctcccttcaaagagagctgtagatttacatttctatcacaaaagctgaaaacagagatgggttggctcagccatcatagttgaaagattagatctgatttttgtggtggtgttcatggacctaagtctatcataagatttgtgtatctcagatggcttttgagacacctctgtaatggaaagcaaatgtctctctctctcctcccccccccccccccccccccccccgctgaccacccctctctctccttctctcttttctgtctgggaaaaggcaaacatcgcttcctttctactagatttcattttttttttcaacaaatatgcattcagtatctactacatgtaaggttctgggctaaaacactggtaactcagggtgaaacactgcacatcattgtctcaaggaattcatggtctagtgaagataagactagcaccgacaatgccagcaacccaactaactcatacttattgagtgcctactatgtgccaggcacttcccatgcactttttctccttacaagcaatcccatgggtttcatcatcattatagtgtacagaagtagaaacccagctcagagacattgaatgagttgctcaaagtggcacagtaacaaagagggaggcagaacaggactgactccagaacatatgctcttaacttacactaaagccatcccatgagtcatttggaggtggctttactgatttgcagtcaggtgtgatcttgcccaggcattaggccaaaatggactaaccacaatgcaagccaaaatggcaatgccattttggtttaaatcaggggaagtattagatctaaatattataactgagttaggtcttgcatatactacacatgctgacatggacactgaagacagatctgtcctcaactcagggcctgcatccagattgtgtcaccaggactctagaatattcccttcagtgaggctgaaggatctattcctgcaagagacttagaccatcacaaaaataaaattcatataagattgattttggtggcatatcccttcagaaatgtccattgtgccacattaaagtgaagagaaaactaatatttgggtctatttttataagagactcatccattgcctttcatgcttaccaacttgtttgataattagaaagtggctttatatcctcatggtgaaataattttcaaaaatatccccatctgttatcaaccacagcggcatatttccaaattcttctcagcatttttaaacagtaactgggagtgaagcaaataatgctggtggaaggcactgaaattgataagcaagggaccaaagttaaaaaaaattcacttgtataattgaatgtaatgttgtgataacacacccccacacacacacacatgcatacatatgctctgtatcccagaacagtaggtcactctaatgtctgatctaatgagatgcacacatagacatatgcacactcttttttcagttattacattgtaaagtgctatgatcagagatacttttcatgtgcacagtgaatgataattttaacacactttcacacaatacattagcccatgtgagtggcacagcattcctgttagatagccaattgaaaagaaaccaggcgtagggaggggaagatattttcctaaagtcctccacctagggagtggcagggctgggactagaagccaggattctgcattctcagaatatgctgccttgtccccagattccccagatggctgcagggccagaactcatcagagtcctgacaagtcttccaggcccagatgaagaacatataacagcagtgtagacaagctccatggattatgcttagaatttataaagaaacaaacaaaatccaactgagactggagtagaagagaagaaatatctacttctgaactattcattttgtttttccctcctatcaagcatctcacaaacagccagatcctttaccacaattaggttactgggaatgttaggtttaaatagtctgctcttgacaccttctcagagttgcttaaagcccctccattttacactgacgagtagggagcagtgttggtagaatactgcagatgcacacaaaattacagctgtaaaatcagttgaagaatctgacaaatgcctttctttgtggttcatccacccactttaacaatgtggaccaaaaaaggaaaaggtctcaaagctatttgattgacatctacaaatatgctgccaagactggaacagagtaggtgggatggagtagatggggttggggtaggtcttctgaaaaccaaaagaataaaatttattttctttgctaccctgtggttttttgacactgaagatctacagtacaaccccatagtatactgccttgtccttgccaaaggttctagggtccctgagagagcaataagtgagagaaaagtatccagagaagagtagaagctaacgatttagcaacctataactctgacagctccattgcctaatttctggagttacttgttttggcataagaagcccactttataaaaattccagatggagatttcaattttgtaactacatagaatatttcttctttttttctttttttttaacttttattttaggtttgggggtgcatgtgacacgggggtttgttatacatattgtttcatcaacaagttataaagcccagtactcaatagttatcttttctgctcccctccctcctcacaccctctcctctcaagtagaccccagtatctgctgcttgattctgtgtgttcataagttgttaacatttagcttccacctgtaagtgagaacatgcagtatttggttttctgttcctgtgctagtttgctaaggataatagcctccagctccatccatgtttctgcagaagacatgatgtccttcttttatatggctgcatagcattccatgggatatatgtgccacattttctttatacaatctgtctttgatgggcatttaggttgattccatgactttggtattgtgaatagtgctgcaatgaacatacgtgtgcgtgtgtctttatggtacaatgatttatattcctctgggtatataaccagtaatgagattgctaggtcgaatggtagttctgcttttagttctttgaggaatcaccatactgctttccacaatggttgaactaatttacactcccaccagcagtgtgtaagtgttcccttttctccataacctcaccagcagctggttttttttttttttttttttacttttaaataatagccattctaactggtgtgagtacatagaatatttttctatttttcaaaagaaaaatcttttaaagtacctattcctcataatatatggaaattgtctaggccatctaaaaattgaaagggtcattctaggtttctccaaaataatttttgtatatcacatggtacagaaagaaacgaagaaaacaatctggatgtgagcagtattcttgggtaattgcaaccaccacttttggaacctactatatacctggcaccatgaaatattttataagcatcagctatttcatgctcacagcaacctcgtgagatagatttcgctatctccatcgccatcgtcaccactatcatcgctcccaggattgtactctcaagggctcagagagaatgccaaacacctgtggctgcacagccaatgctggtagtcatatttgaagtcaggcctgcttggtgctctttccactgtgcaatttcactggttcacttgtttaatcaccttctaggctcataatgtctctgagaggttgataagattaaactgattttatggagaaggaaatttcgtcccagaacagttaaatgacttgctcaagatcacacagctagttgttgagggagatgaaatttcactccaggattcttggattacaaaattcaaaccttttttaataccctgtttgcctcacccacataaagtttcaactgaaatcttattaattgttaaatacgaaggaaaaataacaaaataatcttaataatactactttctagttctttggcattatgtgttttctacacatattgttatataacacataatatatattgttatattgttaaatcttttagatttggtcttcactcaatttctggagcaaggagacaggggagggagccattattgtcctagagaggtcacagatgtggggcatccatttctgagtggcttaagttccagcgctctcactcccctgtcatgtgacttgatgaatttatttggtgcttttctgagcctttgtttcttcatataataaaacagagatgatatattactcagactctgtagcgaattgtgttgtcaacagatgagctcatgaatgagctttgcagtcacctgctctcattggttctctttccatgttagaagtgaggaaagtcatgcccaggtgacctaagtgaggcgtcccagctcacacaggtaatagtgttgccaaagctcagtcctgtttcttgactcctagttgagtgctatttttgctaatcttggccattatttttcaaaagtgttctgtcaatgcagtttaaatcaaaagatcaactgccaatgctgtcagagagcgatagacttaaaatcaataactatgtgtgccactcctctcctaattagatatccccagcatgtttctggatgtttcatgctgctgagaagagtgacggcatttttccactcaattatacccaaggaaacattgttcaatttagtaatagttttagcacttgtagaagaatttgaaaactttagaaaaatctcatacgttttacaatctcactgtcttagagaatgggatttgggactaggtctaccctttatcttcatgcttttatgcagcgctttaaaattttgatattgaagagggcctgaaactgggtgacctgtgttgccctttactactggattaaaatttcaggttgctactatggtaaccgtaccttgaaaattagatcctgacagagtcactaagaaatgtaaaagtgcactgctgccatgaactttgaagaaaggttgcatacaattgtcagcgacagcctcttaattgaaataatctgcctttcccatctgctagaaagagtttgtgtgtcttggggaggagggacaaaaagattatatcttgatggatttttaacacaaaaatggctgtagttcgaagcagagctgttttctgcatgagatttaaatcaacttcagctcaatttatgctattcagaaagaaatgtgatactcagtattcacggtggcaagaagccaagatacacagtaaagatgtaacgatactaagagaagatactgctggggatctatcccagaaaaaccccagtggccccagggtccaaatggcaacctttttcaaaccacagatttctgtgcccaggcttctgggaagttggggaatgcagagcagccgcatgacagactttcagatcaagagggccagcagtcactgatttgcttagtggcataaaagctgagatcatattgatgctcccagagccagggaaatgaaacaagcaacatagggtctcttggctttcaggaacatgagggtgagtggcacttgcaatttcaggaattcctttgtgcatgtctttcccaaggcaagcacatcacggtgtgtctggctttataattagttgtggctgtatctgtgtttccataacaggacttttgttgttgttgttattgggcctttttcttttctttatttttttcgacattcttataaaaggattttgatttgtgcttctaatgccacacatagaaaatgactctttaactctctgaaggtctcaaaaatttcagaccaaaagtgatgttctcactctgagaatgttggtatactattttgcacaaaacagatatcaaatattaaatctgttggacaatatcaagtagttgggactgagggatgtggagccataggaattctcaccacctagtggtgggacagtaccttgaggggtagttctatctaaagactttgggtagaatcgcctctcacctcatttgcgagtctcttcattttggtttggtcagcatgggtactaaggagactgtgatagtgacgactgaattgtgatatacttccaaacccaagcaatgcccatgaaagcccaacaaagacatatcaccagtcttctacctgtgaggactgtggaaccacaggtagcaggatgtttgactctcctgaacataatagtttcacaaatctatttacctgagtggaaggggtggtatccactcccctatttcttcagcagccggtacaggaagaacctactacacaacagataaccagaaaatattcttgagtgtaaagtgaaagaatgatccagaaggtgtcacttgctctgaagtaacttttttttaaatattgtattcttatatttgttaatccatattttaaaagtagtatcgtaagaagaaatataaatgcatgcatgtgtgcatatgtgtgctcatatgtatgtggctggaaagcaaatacaatgcagaacttgaagtggacaggctctgtgctggaatggctgggttcaaatcccagctccaccatcttttagccatgtgatcttggtcaagttacttaacctctctatcactcagtttcctcatctgtaaaatggtgagtagtaatagcacctacatgatacgattaaatgattgaagtgcttatcacagtgcctggtacgtaggaattttttgataaacacttttattaatcatgttcatgattattgcggtcatgatcactgagtcttttgagtgagtgctgtttgtactacattccaatcttcagtcacttgggaagcctttcactctcttccctgacttgtcccagaggtctccagttggagaaagacctctccagaaagagcaaacctggactacattgaacatttccttggctcacctgcctaccccagtcccagaggataaaaacaaagaatggctagaacgtcttaaatgtatagatatttggtactaggcacagtcttctcgttcttggagctcaacacagcatcttatcccagtcacaattgtactcttagtttgtagttatttctaaaaataaaagctaggacttattaagtgccaagcactatgctgagtgttttatatccactagctaattgactatttacaacccagtgagatgtaggcactaccgttacccacattttacaaatgaagaactgggtttcatgacttgaagctaaatttttatagccagtaatgatggattcattacttgaacttatgtctggttgactccagtaagagaccccttaaccctggccctcctgcctacccatggactctccaatctcagagtccacctggacttgattgtcttgggaaatggcaccacctcctcagaggtagtggagcaaatacaagaatacaagagggagaaaacaatggaggacaggaatttggccagagatattctctgctcctgagtcccaaaacatcctctcacattttgtaaaatcaccactggtataatttgctgagtcataatttttaattctgtggttcacatatatatgaaaaactgcttttgaaatatataacaagcatgttgtcaattttctaatcaggtggaacaaattcttttctttattcccagtttttgcatgcataaaggaagtcgtctgaataagaaaacatgtcaataaaatttcatggaatagcctctgccattctgtgaaataaacattccattcccttgcctgggcaaattgttcctgttgctgcatatctacttctgtttccttggtctaaaaagacacttcagactctgcctttaattacgataaggcttgactattaacccttgagaattaaccttatttttgctaggagggaaggtaaaataacatttaaattggttttaagagtaggaatggaatctcagaagacacactaatgtagaatacactgtatatcaaaatatataagtgcatagttgtaacagtggcttagtaaacatattgctgagtgaactatgaaaaataattcaccaaggtactgtttcccatactcgtaagcactaagttaagagagtaatgccataaagtacatatgcactgtttaaaaatatttgtgtgttttttaaagaatactttcttcaggcccaatagacgaatcattttttcttcccttgctaaaatgtacactgtaaggaatttaactaagtggtatattaagtgagggtctaaaatagttgtagaagataacaattctgagcaaagaaatgtctttagcaatttgattctgaatgcaacataaattaactttataaaatagaattaaaagaagttcagttatagctttccaatttttcatataatttagcatttcatactcattgtgtttgctactggcacttttattataaaagcctgaaactgcaggtcaaatgagtacttatgtggatataaatacactgatttttgtttttcagagagagatctttctctgaacaacatgatttatccaagttaagagactacctctgtggaagagcaactctcttgaaaaccattcttcacataaggttttatgcaaaactcctagaaacctgttcaaaaattatagaataataggaggtgttcctaagctttcaaccctccaatgctcttgcttaaattttagatctcaactaaagtaacttgacttttcaaattatgtttcaattcaggtttgttgtcttttaattccatattaaaaagtttgatgagattaggatgagaagagaggggagatgataaggcagttcattatgcacatcaaagcatttcaaaacatatctggtttaaagccattaaataatttcccaaatttgaacctgtggtataaaactctttttttagtctaattccaataacgtaaatgggatacatgaggaaagatttcaaagcaacgtttcttataaatagaatttcaatagcttctccttttaaaaggaaagcaaggggtaaagtggatgaatcatgtcagtctcccataatgagaaaacagagaaaatgcacattcacatgcccaccctattatggtgtagtttggctgcatgatggttattactgaatgattataatacacaattttacatgggagataaaaagaaaatcatatatagatgttttcccacttgaagcaaacctctcacagaaattctagcatatatttccatacagataaaaaggtagtttttcacccttaaaaagaatccttcactttgaaaatgattcaccatagtttccctctaaatagtaagctcatctcatgcatttacaatatggtttgattttcaaaacatcaatttacatgcactttccagtaacaaatctattgtgccatgtgatgcttacttgtataggataaaaaagcaaaagtattttttctaattaatacacaatattataatgtacaacatacaaatatcaattcgttttgttcaaactaataataagtacttggaaatggagatgcaagaaaaccccacttcattcacaacagttatatggatttacattaaaaaactataaaataacaccgaagtacataaacaaggtttgaaagaactagaaaggtatatatgttctcatagcagaagtgttatagtgttatttctcccaaaattaatttataatgcaattccaattagaattcctcaaaatgattctttttggcatgagacaaattattgtatagttcatatactaaaagggtaaatgctcaaccatagtaaatgaaaagaaagaacagtaggaaagattttcattactagatatatgaaaaaactacaatacgctttaacaaaatcaatacattattagcatgaaaatagatactagatcaacagaagagacaattcaatctctctccctatatatgtatgtaatatgtaacaacagcattacattgattcaaagagaaaaaaattgatatgtaatgatgatactggcactactagatctccatttagaagaaaacaaaggtagtttcctatcacatttaaatatattaaagtaggaagagaatgagaaaaaataactaatggttactgggcttaatatctggatgattaaataatctgtacaataaacccccatgacaggagtttacctacgtaacaaacctgcacttgtacccctgaaattaaaataaaagttaaaaaagatacaaatataaaatataaaacaacaacaatgaaaatacctttagtaaaaatgcttggaactctgtttctacaatctaggggagagggtccttcttaattaagtcagaaatccagaagttctaaaagatgaataactataaacaactgaaatataacatttgtattgaaaaagatgccatgtttctataaacaaatggaattttcctacatacaatgaaatgaaagtttgtatgaataaaaattaagtttttatgaagaataaaataaaaacagaaaaacaaatgtagacaaatatttgtttaaaaattattaaaatgtataattaaaaattaaaatatttaattaaaaattaaaaacactatatagcacatctgacatgccaagcagtattctaagctctttacctgttttatgtcgtttattcttttttaattaattgatttatttttttattatactctaagttctagggtacatgtgcacaatgtgcaggtttgatgcataggtatacatgtgccatgttggtttgctgcacccatcagctcatcatttacagtaggtatttctcctaatgctatcccatgcactttccagtaacaaatctatggtgccaagtgatgcttacttgtataggataaaaaaggagaagtatttttttaaaaaatttgagtcgatagtttatagtttgcttgtctttaatattaactatttatagtccagcagattttgctaacacaagttgagatggagatgccactggctgcctaaaagctaattctgtaaagctcattcttgattatcaaaatgccgtatttcagcagcagccgatcaaatacggccttgttcttgttctcatgggaatctaatccttgagtcccttctttccccttaaatttgtctggttcacagacacattccatgagctgaaaatctaacaataaattgagaaaattagatcagtttgcataacatttgaaaaggaatgtagcctttgtttgcacagccaaggtaaaatggacagatcagtaactggaagtgtggtgtagcacctcacagaacatgaattctctaaagaaccctggcaacccatgtgaaaatgttacgtggaatcatcattttgaatagagcaaaatgacgctggaaaagagctagggctgagctgtgcagcgtcatttgagatctgtgcatccagaaactataagcacatcttgaatacagaagacgcacctccctgctttcacggtaatattttaaatagtgtgctggctggctttgctttttaaaacaaatgtgtttaatctttgttagggtgagggtgaaaccacacaagaacatttacagcaatatgtaaattgacattatatggcttttctactctcctaagaaactttattaggggaagtcactttttttctgcatagaaatagcagcccctaaaatatatctaagcagttaaggcttcaccccaacagcttgagtaaacacatttttttaactttcccatggacttcaactttgaaggttttacataaggtaattctgaagtggttgtacagagttaatcctgggtcttttatttataaagcattaatttcagactttttaaaaaatgtaattttctcagataatgtctgagaacaaattgagcttctaagatttaaaaagaaaagatccaattgtgtttatttgtggccaccaagcaggtcagtgggagaatcatgtatgtgtcactaagtgattattttgagaaattgagtatactgactcatcttctaattgaaaattgcgttgctgctgtgcttttttaaaagttacttattaatatcagacaactttccttggaagcttaggctatatggtcttatttatgccatgcaaatgatgtgaatagttgaggcaaataaaatcagaggaaaagaaaataacctcatttttctatcaattatgtgtatgtgtgaggcaaaattattttaagtgtgaaatatttagattctctttttctaaatcctttatcatgaaatagttactatgaaatattaattggtattcagcaaaaaagggaattatatgatccaacatatttgggaaacagcgggttaaaaaaaactaacaagtcttttcattgtaggaattctttgagcctttaatatgcaaatgctcactgtgtttctacaagaggggtgtagaatatgaagtgtttttcaaactaacttggctatagaattttttttcccagaatctctaccaacatgatgtggaataatttgggcctctccaatctagataactacaccattatagagttctttgtgcataggtagactcagcttcaatatctacctggagtatggatgctcattatcttttatcttgccatcttcactccacctttactccagttgccccgccacatctgaaaatacattttaaatcaaatatcccttataggcagcttagtgaaattacagataatttgtatttcaaaattttgggggctttatttttgtattgataatatggagggtgttctgaaattccaccaactttcacccagatttcttttgtgaggagccttttgtctgtttttttttcccccctcagaccacctgcaactgtaagttgtctccggggtggctggctgggatcatcttccttcactgtgaagagaaaagctggctgaatagagacaaaaacactgcatactcactgaacattcttgggagataatttgctgccatgttttataaaaccagggactggatgtgcttaagagctttttattaaatattgccaagagagataatagtcctattatccaggtgacttttgagaccattctgaatgctagtattattgaaaatgcagtaatgaagtcaactctcaaatctaagcatgtggatcgtccacttcagactgtgtcttccctagctggcttgttgaggccactcagcccagctctgggctgccttcccctgccctctgtgggaatgtgttttgagaatgcaaacacgcataacattagactgagaaaaaatgcaattaagaagatattttttaaaaaatgatgggaggaggtgatgcgttatacacaatccagagtctaaaggaaaggacttcccattatgccctcattttctgtgcactgcttggctctattaacgccagtaatccagagctgatacagtccctctgaaacagccaaattatattttcaacaaggccaagaatgtgtcctttatttaagcactttcttgataactgatctattatgagaagcatttactacatagttaaactggcaagaactagaatttctggttttctgatctacacacttaaagcaaatacgtttctgtgtgcacagtacttcatttaattatcattttaattactttattgacttaaacattagtattgaacacattttacaacaacaatgaatacacaagcaatttataattttcattatttcttatctcattcacattatctgaagcttgatagcagataattatttgattgaatatgaaaacacccaaaatattgttgggtagcagatatgagctccaattagttgactctttcttccctcaccaattacatatttttttatatttatttctggtatatacttaatatttataatacgcatgtttggaatttgtacacagggagatggctcagtgattgtatttggactatattgtaacagctaccttatcatatctatgaagacaaatattgaaatttttatttctggaattaacattttactttagagtttctcattaatcattacttttgtttattttatgtatggtgttagagacatgatttgaaaatattttttctcagcaaactgggtagggttaaatttagaaacttgacaatagaagaactatctacagaaaataccaaagatgaaaatacaaaatgctgagaggctggtacaaaagtacagtttacaagactgtactctccttgaggttggaagttgctggagaaaagtggctgatggtctcacacctcatctagctaaactcactttccattatcttggttacctgcgctatgaagtggccattcaactttatttaatgtttgcaaaatctggctgattgattgcctattcactgaggtctggggaacctcagattgaaacattatccaggcagtagcaacatgtactttttcaagggcatttaaaggaatactagtaaacttctggtgggtattcctagtctagatttatggttattctttgaggaaataccaagagtaggtagagatacctggcttatcttgtaaaattgaggtaatcattttgcagggatgcttttcactgttagttgagccttctcttgctgttgcaattttatttgtccacagggagaaaatgggtagggtgggaacaatgctaggaatccgggtagcagtgtgtgaagaaatgtatattttcatctacaaagagaagataaattaaattcttagaagtcagaagattcttatgtttgctgtaagataaaattctgctgacaaatccacctcaggtggacctggctttggggaggaaggtccttaatttgcttttctccccaaattctgatgaaagccaagagaaaaatcaattaaccagtatcaaactagggctcaaagatgccctgatgtggcactgcgtgttcattggtaagcctcagtgtactgtgagcaagtcgtcatcatttggtgcgtggctgatgagagatatttaactcaaagagaagtggcataatcgttgaatttgactctgccagttgacttaccctgaaagcccagagtgtattggcttcaaatggttaactgacacaattttcaacagaatattctcctccaactggttggagatccaactcagtgacttgagattagctgaaaggtggaaaggcttctctgcctctgtaacttctgttttagcaatggataactaggagttttgttggtggtatggttaatatagataacaggcatttcttttgggcaggagagccttgctatttgaggtgaagaccaatggcttgactttcccccaaattccacaaacacaaccatataaacagatttttttcccatgaactccattctagtgtcctagaaacaggtagatttatgcagattaatttggcatagtacagcaaattgctgctgtgagatatatcatagaattacttcctagctcaggctagctaatggctagaatgaaataaaacataaaaatacatttacatagattgttttataagtctgataaagctttttgttacctaccactggaactggacgtgtttttgcaagcagcataagggttgttcatgtaatactttcattatttccagcaagtgtaaaacaaaataaaaacaagaacattgaatttagccgccattaactaccattaactgtaatttttcctgacaagctctctctcatctgatgatgagtgaaacgctgggaaaagtcgactgaaaaattgtataaacgttgatgaaatatgcccttgtattttaagcatgcccagttcagacatttaaaatcgagcaatttataatgtgttagcagtcagaactccatcatgttttaaataaatttatttttctacttcttgtgagactctaagtcactctaagaagactcatgacatttcactgtacaaggcaggtcacaaattgaataatgtgaaataactttattagagaactgaagaaaatgatatggcaataatgtgttttacagtaaaatttgatagccctctaaagatcaatgagtgtgtttgtttactttgaagtgaaaggacaaaggcttcataatggaattcagagaaatgcctgaattaaaggcatcattgccagataaaatggctttcctagtctgtggtgaattcagaaaacctaccacgtactttgcagtagaaagaatagcctaggtactgtctgtgataatatgtcattataaagctgccctagaatgaatgaaagtcctcttgtggccacacagaataaaacaagctgcaagtcacaaggttcttgtcctgtcccaaacattgattgaaagggcactttataaagggagaaagaaacagcgggggcaccctcatttgcatcaccaaaccctaatgatggaggcgcttttatggacacactgtgtacacagaataggttcaattaaaaagaagccattttacactggcctttaccccaccaggattttttcttaaagacaaaacaaagaccatttatctgggtaacaatacattactttaaaaaatgaggcagagtgtagaacatagggtaggcaagaggcgtgggtctcccatggttttatctttgccacttcttttcttagccagtgcactgtagatgtcatgaaagcatatctttgtcaaaataaggtaaatatgaatgacgattggagtaggcaggaatcttgtagctgaccctgactaggaagagcaagattcagaacttcacttgagtttaaaatgaagttccattagcagggaccaaaatgaattgctgtctgataattctggcctcgataaaacgagttgggcatttgagttcaatgcctatggacagatgttccacagacaaaaaacgaggctcttaattggcactaattagcacccttgttggcagggagagattgacaaggttatttctatggcacttcccctgctgactcccatagctgttctttccaggataaggggagagcaatgtaggtaaacttatgctcttagccttcaaggattatttgtgcccccaaacaaagacagtcttcgcatttctaagctgtcaacttagtaagattctttgcctaggatatacattggcttttatttttaattaaataaagtgtaattagtaggaaacaatcaatacggtagagtgacaagcacttttatgttggtttgtttgtccctgcttaaagaagcagaagcaaaaagaaaaaaagaaagaagctgtattaaggatgagaaaaacaatctaagcacattatagatgttaacactagtagcgaacaaagaaggtgttttatactggcacaaattcctgcaacctgctgtgcaatacatcttttcaatgctttgtttataatcaccttcatctgtaaaatggcaaaatgccaccagcctcctgagagggctaaagtctgtaaagaacctggatgtcctggggcataaaggtgtcttataattataagctatctctaaaatgagtagcatgctgaaggaactgtggctgcattctaatatacattaagcagagctatatggaagtatgctttaagtttctgcaaatgcttctctctctataattgcaaagttgagaattatgcaaaagtagttattttgcatttattcaatttagtgctaataaggaattcaaagaatggattaaagtcatttttagtaacttgacagatttttgtatactgtagcatgatggtgtacattgctgaagagctggagaggctcttaaatctagactaagcccatttatttttctaggaaaaccgagggattcgatatccagaactagattcaaagaatgctcatcaacaacgcacatgtggtagaaatcatgtgtgggaatggggcagctggatggcaggttcctgagaagcagagcctgacataggcattcctgtgaattaactctaaagaaaaagaaacctgtaaggaagtgaagagaacaagtgggatggtgggcttggctgcagcttgatcccatgaggagtcctagagcatgaaccaaatcacagagttgtcccacattgaggcaagatggggccagccgtttggctggatactggctgaacgcattcccgtcatttggataggggtttcccatccaagagcaaagtggctttccttctgccaagggcaagtatctggagaagggcccacctggaggtccctggagaaggacccacaatagctagagcatctgtgcaccagtctggtaaaagagatgagggaagggccatgctaccagccttcactacagggctaagtttggtagagccaggtagcttcctatctaagcaaggccttttgtttcctgagcaactttcagaagagcacagtgttgactgagcagaataaagcccatccttagatagtgaaatttttaaaaagtatcctttgataattagcaacagtatgcacatagatgagctaagcaatattttctttgatgcgaacagtccttcttgaagtacaagaaggcaacacagatgttcattcggcttcttatgtgttcagatactgtggaaacagaattcccagttcctcaaacaaaacatttcattcatacctgtccatacttgcatgtgcctcctgtgtcatgcctctctgcctgtggtactctggaatctttgtcttctattcacttctcaagattgcacaccagcataaattcctaggtgaagacttcctagaacacaggtccacacaatgaaaaagtcactacagaggctatgtaaatactccaagttccaaagacaaagggatttccagtacttcctcaaggccatctctcatagcttagatttcctgtccacaccctggaacctaaagcctaggctcctctcagtttactcacactctttgcccctgaaggcattttccttgtcaccaagcacctactacaattgaagagggtacagtcagtcccaagcagccctaccaggtttctcttacctcctcaccatggatgcctggtatcccttcctcatcagcattctctgatgctgacactggatcccatccaagagccatacactgtgctggtacatcacaatgccaaccaccctttttacatactcttaaaacaaccaccaccagattcccccagctcttcttcccccaaggccacaaaaatctgcagactccatgcatcccaatagtgattttcagagactgtgacttctgttgcccttgaagaatcctaattaggggaattgcctggccgaagttatgctttagaatgattactgaagccatagtgagagatcttgaaggcttgaaataggtagggatagagaagagaggacagactggagaaaggtatgatatctgtgttcccatcaatggatttgagtaactgacaagatgtgtgaagtgggaaagagaatagaagtgttaaaatgatcaagcttgcttgcttgataatttggataggtggtaatacaatagagatatcttagtcaatttgtactgctataacaaaatacctaagactgggtagtttataaagaagagaaattttatttcttcacagttctggaggctggaagtccaagaccaagacaccagcaggttcagttgtctggtgagcacgtgttatctgcttccaagataatgccttgttgctgcttccctaggagggatgaatgctgtgtccttacatgctagatagaacaaaatggcaaaaacggcttaacaagttccctccagccttttataaggcactaaccccatgtttaagggcagagccctcatggcctagtcacctcctaaagggtccaccttttaatactgttgcactggggattaggtttcaacatgaattttgaaggagacacaaacatgcaaaccatggcagatgcaaaagtaaagcagaggaattaacttctgacacattctacaacatggattacactcaaaaacattatgctaagtgaaatataatatgctaaaagccacatattatatgagtcccttcataagaaatatctagaataggcaaatcaatagagacagaaagcagattagaggttgcccagggatggagggtggaggggatagagggattgggagaatgatagctaaaagttacagggtttcattctggagtggtgaaaatgttcctgaactagatcatggtgatggctggacaacactgcaaagatactaaaaagcacagaatagtccattttaaaagataaatgttatatgtattttattacaaaataagtagatagattaaaaataaaacaaaataaatgaaggaatgcatacatacatacatacttaaaccagtaggagggacatgccagagatggtgagctcagttttagctttcttaggcttgaggcatttgtggaacattgtggtggaactggatttaggtgccaggagctcaaaagagcgttatagctgtcagggctgtaaatacattgcctcagcccacccattttggagagctgggaaggtaggaactggggcaaagccctgtattagtttcctggggctgctataacagagtaccacaagttggaaggcttaaagcaacaggaatgtcctgtcttcctaacttccagatgttagaagtccaataacaaggagttggttccttcttaggatgtaagagaaggatctgttccaggcctccctccttggcttgtagacatctgtcttctctctccctgagtctcttcacatactcatccttctatgggtgaccgtatgcaaattgcccctttttataaggacaccagtcatatcggattagggatcaccgtaaggacctcaagaccttatctccaaataagaccacattctgaaatactgggggttagggcttcaacgtatgagttttaggtaggaacgcaattcaccccctaacaagcccatttcctgaatttcccttttctgaatggcagcaattttaacgatcctccagttgcagtagtaatcagctgcacagttctgtcccatcctacgtagagggaatttaggggtacttacccccaaaaccactctggagcttccgtccattcttctgcaatctctcagaataacatggacttagggagctgactaagagtcatctgcctgcagtcattttcaaataacattgttattgcaattaccaagttgagaaaagcctgcccaaccactacttgggcaattgataaggtaatgaaaaaaacaaacagatttacttttttatgtgaagacaaaatgtttgtaggaagcagctctcacattctttgtaagcagctctgctctgtggattttctcagcatctttgaccaagcctggcttgtgaccatcttgttttcctatggtagttcattctctgtttctgtggtgggacactgtgccaagagaactcgctcaagaccaagagacagatcaggctgttgttccacattttctttccactaaatcacagttttctttcaagggaaggtggctgttgtgaagctgtcaaactagctgttaaatgggttgaagtgaaggctcctattaacaacagcagctatctctgtcacattcaagttctgcagacagttacaaggcaatttggtcctgataggtgggctattaaaaataacaaaaggcaagaagaatgagagaggaacaccctttttacttcctggtttcaaaactaagggggcaactgaatatttcacacatggacctagcctgcagttagtgtggccttcataatctcacagggacaaggcatcctccctccctgggtgttttcctttagccaggtctgggaatggaaggtggcagtgggggagacagcaacaaggtctctatcaagttcaaggtggccaaagagttctgaatgctgatcataattggaaacagtgtcactggtgagggcagtatgtgtgctgtgtgtgtgtggttgtggggagcgggtggggggcagtgatgatgccctctgcatgagaaaaagcagtgtggacagttttacagtgtcatatccaagactgtgaaggttagacgacagacaaccggaagagaattaaagggaaattatctctcagcttaagggagccccaacttaaattggatttgtgagttaacatttgccttactgtgggagttacatacccgtacagggccctgataggagcctggatacctaacccctcgtgtcatggtttggaaaatcaattagccagtgaaggacccggccttgcgtagactcagcagaggagaaactgctgcaacccaggcagtctgcacctctgaccagcaagaatggacacatttttcttctgttgaaatagattcagagtcccattttgcctgtgcttaatgaattcatatataacatgatccttaccccagcttcttctgtaatcactaaaatgtgagcctccttccatcagccctcacatcgtattagagcaactcatccaaattggcagcccacattaaccacatgcctgcctgtgggttttattgcgaatgggggcaggtgatttgtactgttgcgaggaacattgcacagacagattccttctttactaccctcaggtttggaaattccaaagtcagggaggaggagaagagtctttgcccacaggatcttggcttggtctccaccccatccagacagctgtctctttaatataatgctttgtctctcctggaaaagacaaagctcttttcccttggtgaggcttctgctggtcatatcaattgcagttttaatgtagggaaaaaatacagtgagaaagagattaggcaggaaaaaatagctctttttctctgtgtttttcttggcagatatgtctaggaatgcattggagaccttctgccgtacttcgttatgcaggacagtaagcagagtggttagggacatgggctttggaatcaggccactgtggattgccagaccagctctccgttcttctcttgtccagctgtgagacttttttttttaaaaaagacggctctatttagatgcatataacataaaacttaccattgtaaagtatacaattcagtgttttctagtatattcacagagttgtgaaaccatcaccactgtctaattctagaatatttttatcaccccgaaagaatcttcataacattagcagtcactccccttgccccatccccccaagccctggcaaccagtctctttcagtctctacagatttgcctgttttagacatttcatatgaaaggaatcatgtgatatgtggcctttggtgactggtttattgcacttggcataatattttcaaggcttattcatgttgtaccatgtgtcagtactttcttcctttttgtagctgaataatcattcatttcatggatctatcacatcatgtttatccattccatcagttcattgacatttgtgctgtttctactttatgtctattccgcgatggttaatgatgttgagcatcttttcatctgcttattggccatttgtctttctgtgtctgtcagtctgggctgctataacaagaatcccataggctgggtggcttaaacaacaaacacttgtttctcacgtaagtggtggttgggaagtccatgatcaggatgccagtatggttgggttctcgtaaaaaccctcatcctgatatcctcacatggtagaaagagaatgaaaggaagcaaggtctcttgggtctcttcttagaaggtctctaatcccatcatgagtattcaaccgttatgacccagtcacctcccaaagactccacctcctaatatcatcacattgtggattagagtttcaactctatatgactttgagggagggggacacacaaacattcagtccacagtggtatcttctgtggaaaaatgtctattcagatccttcagccctcacatcgtattagagcaactcatctaaattggcagcccacgttaaccacatgcctgccttcgggttttattgggaatggggacaggtgatttatactgttgagagggacattgcacagagagattccttctttactaccctcaggtttggaaattccaaagtcagggaggaggagaagagtctttgcccacaggatcttgccttactgcaggagttacacaccagtacagggccctgataggagcccggctatctaacctctcgtgtcatggtttggaaaatcaattagccagtgaaggactgggccttgcatagactcagcagaggagaaactgctgcaacccaggcagtctgcaatccaggcagtgtgcacctctgatcagcaagaatggacacctttttcttctgttgaaatagactcagactctttaattgggttacttatcattttattgctgagtttccagggttccttataaattctggatactagatccttatcagatatatgacccacagatattttctcccattctgtgtgttttcttcttaacttttttaaacctgaatttcctcacttgaacagagaaaataccagtataacctcccaaatttcatggagagagtcaatgaagtgatccattagcgcacttagagaaatgaatgtctggcacacattaagcttacctcaataagtcttagttattattagctagtattggctgacttggatttattgtgagacagagacaaggtgtaagccctcaagtcataattgtacatctgacaggtgtgatgtgaaaggttcaaagtgctttgattgaactaacatgttattcctaggatgattggagcaattttatttgagggactacatttttattctgaatagatttcctagttctagatattaaatactaagtcttggccagtattggggtctgctattctccacgtatctatatttacagttctttctgattctatctagacagctagttacctatctatcaagaaggtgagtctatgaataataggatagaaatagccaagttctggggcaagtactcagaattggcaccctcttacctgaagccaaatcaggaaagagtagagctccaatttcacaagatgttcatccactatatgtaaaacctactctcatgtctctctgttgttgcttaaactgctttcttcaaccagagacctggtgatttcctctacagtgattcttttaaggctgcttctaaatacattgatataagaaccaggctccagtttgccttaatatcagtaatagtggaagcagtggcatttatcaagtgctcacgacgaactcttttcacatattatttcagctaatctttgcaacaaccgtccaaagttgttataactagccttgttttagagacgaaaaaaaaaaatggcgactcagagaggtcaattagtttgcccagatttgtacacttggtaaatgcaagagcacaggctggacctgtagtctattcagctcccaaccctttgctatttcctttacacattgttacccctaaggaaattgaattacagagcccttgattgttagacaactgagttatctccgtgtttcagaattagaaagccaatcctgtctaattcattagtatatggtaatacagaacagtttagataagtgtgtcatttgttgacagtggccctcccttttcttgagaatcctcctctccggttcagtttttctttatgagtcagtggcagtgctaagatgatggccttacatgtgttcagcagggtcacaggaataagaaagactcatggtatattggtgagctacagagaattcatttgccgcaagttgaaatttggagagagatggccaaaatgactcaacatggttggctttccacatcaatgtaattgtgccatgtgctataatttatagtgtaaacaagtttcctgcaaaagctaaatatatcatgcaactcatttaacatgcacagaaggagccattaaattatttcagtcccgttactcaaaatgttcagaaaattcctctgtattagagccagtgcaggattggctctgcagccaagtgcatcaacataaatgttgaattctcagaaggaaatgcatgcctcatactgttacttagggaaaatatatgcccagacattgtggagccccttctaaaacaatcctcattttgttaaaacaatactatcaaattttcaatcaggttataaagcatctctgcatttataaagcttgcagacaattgtgaatatcaataaaaaggtgatgtgtttttaaaagattaataatttatgaaccatggaaatggaaactgaggctttttatgtcattttctaattttgtctacctacgtggagagaatgccttgtggaagccatatgtgatgccttaaaactgtttaaattggagtaattatcagaacaaatggtgtcattggatgatattagtctgtttgtgttccttctgtctacccaatgaatcaacattaatacatatttttaaaaacatttgaaacatggtcatctgtggtttcttttttgttttaaagtatatgtttaaaaattgatctaaccttccatacatactaaaatataccttagattgagagtttgcagttacatattccttatgcaaaaagggagtatccttctctacttagctgttaaagagtttgggtgagggatggatataaaattttgtcaagtatatttttggcctctattgaggtgatcatctggttttcatcattttatttgttgatgatgtgctttgttctacaaatagacatttcattatcaaaatgtttcagcactcctggaatgatactagattaatatttgatgatatatagttcagttgcattttaggtagatttgaattttcaagatttgaaaaagttgatatagtaatattaaaaaggttctcattattaaaaacatgatctacttctgtttctggcatgcaaaagctatttgtggcaaatatacagttattttccttctttcgatttttactttaacatgagaacacatttctctagtttgccttgtttccaaataaaatgacatctgatgtgtcaggataattcaagctcaactatcttgagccaataatcacagatgataaagattgggtgattcctacgtgctaggggtttgaagtgagatattgcatttaatagttatagcaattctataagacactcagaagttcaagggatttgatctgaggtgacacagatagtcagagtttgaacttgggtctatctgactgcagtgcaagctctattgctacactgagcttttcagtgcactcagtagccacacacaagtcaattagctttgcaaagtggaaagttactggtctctgaggactctgaatattggctagttcttatggatgtgtgtgcccttggacccaacatgttacatgatgagctctggctagcttagcatgcatgcatcaccccagcagagaaacaagtccattcgctattgttctgtttatggtaatgatactaccagcctttgttagaatttaaatgtggacagcacattcacaatgagaccttagtaaatgagagttatgttcagcaggtcaccaggatatgaaactcaggtcttgtaaggagtagttatcaacttacagggatgtctggtggtgtaggggagcacttttaccatggcaccctggagaacctgcaggtatccaaataggccacataagcagaggcttgaaccacagctaatctgagccttggtggaacatccattgatcctcccagaacaagagaggacaagaagattgtgagatgtactttaaggccatctcccactcacttccctatctcctttggaatgctatcatgagacagtttcccatcacctcccaggttctgttgaggagttttctgtcctgccctccactgaatagaactctagcctatacaactgctaagccaaagtctaaaattgactcctcagctacagtgtgtcctataacttggtcttcagtcatctggcctcttttggttggtatcctcctttttggtgtgtgggacaagagtcgggggtcagctggcacctttggcaattcttcttttattttatttcaagcctagtttagtaagtactaaactatctgtatctaaaagtggacctgcatctttattggttgaattagccaggccttggccttgaccttgccctgtcttctatgtgtgtgttaacaggaggtactcatactcatctgctggaatgctcacaggggtcctgggctacatgtgcccaagaaggtctatccagctctacagagttaaaatactgtcaatatgggttagaaagcaatctacctcttcccctaaaccagagtgtggagagtgattttgatgcagccaaaagagctgagcatacaaatcaggtgggatttttataaataactgagcaacaatgctgtcaacattttagttgggcctacattgtcagtcctgaatgttttgctaaaataatctgaaataaaatgtgaattctttatgcatcagcataagggaaatcctatttcctgtgtcaattcaggtagacaggccttcttgacaacctttctctggaaatgggtttgagaaatggtttaaagcactccaagctaaagtgttctgttatcagcagctgaaaatttgccatgcatcacataggactaagaattggtccttgcccccattgagtttaatgtaagacacaatggctgtcagcaggtatgagttgtagtgcacttaacagcgacttagtatttcagttgttttggacagcttccttagatagatattaatggaccaactccataaaggagttatttccttaatcatttgacaattaggagctgacgtgaagagatgagtaatgaagtaccctctgtgattgtactttggaggtagccacaggggttttttatatctaatctgctgtagttgctctaagaagctgaagggagactgagaggggcaattccaaaaggaattctgcctttcctcatcacttgagaatggaagctaaccagtgactgggtttgtctccaaagagaatgctgagtactagagacactcttctgcctgatagagaaagtcctcacttggcatctgagccttatcaaaatgaagagacatttgatagacaggcagcctagtgtgagggaaggctttgatgtctggtggaattcctgatttaaattcagtgttcttagacaaccttgaatgttaggatcatcagtgtccaaattcagttgactccaattctgaaatgtctctagaatctggtctccactatttttactgtctgtgccctgacccaggccaccaacctgtgttacctggagtactacgatggcagtctaactggtttccttgctgcctccttctttcagtcaatctatattctttacttcctgaaatctcaccggcaaataccaagcctcgtatatggtcttgaatgaattcctattcctccacttgaatgactttccatatcacccagtatgactcaaaggaaattctttcaagatgacttgtaccgccctaccaaagagcagaacatcagctatcagggtccatacttgaaattttttttaaagataaaagattctgtgttctcctttggaattatccccgcatttgttttcaggcccaggttgatctactgagttatggtcttctctggggaaattcactcttagatgttttaacacacacacttctaaaaaatgatacaagactgtttcgttgtgagtaacattttcttgaaagccatctgaattctattaggcactttgtcatttgcatgataacttgagttcccacattgggaggacattgtataacccagagaaatatactaagaaaatgaaaatcaaatccaaaatagtgacagtagagcagaaaattggtattgtgatgaatgtatgtgaccaattctaaggaattccaaggttgaagaggtgacagttgattgattcaagtcatatacgtcagggttcatactattagatttggcttgtgtatacaatatagacatagattcatatgtatcacatatgcacccagacaaaaggatagttactctactattctcctactgttgtttgagaactcagcactgtaggctgtcaggctatgtggcactttctgaatctctgagatacatattatttttattcccattgcatagaagagaaaactgaggttcagagagggtaggtaaattaagctcaagttctcttattaaatcctatgcaatatccatggagccacaaccatctccataaaatgaggaatcttaactagatgagttgtttttaagctttgttcctgcaaatccctgggagttaacaaaacaaactactttaatcttatttgaggtttcctgtaaggtttcatttggctacacaagaaaagattttttgagtttaagagtttgaaaatcattggcttaaagcaagggtcagcaaactctattttgataaagacctagatgataaatgttttaagccttcgtttggtagcaactactcaacctggccattgtagctcaaaagcagccgtggatgatatataatgaatgggagtggctgtagtccaataacactttatttatggataatgaaatctaagttccatataaatttttatgtgtcgtgaaatattattcttcttttgatttttttacacatttaaaaatgaaaaaaaaaaaactgttctaaaatcataagcagtacagagacagacggaaggctgctttgggctgaggccttcagttggccaatccctagactagatggcccctaagggaactcctagttctcacactaagaagcccaattaatcttatgaaatacctattttctgaaccccttggaaggccatcagctacagaagacaatctttatcaggcccacgtgcccatggcaggatgcatgtttagaccttgcctgtgggcacagtggttggcactgggctaggggtccacccctgatagatcttggagatttgttcctatagagtataatacagattttcaaactggttgtcactgccacagccctcagacagggattctgtaggattcccagtgaggtggtggccactgaatcaaagttttaagttaaaaccttaggaaaattaaatgtagctcctcctaaggggaaaaaacagcctgagcacctttactgcagggaagaagaatgaattccctgaaaaatatcacctcctcttccttatcacctgccttcctaccaacaaatgattcaatgctgtggagactacaaagcactagataggaaaatatataactctctgagtaattctaaaccagtcatgttttatttcttttaggttactttatgaagaggaagtgccctttaaggagtcaagagggctaagttactatcctagaagagggaccagagtaagactctgcctaatgagaacatgcaagccctctctaggctgtgttattatcctcaaagtcaattgtgtcattcatttgggccatcagaaacttactctgattgccatgaactctggggtatttagaaagacaatgataatttaaaccagtaaccggaagaccccaaactcactgggccagaagttatagctctatgttttagttaagagcttaaaacctgagtgtaataacctcctccctctcctatatgacagaggtagcaacactggttctgtctccaacatcattacaagtctagtctctgagtgtggactatagagagcaagactccagctgcaaggtagaaggtacaggaaagcacgtggcaactcctaactggcagatcattctcacaattaaaggtattgaacaatagaaaggtattgttagctacctatcagaaaaaaacatgtatgaccatatgttaggaatgttgcagttctctccactaggtgacacagtgacatggtgaaagagatagcactctcaagtacttccaactggaagagtacatctgagaatcagtcaccagcattgcagctagcaccatagataccttgaagctggaatctagccagtatcaagtgctgctgtctgccaagaggaacaccattttgtagttcacaaaaaggcactgtgtaggcttgcaagtcctgagaacaactcagtgtcccaacggttgtttctgagcaaggattctggatcaactaggagcctattatgcccagtcttacacgcaaacttcagagacagatgtgtgttggaacagcttcctgagagtgacaggcctaaagacacggtgctcaaggtgagcacaacttcaactggggggtcgcccttggttcatttctctggatcagcaggtagcttcccaggtataaaggtcagaacatcgggaccactcatttttttctgaactctcacttggtacggtctggatgtttcctcttgcaactgtctttcaaatttctgggataacttaagcactccaagaggatctaagaaaacccaagacagatctgatggatttaggccatttctagaagagtaaaccaaagctccgaaactttccaaactcctttatagtctttgaacctctccttatttggtcatggtttccaatgatgtgtggggcctgattcctctgccagcctctaggttaacacatcagcttttaaaaattattattcccacctctacaacaaaattcctttgacaataataataacaatatcaatagtaaccaagatgaaagtgatagctggtagctgtattggctcctaggcaatttgtataaactttattttctaattctaaaaattgtccagagtaggtattattattgcccattttaacatatagaaaattgagattcaaaaggtcttatttactgtattaaaaaaaaatccgttaggaattcctgtatttgaactcaggtctgtttggctctcgagaccttgctcttaagtccatgctgactcaaccaagggcttcttcctgccagccttctataataatgtttcaagccctctatttttccctcttcaaaatcatctaagcattccactatgtaaattggcaaggttttgggagagtgatcttatgattttctggttatcattcacatgggacctgtcatgtcatagtgcactagaatgtttcagtgcaaagagcccttggaggccactaggttcagcttgaagctcagaaaatcaaggacaaagatcttcttttggtccattccatctcatccaaatttcactatctgagcttttataggatcatctcctcagggcaagaacttggttttttgttcacagttttatagattattctatgtctcaatactacaaattataggtcacagtaaaactaaaaacagcatttttacaccaagatgaacattgtggatgactagaccctgaacagacaacagacttcactaaggaggtctaattggttctgttttcacctaattgaaaagttgaagaacaatgtctgttttttttaagatcacacacacaggcatacatttatatgagcaatttttttcacattatgtgtcatgaatttgtctatggaattataacctcatgaaaagagattaccatttttctgctgagacgaccttaactgcattgggtgtgaatggtgctgctataataattaaatctaatatctttcataatcctacgctttccctagagtaatgttcagcattagccaaggatgaaaatgcaaacaagtacatgtatattcaataataaagcttaataggtcagggaagaagtggaatgaaatgaatgcctagttcctccagagataactaatagtaatttgcttcctagttacttctttgacttgtgtttactgggacttaaatgtatgcatcagattttcctttattaacagccaaatccataccaagcttgttgcatggtggggatgtggggaggttgtttaatgtggatcgctgtgtagattggctgcctatttccagaactgtacattggagtgcatttcatctccatgttaaaaatcatataatgttgattggagagtaaaataactgctgagttcagacctctgtgctctgactctggatgtgctacttctacctgaaggagagaaaccggaagaccacaagcacatttctacatctggccttgagatgcccttagacatttcccaagtcatcatggattaccttcagattgttcagaaaattaaaaggagaggagcaaaggcacacagaaacttctgcttctgattactttttaatagtattaatgaagtccgttatttccaactgagatagctttccaaattaatggtgccccgcattattagttttgtgctttcataatgcactttcacatgcattagctcctgttatgctcaccaccaccctcctgtgatggaaccaaagtgttatcccattgaacagatgagggacacagatgaacctcagagctggtaagttaccccagatatcggggtttatgattagccagcaattgagtcccagtatcttgactccatgctaatgttttctgaggtttttgttattgctgtcaattttattgaatataccatcttttataagttgtacactctaggaaaaccttgtatactcccaattctagctggagatgatctaggttccatgtttgtctccgtgatttctagctgtgtgttcacaagcaagctccttaacctgtctaaacctcagagtctccatctgaaaaatgcagctgtaacatcatctccttcatagaagtattgtgaggaccaaattccgtgctgctggtcaaatacttaggactttctctgtctctgaaaattgaccctctaaatgcaggaattatttaccatttcttttgctgaatacttgaatataaattaacacatagacattccctagatgtattgagatacacacacacacacacacacacacacggaaagtaaagccatttataataacaagcataggtagtttgtaaatatttgagttctatagcttatgagaatgatacagtcttcatttcccacaatgtgttgtaaagaattatttgttcagagtcagaagtctgcaactgcaaaagaaataccaagatacattttttctccttctctaagatcttcaaaacatccattagtctcttgaaggacagtcataaatcctgcaaatttagtttatccgaaagccactctaacagttgtccttcccagcaatcatcctttatatcagtctttggtttgccgacctcagtgtacacattctagtgttatgtgactgagcatgaaagtgggggagctgtgctttttttggagagttattggatatccgctctgccctgactctcctttcaatatttgaacataacctctgaagtaactttccccctatttatcaaattagaagcttccttttcccttctggcttctcttctggaaaaacacccaagtgggattacagagatggaaattttaggagtggctccagcactaactattaatagctgggtgagcttcagcaaagcaattcacctctctgaatctttccttccttgtctgcaaaatgaggccagtagactctatcatttgtgggaagatgctgtgaagcacagtgaggtgaaaatgctgcaccctctgccctcatgggaattacggactagtggggagagattcagtggaaagctgtgctgtgatccagctggagctgagggttgggtagaggaaaaaaatattcttcctgagatgagagttctttctagaaagcttttgtacagaaagtgggatcactgggctacaaaggataaataggatttccagagttaagaaagagatttctagccctggagctgagcctgatgcagagcctagatgcaagaaagagcaatatatgcataggaaatggtcattggtccagagaggctgagactgtcccttcttgaagcctaaggatgaggtataaagttatatataataaataaaaatatgaacaccaataggtctttaaagacagtgtagctggaattttaagataataagctattcgtcctgctgtagctcacacttggagaggatgccactggaattaatatccctatagaaacaaaaggctttgtggctccataaacaatcttgaaagtgctagttcatcaccaaaatccagaccactcatttttcaggtgccttgccttaggagagaaagatttcttatccacatcatgggcttacatctctcagatcaaattttacaggaagagatcggtcatatatcagaaggttaatgactagccatttctctcccagctcttttgcggccacccagctacccagcagcagagggcactgaaaggcagtgcaggttcactgtgccttttacctccgtcatccagagagacccagcaggctttgacaacagcctccagagctagggatggttatcatgcccctcttctttcatgggaaactctgagcaccttgtcctgtagagatccagtgccacatcccacatacacagtgattgatcagtacatttattgcacttttagtagtaaaaatgtatagaatccagtcatctctggagatgctgaaatagtattttccccttgatttaggggaaggtagagagggaagatatgtgcaaatatgatataaatataagagctcaaatatctaattagctgaaacaatcttggttccctctacacctttgaaggatttgcagctgtcagattgtagctccaatactttattctcattgcaagatgtatccgaggatgatttagaaaatatgccttctaactcaaacaccactctgatctctttgtaggatgcttgaggatgacctgaagctgagcagtgatgaagatgaccttgagcctgtgaagaccttgaccactcagtgcactgccactgagctctaccaggttagaagagcttagggctttgttttgggatgaaggggggagcaggaggaactggaatggctttgacatgctttgacatgcgcaaacttccccatgctttatctctgggctttggagagagggaaagaagcaaagatgagcatagtgttctggaacaggtcaaatcagttcaaactttcattaaagctatagtaaggagatgcagagctctttaaaactgctttcaaccccctcccatctctctctctgttccatacacaaatgctggtcagtggtaagcaatagagattgtcttgccctctcttggactacttattgtcttgggtgaggtataattttcatttggtgactctggtgtgaggcttggaacccatactcattaatttagatataaatgtgatgcttcattcacctttcccagatgcaccatttcagaatgcagctgagaatcaatacgcaacatcttgccattaaatgaacctttaggcagaagacatttggcaaaaacttgtggctgcccttgtatccttctatcccacattttaagcatttacagtattttaccaccaaatgagatggcaggaatgtgtgttttcagcatttcaatgagactggactttatgatttgaaaaggccaagtatcatgtatgactcatgagaacggcaacctagtgtgtggtgtcaatgatgcttgcacattttctccttgagagagaactgtctcgaatgtggggtccttctgggtgtgcttatcacctcaagtgaggaatgcagaaggattgcctttctttaaatccagtacctgaccaagatcttcctacagtgaagtctgctacattataaaacagactgtttaaaggaatgctcatgcactcgtatttcaagagagttaacaaatatggaattccatgttcattgaacatttcatgaggaagagcctacaaagaaaagcttaggaaaaattatcaaggctcagctactctattctcatctacagctgtttaccacactagaactcctaccattctggtatactttaaaaataaaatccatcttcaacgttatgtggccaaaacttttgtctactttactttctccactttcttgtgcttgaattttaataatatgtaaaaaataattgcatctttgcaagtttagtgctttatcaagaacaaccacagggtaagtgcagactacatagtgctggcctaagccaatttcacaactgttccccaagggcttgctgtacatttactggatgcaagctgtctccctcctgcttgagttgggcttcatagcaaatgtaaaatgtacacttcatttccaaaaattgtcatttctccttcacacatttaatacgccaatagcaggagcatcatatttgtaagtaaaacaaaagcaaaaatgaaaacattctagatcattgattttgacagataaaaagttgccttttaatggaaatgtttaaagtagaattcaataataattgaaagtagattttgcacattgacttcctctttatgtaattatatgaatgtaatctactttttaacttataaagttattttctgtatttatctcaaaattggcaaagggtctgttagcctgaatcatctgagttttagggtatattcactgactttttgtaagtgctgagactctcagatgatcaggattggtgggttggaacctttttatgacatgttgccgctagtcatgatgtcttcctcaaaaaggcttaggttctcagtgaaaatttgatggggagattgaactaggggctctaaggtgaggcaaaatgacaacttattccctctagctgagtcctaggagcaagatgtaggcacaaggttataaacatttgcaaatgaaccctccttgtagagtttgaagatgagttacaaggcctggaaggctatagaccaaaagagaatgcttgtgcagtagtggcagcagtaatactagcaatgtttgcagagctctgcttttaggatgcataatgtctttttgtaaaagtaaatgggttgaaataattttctttttttattgcggcaaaattcgcataacataaaattaaccattttaaagtgttcaattctgtgacacttaatacaatcacaagactgtgcatccatcccagttccagaatttttcatcactccaagtggaaactccatacccattaaacagttcctccccatttccccctccccctaaccccgacaactgctaatctactttttgtctgtatggatttgtctgtttcatgtaactggaatcctataatatgtgaccttttttgtctggcttctttcacttaccataatattttcttggttgttcgatgtcatgtatcagtacttcattttgttttatggctaagtagcattccattgtatgaataaaccacattttctttatctactcatcatttgatggacattttggttgtttccaacttttggctactgtgaatagtgctacggtgaagatttgtatataagtttcacatggacatgttttctttctggtgtgtacctagaagtggaattgatgagtcacatggtaattctacagttaacttatagaggaatcaccaaaatcattttgttttagataatatagtgccatgcatataacatagtactgttcactcatctttgaattgggacagtcatacctccagcaccatcataaggaggagtactgagactaccatttttggaaccactcttgctctatgccaggcacaagctaggtgtggtgtctcatttgaaccttacagcaaaccttagcagtaggtttgggcctcctggctgagcaaaagaattgcggagtcattccatttgtggcagaatgattggggagaaagcatacagacaaatgaattggtccataaaactgtgctcaagagcccagacaacactgctggtttcagctgacataatagttagaaatggctcagaacccagtggctgcattcgtgcagacatagtccaataaaaaagccatttactttctggagacgtccccaaatcatctcatccataatcatcacaccttgactcatttgaagaaactcaaattatccaggtgtagtgagtacacagcaatctttttcaaacagtatctaagagcttataatgtgggcttagagcataagcatccccaagagaatacatttcaaatacatgtatgaaaatgaaacacaggatcaagttgtgtcagcctctaaactggcatttgggtaccgagtatcttacaatcagaacagcctcccctttttctgctacttctaccttccacagcagtgttagccatgctgagccaggtgacaggtcatgtgcacaaacacaagcagagcaagtagggtatgtttaaatgctaaatattattccctcaaatgggaaaatggaacatgagtccagaatgggggaattataatatataaattaaagatgccaaatggtcagccatagagactcatgatcataagaaaacatttttaacagaagattttaccttcaaatgactctttaaagtcagagatatgtaatcacacatgtacatggcttcaatgaagacacgatagtgattgcagcctgaaaatacctgttaaaactttgtgttttctctccagtcctctactgcatttgactttcttggttgggactatttgggcagcagacatatgcatgctgttttctaaggtggtgggacaatgctgggacagtgtaggagagcgtgtgagagtatagctgtatagttacacggacatggctttgaattctagctctgccactctgaaactggttgaccttgggcaaagacctaagtacctataaaatagaggtaaaaatagcaccttcttcattgggtcatactggggattcaatgattaggtcaatcaatacaggcaaaagcacctgatgctatgcttagcacatagtaagtactcaccactttacgtgataataatcatcattgttatgggtgctactaatgatctaaaaagcttcacattctttgagatgctacatatatttactttcccttttcttgtaaggaatgggatgttaaagacagctgctgggttttctatcctgtatatggcaaacttgaatgaaaatgtctgtcatcctaaagtttattagctgtgtgcctggccatgagtaattttaaatgtagatattaagaacatagtttttggaataaagaagcctggggtttaatcccaggcctcaaatactagctgtatactagctgtatggcattgggaaagttgtttaacatctctaagtctcagatctcttaccagtagactggaataaaccagccttgtctaactcatggagtactgtaaggatcaagtgaagacagtgtataagaaaatgccttgaactacaaaataggtggttactcttccttgtggtccttttaaacattaactggcagccctctctttaggatccatagggaaatagacatagcccttcattttggcctaggtatccatagggatctgttaggaactgcattgcatgtcttaactggcccccaaaggcagccatcagatatgaatgaccttaactttcctttaagccctgacaacttttaaactagagatcccagaaagaaaggctaggttgccaatgatctgcaccaagtcctccaggaaattatgtgtctccaaaagagtttttcttccaaggattggcgtgggtggagagttgattcatacccttctattgcagttcttaccttctctttctgagctcatgctgtcccctagagaaaggcttgaaggctcttctaggatgctatactcaccttggctgtctctcaggagctgtccctgaatgggagataaataactatttgaagttgacattagacattgcaaacatccagaacagtgttggaattagacatagtgctatgtacttagtgtctgaataaacatatgtgctgcaatgtattttttaagtttgatatcaatggcatggttgagatttgggggccacatgatgtctattacctggctgactgcattttttgcttctcagctgccactgttggcatcatagatataaaatccagccctggccttccccatgaaacacttattgaatttccattttcaagccagtcctccagggtaggcagagatggccactggggtttggctagggagtggcctgacccaggaggacagacgttttgggagtgggaatatgttatgttctctgtatgccctgcctcataccactaaacctctggtttttctttttgtcagtttttcttttcatttttctcggggttaaaggaacccctgaaaatcaggagttaaacctggaatcaattttcatttacagctgagaagcagttattgatgctatgcttgcagttcaataaaagatctaaagatatagaccttgtgcttctctttcaatataagcagcctaatcagtctcaaaggtttttttaacaaagaaattgtatggacaggtttattaaaattgctgtctttaaagttttaaactatccgcaatttgacttattccaaaggcttctagaatgtgtggcgggcaaactccaaagctccctccagcacatgttcttagagccaggtaaacatctgcttaatgtctaattgagtgatattatgatgtctgatttccacagccctaaacatgtagtctggtgtccacaggtagcgggatggcttgtgatgcctgggttctgaagcctagttagatctggccatggctgtctcatgccccagttagctcacattggcattagaagcagcagactttagaaatctaaaagccataaaagagatgggtcttgttagaaacttcctttagggcattataacattagtaacatcttattaatatgaattagattgaaatattagatgacttcatttagcacagttagaagttcagaaaacatttgatatgactgaaaatgttcaattagtgaccaggttcactaaaagaccctacttaaagcttggagtagtatgctagtgctttaaaaacagaactgaaccattaaaattttctttgaacacaaaacattctaatgtgttgtgtctgggcatgtgattgtgagtagctccagtgtacccaattttatttaaccccatcttatttctttttctgccaaagaagtatgctggtattctgtgaaatgttcacttaattgaaagcatattaattactggagatgtatggactttccaactagacactagtagcagagtcgcaccttaagcatatgagcatttacagaaaacaataatcttcttagatcttcccctccacttcatagttttgttttttctttttttaaatcttcagattactaattaccgaacacaaaaaagttgcttttaatccagtttctttaatccaggtcttatatttgatccattttgatttgtttgttgtttggtggtggtcatggtcatggttgttgttcttgttgagcgagcttactggcctggttgctatttgagaatttcaaatgaaataattacatagccaccgaagacccaaacattctgtcagctttgggatgtgttcctgatacctgtgatgcacactgaactttcagaacctagtagccacattaaattgaaagcccgcatttatattttaagtttgctaatgaaaaagatgcaatgaattttactcctgctatcagctggctcttttgaagttggtgtgctgtatagaatacattagttgtgacaacagatactcttccctgctgtaatcggtcctattttgtagccacagttctccctcgtcatactgaacaagttgttacctccccaaggtttctctgcatttctatttactttgttatcagcagaaaggctggggaaagcctcttcagtaatgacatcgatacgacacacacagcaagagaggtcagcctgtcagagctctagaaacagcagatggattaggatgaaactgggtgcaaaataactttgatagagtcttttaatgtaaacagtttatctgtcattgcctttcattgaaatccctcacagaatgatagcatttgggccgttaaggttacagaatgtagctgaataaaacccatacattgtcatgctcaaactctccaccaattagagaatgagaggacattttaatttattcattaaagacaggagagtaaataggataacatataaggttaatagaataacattggccttcatattcccaagattgtatttcccatttggctatattagcacagagactagattaataagaaactgcttagggcttgtatgatgtggtttttaatatgcttgagacaagtctgtgactgtttagaaacctgtgtgctgaatttttttattacaattaggtcttctccttcagtaccaatttttttgacttgtaatctatatacaatagaatgctttgagcatacagagatgcatagaagtgtaatgtttttatgtattgtgcttatctcatggtcagtaatgaccaaatactggctagtgtttaataaactttatgaattatccaactatgagcatttcagttgcaaagccaatagctcttttgcttagcttagcacttttccacaatgaccttaagtcagacactggtgagggtatgttgtttgccccaagatccaaacagaaacaaaaatggatatgatctgtcatttcaaaatagataatgctcatatgtgacagggatgaccacagccttttcacccacaaagagcacacagcacatatatggttctgtaaagagtgtggcagtgagagagcagccacctctggaaagctggggaccactaagtacagacttcagttgaagtgcctggagaaaagagtcctcatcatgttgccctttctgggctggaggaagtgactggacatcactggtcctttcttcactcaaaccccaccctctgtttggtccaagcacattcttttccttaagtctcttcatcatcccaattagggtcctaatccattcttgcagcctggaagtttcactctggagtcatccataagtaagtcccaggaaatgcaccatgtgtgcctaacttcattggtagtttccaagccttgagtttaatcagggttctagaatatacctagaacagtatgcacatctcaagcaaaagttatataatgaaacactttgccactttgaaaaagtaagattttgaaatttatattctgtcttgaacaatttactggggctttggtttagggctcaagaatgcttaactctaccccctcccccccagatatctgccatctgctaaaaaagtcaccaggcaggctgaaaacaccaaggaccttgttctgcctggaaaactgaattgatattttcttaagcagctatatttacttttatctttatttatcaagagcaaagagcataagcattgtaagtgcacagaagagtttccaaatttgagattaaccaatccaacattaaccattcaaaatacaggtggatgggcggaaaaaagaaacaaaactttccaaaatgtatggggccacataactcgtatttcacacagcaaaaatttcataggagtctttggaacattttactaaaaatgtataaacttgctaaagctagtttattgttaatggaggtcgactaaagcttcatatttaaccctgaatcatatatatgtgtgtgtttctcaaaaaactaaaaatagaactactatatgacccaacaatctcactactgggtagttttccaaagtaaagaaaatcagtatattaaaggaatacttgcaccaccatgtttattgctgcacaagtcacaatagctaagatatggaatcaatctaaatgttcatcaacagacaaatggttaaaatgtgagatagatagatatatatatatatacacaaaattgattactatttagccataaaagagtataaaatcctgtcatttctggcaacattgctgcaaaagcaagtagggctttagttcttccccctcctgtggagtctgcagtccggattcatgcccttccccaagttctggccaggagatttctcaatgggttcaaattgttacaaagttcagctggaggtttccttctccctgtagccttttccgagtgcctctagcagccctcctaaaggacctctgtgaggcaaagctgaaattgcttactgggggggccagcaagcccacagggcttttcccactgcttcctctacccctgtattttgctagcaggggtattgtgcttacaataaaaatggctacatttttattgtagggatacagggaaccaagttacaattggcaacattaaattcacacagacaatgagggaaagagagtaaaagtgtacagtccaagtgtgttaatacccatgtaattttatttgaatattgacataagtgacacccacccaccaccttaaacacacacatataaatgaagtctgcaataacatccttttgtcttattgacaacaagtatggccatgctactatatgactgtatttgtgatgttctggctgtgaacagtgtactctgtgagtgagtgagtgtgtgtgtgtgtgtgtgtgtgtgtgtaagagagggagggggaggggagagagagagagagatacagagataccgaaacaaatagaaattctgtgcattactgattggcacaccactgccctcacctatggatgtgtctgttccaatcccatatgctctgttgtgttcctctgtgaagagtagtgcagtggtacttgtgataattcctcagaaaagtggaagaacctggcctcttatatcctcattttccctcttcttctcccctctgtatcttctcacctctcctgcccaaccattcttacctctctaatatttcttctcccagccctcacttggagcagaatcacagcatgagctcaggttcttaaagacagcgattaggttcaccttcaagcctctgagccacgagcctgcctggtaaagtggagaaaactttatagtgagtgagagcatccctatgaccaggcatgtcccagaatccccaagcctagccttcagaatcctctgggcataaacatggactcgagggtcattaagtcttagtaagtctttattcctctttactgcatctgcagagaaacaacgtgctagatacaactccttagctcaggggagcaggtgtgttatgaaatgaggggaagggcactatcctgaagagggaggaatctgtttgggggatgatattaattcagcttccctcgggagccatgaaaacattgattttgtaccattaagtcttcacagtgtgaccatgaaactgttctcagcaacttttctgttttaatatatttgtgtaaatcctgacgtagtttcacaactgttacaattgaggcttcaaaagatgaaggagaagacatctaaaatagacacattagactctgtggcacaactctgtttattggcagtgtgcatgcctgcagataatggcagcaactatcttccaacccagcaagattctccttctcagtctataactaatggtgaacagatacagtatttggagagaggtttgcatgtgtttcagctcttttggcagaaagtgaagaaaattccacattttttttctgataaaacatattatattgtcccttccagccagagcagaagtagtgtttcctgagaggctcccttcctgaatgatgatagggtggacctgatagtactaccaggacatgctacagagcctggttttcctgactagagttaaaaatagactgagggaaaatttagtacattagacaattagatggtattttttgcctcctagttcagactattttgagttgttagcacagaaatagtaatgctgtctgtggtccaagagacattctgctttgatctgccatgttctcgtgttcattacttctcttttgattaatgagaaagtaactccctagcttcctgtttctccctcattgtgtccatcttccttattgtatccacatttatcttcccacatcaagtctgactctatccagtttctgcttaaaattccttcccttgaaccctacattctccattgcatactacagactttatgtaataaagggcaaacaccattgttgccaaggacattgttgccaagtccttcactcaatattcaatcacacatatatatgattcagggctaaatatgaagccttagtccactatatatatatatatatatatatatatatatatatatatatatatatatatgtatatgaaaaatatatatatccatatgtgtgtatatatataaatacatatatatatccatatgtatataatccttttagatatatgtgaaatactcctgtgtgtgtattaaaatatagaataccagaccttaaaatgaccatagagagtttttactctagctttctaattttctcaataaggaaactgagatacaaagcagtcagttagtatttagtatataaataaaaatgtagtctcattacccacagtataatgtgttccaaagggataggaagccttatcacactagcaggttaatgataaagatattttatcagtatttcctgccaattaggtttttgaatatgtaactgagtacctactatgtactaataatacacttcccatttcttctggttatgaatggtagggagaaaacctctattaggcattgattgtctctcactaaaagatacatgtcattttatgaggtgtgcccccttagcatcaggggcaagagggctcagattggttagggggaagaaaattgaattttcaaacccacaaaccccaggggaacagagtgaccaagtgccacttacattgggcctcctgactgggaaaaaataaacacctcaatgcaatactgaagtgcttggctggcatctgcatatttactccacttagagaatgattagtgtcaacagatgactttgtgggtgaaacatgcttcttcaccaaagacagtacatttttcattaagttacaataaaccaaaccttagttataaaggaaatttccaattgacaaatggatcttgccaaaggattttctatccagcaacatagccagagtgaagggagcaagtctttatggagtgcaggcacttctgaatgctgttatcacgtcatctttgggctggatgctcacaaaactctggcttccatggtagtgaaatgcacatgcaggtacaagtagtacctgctattcagtggctgttcaactggctgtggcagggtctagaatggcagtgtgagtgaaattgatatttactcaatgagcaatgggaagccatgaaggattatgacaatgagagcaatgtgatcaaagtggagccttaggaggattcatcttgaagtagaacataaaatagatttagaatagggagaccagtagagaagtgaggtggcagtggccatagtcctggtgagaggcaatagaaatcaagttagcagtagttgcaggaagagtgaggaaggcacaggtagctacaagccttcttccagaaagtgggatgggaaattcaccctgtgaatgctgctccagactccctcctcttcggagtgtaaacaagagccttacattcagttgcaggatgaattgagatgcacatcagcctggagctcagctcttcctccagaggcttattttttccctccatacagagcttactgtcctctggcacattttcatgcccagagcataatgtccaggcctatgagtttgcctagtcattcttgattcatttatctcatcaatgtttaagtgactattaagtgcaagacatagttctatccactgagaacaaattttccccaacctctgcctgtcaaaagtatgttcctgcccctgttacgtatagcaaagacctatttcattgattattagaaaagaatgaataaagttaaaatgtggaaagcccagtgatctaaagataggtaacatgtttttgcttcctagaggttcaaggttcaaatacagaatgtttccatgcacgttttcaggcatccataataatggttagtgttttcctgaagattataatccccgtatgacaagtcagaaattcaggcatccaggtgttgcaaaatcttgagtgacattttgtcctcttaatctgccacccttggctgtgtgtgcttaatgccagctggggtttagcctacaggatacattgtcttttgccattttactcattccagtgaaatctatttaaatgctgtaattaagcgattcatttttatatttaagcaagtgctgtcagtatatgtctcttcaattgttttagccaattctgttggtattgattttaggccatctgaataccctaatgatgagttcatttgttaatggaagagtttctcttctgaacttaagcaatcgatgcaatttaccaatacatgctgctaggttagggtatagctgtgccccacagaacaatcatgtgaaaaaaaattaaatccaaaacaaaacaaagaaacacaaaaccaatgcaattaattgtttttctgtctttttccatgttgttgaatacccagttatttgaaattatctgaatgattggattttcccttttgattaagaaatgtaaaaacccagtttggatgtatctgctagtagaatgaaaggaaaatgcatatgaaatggaaatgtaaaaggcatatagagcaatactaataaaatcacattttatgcttgactgacagtattattattgattatggaagaaatgaatacctgagtccactgccacaatatctctaggccatccaaatgttcactttgacagtctcaacatacaggaaacatattgcattagatttgttttctgtaaaaggagggggataatgtcataagtctgactgttcagagcatgcttcttataacccccaaaagattctcacattttctataaatatatatatatataacccccaaaagattctctacattttctataaatatgtatttttagtccaatagacatgtctatttatacatgtctattggactagaatagcaattaattgagtataatctctgagacagaattaccttgctaaagaattttgaagaagtgttatcattataaagaaaatggctggcaagttttctaagcaccttttatgtcatattttatccttaaggaaatgtgataccatgtatgccacgtggatgggactcaagagacagcaactgtctttccttccttccttctttctttctacctatttttttgtaatagtgctatatgatatggtttttgtaattcaacatggttcctgggttacttgagctttagtgcagcacaaggattctctatataaaagaaagacaagcttcttattttcaggaacataggtttagcgagtgagcaaatctgagcctgtctgtagccacatcatccctccaaaggaaataaatgtgctgataatgagagaggagtcacctcagaaatgctccttggaatcagagaagttccttcttccttgcatttaatttctcaagataccccatgacagaggtggcccatgtagaataggagcttcagggcttccccatcctcagggtccaatgttaataaaaaagtaaagagcccatctgatggagtgaagtgtggaaggaggggctactaaaggagagatcaactggaaaatatggaatcatcctaggcttccttggaaacacagagaaagagagagaaaagagagaaagaaaagtagagagaaagagaggtctgtagaatctaaacatatcaaagtcttctgtgaatagcactttccagacagaagcattctattcactccagaaccactactgatatggagagtagaagatagtggttcctataatcctcattggaataactacgtaggtttcataccacaatgtggcctctactcagtaagcccatagactatctggctgtaaaaatctatgcatgaacaactgtgtagaaagcagtcacaatcaaggtgcactgcatttgcatatcatgttgcagcttccagagcactgttgtcaatgttggctactcacaaccaccgttgctgtagaaaaggcaggaattattatcttcatttttaaaatgaagaaactgatgctcaaaggtgtttagtacttgccaatagggtaagtggcaaatctgggactagaacccaggtttttaacatttctggcacagcactctctccactctagcctattacctctcatcacaccatactggagtacattctctaacattttaatttcttttattgtttttttcttatactagagcttcctcaattgtgagataaatatcatgatagggaaccatggcacaaaataaggagaatataggtttttaaaagcatatagacgttataaattaaagcagcataactgttaactctccagcctccattttccaatcagtttaaattactttaatgtatgtttttaaatttaaaattagctgcaatcccaatatgtaactgtcttgatgtttggtgaattgtgctatgtcacttccttttaattttcctccttttgcagtgtgtctcacattctggcaagtgtatctggaacttgggatggtcttcttatgtcccatcatttcaaaagagaaattctctctttgtgtatcttgtagaataattcacatatcatttgcacataaataattcacttaaaattttttcctcaaagtctcttaatgtaataattcctcatagcatacctaaaacaacatcaaattacagtgaaagcatagtaacacattgcgagctttttctcatatggcaaggttctctgccatcatttactctaccatcatttacttgccatcatttacttgagagattcaaggtgatgagcacacaagaggatgacatgaggacatctgactagagctgttgggacatcagaatgatcacaagttaatttccaaagaaaagagaacctctcagcatagacattttcaatcaatagccaggcaacccagaaaaaataatttgaaggaagttattttcctatgttggctctataaaaagatgtatgtttcaaagaaactggcctcaaacatgatcacgttcctcctgatcagagaaaaataactgggtctaattgacagttccaaagcatagagcagagagggtattttcaaaaaacatgcctccgaatcaaagggaggataagcaatgtcactttgatttttccctcttcctgtctcctgccagtggcaagctcatcctatcacatccagcatgctttaaaaggaaaccacttgaacacagcacccattactttgtgataacctaagtcttctagaacagacttatctggattctaagggattgaaaaaagtggattcacatgatttccacagtgacatgtcttcagcctactagtatatcttattgcaaaccagccaggcttgggagagaaaagggttttttaaaaaaaaggcagatgtgagtgtgcatgtatgtacagactgggtcctgctgctgtaggaaagctgcatggcagtccccacttcttgccagcaccacttctccctttgttcttctgacatgggagaatctgcaggatgagtgaggttcacatcctctgtacatggactgcaaatggacagcaaatggacaagttttcatgtccaagatacatgtgacagatgagttgggccagccagacacatatttcttgttttctcattttcacctcttacctcattccttagcttttttcctattctagcacttgccaaaattcaacctcaggcacagatggtgagaaaatgatttttgcctaccaagccaaagaaagtgcccaaatattaatggttatttatctagaaacagaacctgagacttagtaaatggaagcatggatttccagcactaacatctaaaatttggaagtgttttattcagttgttatgcatagaggtcttcagtatgttgaatatcacttgtcaccgagaatgtcaagtccagagttagattatatgttgtctctgctaaaagtggttgcctctgtattctaatttacagcagtattctcttctctgtagcccttacccacctccaagattcacaaagatccccaaacagatacttttttaaaggatctgaacaaccctgaggttgtcaaatagctgcttcaatgctctttttatcaaacataacgtctatagcctgaaaaagtctatgggagtacaagtttggttctgattacataattatgctacagaaatatgaaaaaaaaatcatcactaaaaccctccaggtgcttaaacagtttgatagactgtagccattctgccatcagcacccccagctgtgttgcttagcaacattttaattccagaagaatcgaaggagatgaaatccctgtggagaaggaaacagaaataagagggctgttgacagatgatctgagttgtttcttctaatatactgtgaagatcactagctcttttcatgaatgataaatggactgtacacagatcaatgggttcagcactaaactggaaccgggctccatgtctaaggcaatgcaggccgagaggcccagagatttcctcatttctatgatttggtgtatattttcttaaaggttccacaggaggaaattgatctgagtattcagtcattccttgcccttctgtggtgtcggctaataaaaatgattttagaaagggacactcgactttctatcatggtggaagtatggccagatgtcagtagtagtgctagggtgagcagttccctaccacaaatctaaaaatccaggatatgcccatgaccattccgtctgcatctgtttccctaacctgtcgttacaacccaagcaggtccaaacacggtaagattagagtgaaaggtgggaagagagggaccctagttatgcacccagaagtccacttttatggtccctgatgaactttctaggcagccctcacaatatccacctcacaatttccacctgtattggaaagctgcacttggacaggtaaccatgtttcccaggagaagaaaattgctttctgagtctccagtctgcttatctacagcaccctgtttcggttagctccttatgtttctgaagagcattttatattgcttattgttttggtagctagttgcaatgattatgcctgctaatattgtctaattgcattttttcttctgtttacaggctgttgaaaaggcaaaacctaggaataatcctgtgaagtaagttattatttttattagttgcaaatgttaattttaacggactcgatgcatgtgaaaaaataaggtcataaaagagaccttggattttgagttaatctctattcatgacaatttaaagacaaaaacaaaacaagccaaaaaaatcctccaatgagcagggaccagcttatatttttccctgtgctcctgatgaagaaatgccccaagttgtacccagtttacataaattaatatgtgcaatccatgaatagctgccaaatacgattataatcatattcaatacatagtacttcaagcctttgggttttgcacatgctaaaaagattacatttttaattgcaaaccttggacctatgacagagacataaatgactgaaagtgtgccaagtgatttccagccacgtggggaggtttggcaccttggcatcaaggcctcaatactctgttaatgaaaagctcataaaatatacttaactaaaggcttttcttttttgttttagctaacagaaagcaattcccaaggcattttatgagatactcttaaatcataaacaagctacacagacctcctttaaatatagtacatcttagacatcctgtctcttccagaagggagactttcaaattaagaaggatggctgtcttgtcatttggtttgtaacatctgattgcagtgttacaatgcatgctagtcctgccagctctgtggctgagggaggactttctctatttgctgggctattataggtctggtaatatcacatctcgaggaactatgtgttaatttattttggctgacttcctttatagttggtaccaaatacagaaatggagagtacatagatttttaagtttctgggagaatggatcagctaatgccaacaagaaatgtttttgttttgtataataaaataactaaatttccagagcaccagggtagcatttagcataccattaaatccaagccctagtacgtttttccaaaaggtgttgtgtactttgcttttaagtttcatttttcttaggccaaagaatattccctatcaggctctgtaacatctagaggggcatccgtagtctggagatatattatgttgtagtcttatggaagtatttgtagtagctgaggttttgtcaggtcgtgcagctgggggttgaaatcttctctgcagcctgatttcttttccgtctgaatgccctaaaggctcctccactgtgagcctgtggctggcaagctcggagaattagaggatggtgctaatgaggccagggtcagggcttttgtccctgggtgggcgattagtgatcttctttcctgcagttcaactgcactcctcccttcagtccgcctgcatgcagatgtgtgccccaggtcataaggagtggggctagggctggaggaatgtaaatcaaggccctcaatggcaaatgtctccaagctccagccctcccaataggaagtgattcccaagttgcatttttgcatgcatggaatagcccattggcagtgtttggggttgcatttaattctattctaatggcctagaagcaggacctgttttctctttgctccttgtgagaatttgaccctacagtaattgtatttttatgagttcttattaattcacagtgcacactctatctaatgtctagcgttttgaggaatgttataaaaagaaggaacagaaactagaagagtcaaaggattattgagctttgtgctttaaatatatttgaaaatctgcttagtaataaacctaagtcataaccaactggtaggtgtttagaattgtcttctaattaagtaagatactgttctcagaatgagtttgggttcatgataccaaactcagcacttgaagaaggagacttcctcaagacctcagctcagaaacaaaaactccacagcagggttcagttgctctgcctgacaggagaacagagtcaaagtttttaaaaagttttatacatagtggtccttttgccatttctgatgacatcaaaggcatccctcttgaggaaatctcgactgcacaaccctactatgcccccagttcagcaggaagcagttagagcagttgttggccaacctccccaacagcacttgggttttcccattgagagggggactgagagacaggactagctggatttcccaggccgactaagaattcctaagcctagctggggaaggtgaccacaccctcctttaaacacagagcttgtaactcagctcacacccgaccaatcaggtagtaaagagagctcactaaaataccaattaggctaaaaacaggaggtaaagaaataatcaaatcatctatcgcctgagagcacagggggagggacaatgatcgggatataaacccaggcatttgagccagatcaggtaaccctctttgggtcccctcacactgtatgggagctctgttttcactctattaaatcttgcaactgcacactcttctggtccatgtttgttccggctcaagctgagcttttgctcgccgtccaccactgctgaatgccgccattgcagacctgcccttgacttccacccctccggatccggcagagtgtccgctgcactcctgatccagcgaggcacccattgccactcccgatcaggctaaaggcttgccattgttcctgcacagctaagtgcctgggttcatcctaatcaggctgaacactgttcgctgggttccacggttctcttccatgactcacagcttctaatagagctataacactcaccacatggcccaaggttccattcgttggaatccatgaggccaagaaccccaggtcagagaataaaaggcccgccccatcttgggagtggccaccaccatcttgggagcttgaagaacaaagatccccccggtaacactagagaatttcagttacacacaatgcactggaactccaaatagagtaaaggttcaatacaagtttacggaatgaataagtaaacaaattggacatatcccagaaaacagggattcttccaggaaaataggtttcttccaggaacctagcctgcaggcttgataaggctggtggctctcttctagtagagtgtcaccatcatgttaaaagaacatgtgtattgtaactaaccaagtggtccagtcctgtcgggcgaaattcacccctgatatttcacgtaggttcttttctgttttccctaagtgtcagctggtctgagacataaagggaaagagtacaaaagagagaagttttaaagctgggtgtccgggggggacatcacatgtcaacaggttctgtgatgccccccaagccgcaaaaccagcaagtttctattagtgattttcaaaaggggagggagtgtacgaatagagtgtgggtgacagagatcacatgcttcacaaggtaatagaatatcacaaggcaaatggaggcagggcgagatcacaggaccacaggaccggggcaaaattaaaattgctaatgaagtttcgggcacgcattgtcattgataacatcttatcaggagacagggtttgagagcagacaaccagtctgaccaaaatttattaggcgggaatttcctcgtcctaataagcctgggagcgctatgggagactgggccttatttcatcccacagctgcaaccgtaaaagatagccacccccaaagcgaccatttcagaggcctcccctcaaggacgcattctctttctcggggatgtcccttgctgagaaaaagaattcagcaatatttctcccatttgcttttgaaagaagagaaatatggctctgttccgcccggctcaccagcggtcagagtttaaggttatctctcttgttccctgaacattgctattatcctgttcttttttcaaggtgcccagatttcatattgttcaaacacacatgctctacaagcaatttgtgcagttaaggcaatcattacagggtcctgaggcgacatacatcctcctcagctttcgaagatgatgggattaagagattaaagtaaagacaggcataggaaatcataagggtattgattggggaagtgataagtgtccatgaagtcttcacaatttatattcagagattgcagtaaagacaggcgtaagaaattataaaagtattaatttggggaacaaataaatgtccatgaaatcttcacaatttatgttcttctaccatggcttcggccggtccctccattcggggtccctgacttcccgcaacacagtccctgttattcttgactcatgccacatgtaaaaatgttcctccattgctctggttctttctagctgttctttttctgaccagttccttgtttgatctcatatcaagaaataacatttgattgtctttttgagcatacaatgaaaattgtgtacagttttactggaaaacagaggcccagcggcatcatttacaactcaagtatgaacacaaattggtaaatatgaacatgtgtgtggtttcatatagccctttggtgtagaatttggcaaatggttgaaaaaaataaaaagaagaacatttcttgacatgtgaaaattatatgaaattcaaatttcagtaagcataaataaagttttattggaacacagccacactcattcatttccatattgtctgtggctgcttttgtgctacaatggcagagttgagtagttgtgacataaaatgtatgtagcctacaaagctgtacatttttaccatctggccccttatagaaagtttgtggactcctgctctagttggtgaggcagaaaaaagcattaagcttttttgtgatgctgaaggttaaactatcaatcctttctcctttggcctttaaaacagtgagttttaatgagcccttattgtgtgtttaggactttctagggttgatgtgccacttaattctcattcagagcaaacagattcgctcttcactcactacctttgaaaatcatatggatatgagatccattgacagggcattgatgcctcagaaacaaatgaacacatagaacacatatctagggcatactgctagccttccaaattgtgtgtagatggatttattgcaaagggcatattaattttctaaaattctgtcacttccacatctaactaaggctaaattagctttcagttatggtgctggtaaataaacttattagtgtatggctaataagtttctaaaagttttgcctccctcccctatttcttaaccactctttcaatttatttttaatactttcatggttgtaagctgcttctttcattgccatagggagactgtgatatacagtaattatgctccatataaaaaagaaattaagtatatgcctagtgaatgtaagcacataatgtacctggatacactaatgccatttccttgaaacattaaatattacctctgagggtaagactcaaacatgagtgttcttaagatcactgatcaggacaagggaaacctggtctatttctcactatactggaaccatactgttatcagagcttgattagtatgttcaaattatggctctttaatgtgtcagaaagactttcacttgtattttaatgctctgcagcagtcatctccaagatttcattgtgacagcaaggcctgagagatgtacagatttctttcaccatatgtgacttatcacatacatttttttcaaaaacacatttctgttattaagacatatgtgatagtacatttctgaaaatgtgaattgcttttggctaaaagccatgcactaataagttgagttgaatctaaccaaggttgacatctgttaccaaaagagagagagaaagaaacagagagagagagagagcatgcacacactgttgtcaagcataaaattcttccctgcttttacactttaacaacattaaacaatgtgatgattgtctttcacaattcaggatcagaatccactctgcgtaggaaattacgtttttttaggacctgattcatcatagatatggtgctttcattagtgaaaatgacaaatagccacaaaaattttcctgactatgatatttgcacattattcatttattcatctgatgaatatttatttaggttctacaacattctgggaactgtgataggtgctgaggaaattaaaagtaaatctgacacaggtcctacccttgaggagtttagagtctagcagaaaagataaaatcggtttgtaaaaaattaaatacaagatatatggggagagaaatgtttgttaagtggggaacagataaagtacagggaggctctaagaacaaaaaatgcttctagttaacactgtcaaagatggaagggacaatgggggaggagaaaacatttgcaccaggattttaaggactgctggtttgcgacactggtgctgaggtatggcaagggaaagcaaggagcccaggatgcctgatggggtgcaggcagtgaaataccaggttggaaaccaaggctgagtagaaatggtagcttagggccctcagagctcacccagatgaaagagattcacatggtagagtcaaatggcattaaagagctcttcacttggtactgaatgtgaattatccatcagtcccctaattattaaacacaaagggttgatagacctgggttctagtcttgaatctgatattagtttgtagtatgaaattgcatgcgtcaactccttgttataggcctcagctagattatttacatggacattccacttctttaaaaaagtcaaagcctggaaatctgttttatgattatactcattttagaacaatattaaccctgttagttcgatgtagattcatgcatgcacataaattatatatatatatatatatgtgtatgtgtgtgtgtgtgtgtttatgtgtgtataatgcatctgtatttaactccacacacacacgtgcacacacataatgcctttccccaccatttttaccttttacatttgtggaataaaggacaagaagacacatcattagagtttaaaaaagatatcttaggtggaaaataagtgtggctccaaagacacttggtaaagcctttgaaatggcccccgaggaccaaaggtaattttgcatttggagtccatatctcttgtgatgttcttgtatacatgcacatcacagacatgcagaatgtcagtcagttaagtcaccattctgaataaggcagtggaatctgatttgtgttctgccagacaagttttgtgggattttctccttgagaataaaaggctccagcaccaagaagttttggcatcttctatcatatcccttccctggagcatcactgtgcacattcacataatgtaggctcaaagaaggagttctgtttagctttgtcttacctaaggattcccaaatgtgtttgaccagaggatatctttgtctggcagggcaaatgtttcatgaaacacaaaatcgagtgttgttgctaacaataaagtggcttcattccatttaaaaatctttaattccacatttgttggcaaggtcacagagaaaagggacacttgtacaccgctggtgggagtgtaaattagttcagccgttgtggatagtaatgtggcaaatcctcaaagaacttaaaacagaattactattcggcccaacaatcccatttttggatatgtacccaaaggaatataaatcattctaccgtagagatatatgcacgtgtatgttcattgcagcactattgacaatagcaaatacatggaatcaacctaaatccccatccatggaagactgggtaaagaaaatatggtgtatatacaccgtggaatactatgcagccataaaaatgaatgaaattatgtagtttgcaacaacatggacagagctggaggccattatcctaagcaaagtaatgcaggaacagaaaaccaaatactgcattattttttaaaattttactttaagttctggtatacatgtgcagaacatgcaggtttgttacataggtatacgtgtgccgtggtcatttgctgcgcatattgacccatcctctaggttccctcccctagccctccacccccccatcaggccctggtgtgtgtgttcccctccctgtgtccacgtgttctcattgttcaactcccacttatgagtgagaacataaatactgcatatttttagtgggagctaaacaatgagaacaatggacactatgaaaggaacaacagacaactgggcctatctcagggtggagggtgggaagagggagaggattagaaataaatacctaccagatactatgcttattacctgagtgatgaaataatctataaatccaacccccattacatgcagtttacctatataacaaacctacacatgtacccctgaacctaaaataaaagttttctaaaaaaagaaaatgaattgactgtaaatgcttagatttatttctggattctctattctgtgccattcttctgtgtggctcctatgtctcttttacagtgtgacactgtaagttgtttttatggattgtaaatgccctgagacacagtcctcaatgaaggtataggaaattttggggtgggtcccaccgagtgagatacatgaagctaagtagtccccagtgagcttcatcagatcagtgggcaaaatgcccagtccactcatttcaagataatgaggcaccctcaacaatgtgcttcctacatcctccccaaacctctagtcaatctctaactggctctcgccaatttaaggacaattaatggagagataccaataacatctctctctaaatagctgcataaaataaattgggctcttaatgttgttcagatagacacagttggatgcaacaggttccagcaatcatcctcacagctaatgaaatttgcacaaatgtctgaacaccttccttttcattggtatttggatttgtaccatctaggcaatctcagatgagaaaactgagacccaaagagcaaactgcccagaaccccaagtttccaggaactctacagtttttaccaactccctctcaggacacacatgtccactttccatgcctagaaatgtgttattggttttttcagttgtattatgtaactttatttaacaatttattttcttagaacatgacaccaaatgtgtcaaaaattaatgaatcatcagatttgcaggttctttaacaattatgccaacttcaattatattaaatttatatctgtaaggataagtttcttcaaaacttcaaacacgttagttgccaaattaccatcactcatctttccaaaagttttatgagaaccttttctctttaggtgttaaattaataccctaataaccatagggataaaatagaaacaaaaagcacccatttattggtgaatctgatggacctcaactaagccagcaaatgtggaattaaaccattttaaagggaactaaaccatgttatttttagtatcaacattcataaaatactgcctggtccacgtgttagtttctaactctgtccttcttagtgtttgctgtttagacaagaatggacaacgctgtttaatctgcccacataagtcagctcagttttgggtacataagagttacacctagaattttatttcaatattgccgtgtagtgatctttcagtaaactgtcaaaaatgtagagtcacatagctaacctgctagaattcaagcaagccacacatttgctcttttaacaaacaataatgatgtccctactatgtgccagacacagttaatagagagattagttaaataagatctctactgtgagagtccccacacactggtagggaaagacaaagccattacactacagaataggtcgtttgtatgattgaagcatgtgtagcattctatgggacagagatgaaggagggagtgactgctgagagtgagctctccctatctcagcaggagtcccccagtgaacagtggggagaggcctttcaagagagcagaacaacattttcaaaaggcactaagagaagaaagcagatgctgtgttgtgagcaatgtctggtacttagaggcagctggggcggggggtggcatttttcacagtagcggaaaataccaagtgtgtgagttgtagaatagaaaagaaaggaaagagttgttgcatgtgccagtatacctaaagcatcacactgccaaatattaatacttgggccctacttttggtattaggaggagagcagtgtagtgtgggtgaaactaacaaaatgctggaaaggattcttttattctagaaagttaaaggttagagttagggagagattataaggtgctctttttaaactgtttgcaaataaatagacacatcaaatcctttctgattatatctagctaatccttctctgtggacttttatgtaaacctcagctcatatagagttcctgtaagcattcagctgttcccttgtggcttcatgaacccttgattatttcttgcatttttcaaaatgtttctttcatacagttcctttcacattacacaaatgtctaggctacactaagatatagtattttaggcatgacacaaaacactattattttagcttcagtttctgaattcacttcacagacataaaatttctttctgaatgtatttttgtcagcccaaaacataagcacagtagggctatttagggctatttttatttctagggaaatgatgcatgcccccatggtgactatagacaggggtccaaacagtaaatcagtcctctgtcgaccgcagaatgcgttcagagtcaagagcctgaggtagtaagttattattcagttgactactagtttggggggactgagaactacagaaatgactcattttggccagggcctcaaataggaaacaaatagtatctgctttcttaaagcttttgcctaaatcaacaggagttaactagagagccaccattgaaaaagaaaaaaaaagtaaatcattcttccacaagaaaatgtttttatttgtagaatttacagcataggggtatattacatgtcattataatccagtttttatatgcacatgtgtttatatactctatatcagcataccctcatgcaccatggtaatttaaatccaagacagaattgttccccttgttggggcaggcagaggcagccataactaaaagaaggtctcaaatctttttctcaattctcattccttttccaatttgtttactgtcttctgcacctctcagcaccatactgtcacaacaagtgggtcccacgtacttggggaaagcatttcagaaaactgttgtggcttatattcctccatggaagcctggcaaagggagctcagggcagccaaagagctccttcgtactcattcatgtttgcattatcaaacgctgcagtgtggttgctggggatctgctaataatagcatctacatctaaaatcacaacttattcatctctctcacgagctggagatgtgtgtaacttccaacactggctaggtgaaagtttaacttgactcataccatgttgcgcaggtttaatagcaaattagacatgttagaaaacttgctttaaatatatatgtggatgtgtatatacactctctacatacacattgtacactcacatataatttaagcttcacctatttccaaacagggatgtaacataattgaaacaagattgtacaggagaatgtttaaagaaaacagaagaacctatttccaaacactacagaaacatctgtttacatatgtgatggaactagaaaaagctatgtgtttttaaaatcaacacccaaataagggccacccttacaatgacacagcagagcacagctgtgcccttcctgcaaggatgctgttgtggtgcacagcccgttgggagatccccttggagagtgtggtcaaaccatgtatgaggttcttctcctggtcttagtgatgggtaatagacttttgaatgtggttttaactttttttttttttttttttttttttttttttgagacggagtcttgctttgtcgcccaggttggagtgcagtggcgcgatctcggctcactgcaagctccgcctcccgggttcatgccattctcctgcctcagcctcccgaggagctgggactacaggcgcccgccaccacgcccggctaatttttttgtgtttttggtagagacggggtttcaccagattagccaggatggtctcgatctcctgacctcgtgatcttcccgcctcggcctcccaaagtgctgggattacaggcttgagccaccgtgcccggccggttttaacttttaaaaactaatctaagatggtgattcggagccatggatgttgaaaaccagttgtaaataaaagcagttaatgtggttcaaaataagaatgatttcttcttgcacatagtgaatgccttgaagaggaattttacaaggctttgagcaggaataacaatattggaccaccgctgtatacaaaatagcatacaacctatacacgctcactctctttaccctactttattttttctcttaagtactcatcattctctctctctcactctgtccctttctctctctccatgttttgaagtgtcacctcccacaagaatgtaaggtccatacaagtgagaatgttgttttagtcactgctgtaaccccagcatctcaaatagtagctatcatataacaacagctcagtatcttgaatgagtaagtgcaaacatctaaggatatcactttaaagttcaaccgtcctagtttagtttgagtatgcgtttagtcttagaataagtatgattttgtgctgccctttggaaatcatactgaactaattattaaccattgggtaaattatttgcttttgttggaaaggaatagagttttattttataataatctatgttccatattagctttattctgagccatcataaagctagttttactgttattaatagagctagaatttgaccctccaagtgattcttctggtgtatatccaccttcatacttttgattcattccctctacaaattgaaaagaggaggcacaggagtgaagatgtcggcctccctatgaatgggggttagtgcatgggtagttatatttgatgtatgtcattaggcattttcaagaatgatagaagtcaaattttcataacatgggacaaggaaacaaaaacatcatgaagttaacagttgaaaacacatgcaattttctattttggaaaggcatcttgatcctcagaaatctgcaggattggacacacagcagccagtttcagaaccctcacacttgtcctcttctttggagttatgaagtctgagatgcatctgatacttcccttttgtccttcctgcgatactccactgtcacaggactaaaaagcattcagcagcttttcccattggccagtagttggagaagttggatggctccaaagctctaagggagcggcccttaagcaaggcttgactcactgtcacggacgtttctagccacaaggtctaggcaatatctctgcaaagtggttaaactaaacaagctttctttaattttatatgcttctcatgaatatgtaagtcattaaatcccttggtcacatctcagtgatggggtaaaaatatccctctcttaatattgaagtgtacaaaacaaacaaacaaacaaacaaacaaaacccaagaccgtgttaaaggaaataacattgctacaaggttaattttgcctcatacagcatttcctagaactgaattgcctgatctcctccctcgggggttgcgccaatgcttgcaataaccaaggctgattttattggaaaatcaccactagatgaagaacatactccagaggagattttgtatgggacaaactggtttctggtgccagtgtcatgttatccaggttagcactctttgagctcccaatctttctgttcattcaggcagcacattcattagcaacccttaaaacagggtagaataactagacatatcagggaatttactttaaattgttttcaagacttattggctagcaggccagtattcaaattgtagctcttaacatgcacattgaatgttttactagtagtggtgagactcgcggtagtttttatttcaaatgcttaacagataactctttaacataatataggacactcaaagatcctgcctaattgggaagaattatggagggtagattgataggagagagtatgatggtactgagtagtgaagatctcatgttacctttgtaggcacagcttatcgaacaggcatttcctgttagttggcttttttaattataaaaagaatccatagttatcttgacagcacagcgtagcacaactcacccagagacacaaattcggaaatataccccagcttccaaacttcaccaagtggaaatggagaatattataaatggaatacattgagcctccaggaggaaggaaagggaggaggaaattgatagagaagccacacatctgcgaactctggtgaccttgggatgacattaattctagaggctagaggacagatactcaaaagctgatttgattcaagatgggatacttggagaaaaatccagaaaggatagttttatgaacaagagagggaaacagcatatatctcatcaaagtacagactgcatctgatcttccagcttcttaggcaaaacctacaataagaaggagagaaacgaaccccctgttgtcttccttttgaaagtctctctgcctgggccactcaccaaagcacaagaaaacttgttcagagacagtgtacctaatgcctacttctagatttgtaataattcagacattaatgtagaaagccaaaatatctgtctatgctgactcattggtaccttccttttatgaattttgtgtccagattactattatttactctaactgagagagggaaagtaaaacaattcccaagattcggcactgacacaaagctttttaactactgatataggtggcatatggcttaatacttgggttttcagcaatcaaaaagcaaccctgtgcaatatcaccgtagctcagttcccagtgggcataagagatgattagatatattgagttctttgtgtcattcaaagaataaagaatctcatacacattggtgttagcttcctctcacttcatttcaattttcaataaccagtgtcatcacttgtaacagtttcttcataatgaaacctcatgtcgaattggatttgtctttcaagtgaaagcatattgggaagccttctgaaacctcatccttgaaataattgttactgctataaaatttttacatatatatataaatatataatttatttatttcaaattccccaaagaagaataatatagaaaatgaataataaaaacaaaattatgacatttgaaaaaagttataggttcacttttcatatttgacaagtctgggggaagaagtgctctggttaatccaaataatttggttaatagagctaccacatatagagagaatgattttcaaggaattagaaggctatatacccttaataaaaaaaagaaacaatgtgatccataatataatcttttctaattcagaaagaccatataagactctcactgtgaatagttctcattgtgccatttgcacagaaattctgattactcaaaagttctaggtgcttggacacaatcatgctcagtctcattttccagaatatcaaattatgttcttggatttggtagtttggtgttaaatcacacctttgctctatgtggcttcctaccacctcaacaaaactatagtcaatcacactgtgatgtaaaaaaaacatacggtagtgtctgcacaaattctacagtgtccaggttaagtcaagcattgcctagacattttgtctcctactttcccaacaagaagatagttgtattggggtagtttttctatagattatagattattgagagtagaactcccccaggctttttagtggtatagatgactgaaatccagacatattgatccttgtaacatttggagtgacaaggggtaggagccctgaacctcttgactgcaaaccatcatgttagtttatcctgacatactattccaattctttcctttgtgggccaagatttgtaaaaggttaggaattactatcctagggatttaggtgttgcatatccatgttcatttttttgaaattaaaattctataaagcaaggtaaagtactcagatggtaaaagctttaaagtcatggttctctcttccttcagccaatttgatgagctaaataagcatttcttaaagtattgtccatgaatggtgttttgagggatgtcaataggtattgtgaaggacaaaaatgtgtatgtctttggggtgtgtgtgtgagtgtgcgtgtgtgtgcgcgtgtgtgtgtgtgtgtatttggtggagggtggttaaataagtatgggaaattctgagttttaaaatttttcttctaagttgaattttgagcccttaatattacattgtgcacctctaagatgggggacatagtttattgttgtgtttccatagcttatttgaccctagaagctttttgcctatggaatatcagaatcaactttgagacatgctggaatgagtaaagttgagttgtgttggtgatttcgacgcatcagtgggttaaggaaagtcattgctgtgtaaggctacccctaactgagccagaagcaaaaatgtctttaggcaacatgtttctggcatatggagccgctgcagcaaaccctggaaggttcaccagcctatcaatggggccactaagctggacagtggtcctaagcagggagtctttaagccacagcctcattgcaagcaggtaaattgagctaaaaagttggagatttatggttcaactaattaggtgattatgaatactcatattggctaggtcagcatcgttagtaatgtctattcctctcttaaactttccccatggtagacatataaagtggggattttgagatcattacacaattttaacagctttattgagatataattcacatatcatacagttcactgatttatacaattcattggcttatatattcacagatttttgtaacaatcaccgcaatcaattttagaacatttctctcaccccccaagggagccctgtacccgttaagcagtcactcctcatttctccctccagtaagccttgaccagtaaactactttctgtctctatggattcacttattctggatatttcataaaaatggaatcatacagtatgtaaccttttgtgtctgtttctttcacttagtatgttctcaaagttcatccatgttttagcatgggttagaaccactagctgattctaactagggaatgttactaggaaaaaaagaatggtcttcccttttctacattctaaatgtatagggagaaggaatttgatggcattttaagaacattgagagatattgaaacaaaagtaaatgataacttgatacattctgatgcttaagataaaatgactctattatgtggatccttctcaaaagcattgaacatcttgtggattagtttttagtaagctggtgttaagtatgaatggtgttcttcaattctgtaaactattcgtcctacttgcaaaacaaggaggtggtgtggctattgtatcacatatctatggcttcccaattcatattcttacatctggcaatttcctattttatgaaatattttaatatggcaaactcattccaattacacagtcattataagttttgccaaggttgagtatggatcgttttgtgttcattagagcacaaaattagaattttcattgctgcaaccataaacaccattggcacaaaggatttgagcattttctcataaaatcttggacaactgataattgttgttttccctgtttttcagcatattttaattttttgaaactattttctgtatttcctcccctggtatatttcttttggcctagaagtgattctcttccaaacggatgatgtcgcacacgatgcatgaactagtgaacacagagagcaccatccctagagtcaggggaaggagcataaattatttctttaattttctcagctttagttggtccaaagtctggcagttagacctgagtaagtctggaaaaaccgtctggcacacctacatctgttctcacatttgccaatcaggatttatcaaaaatcaatggctcaaaaacatgaagctcttgagaggtgctaatttgtggctaaagaataattcaaatgcagcaccatttggtcttcatggaatatggtttcgattttgggaaattcaatgactgtttcatcttgctctcttatattctctgttaaaagaaggaaaactggaaagtagttctaatctaaggactttatttcccctacatttgtccctttggaaatttggaataactttgccaaggggatttagatacatcagtgctatttatttattaatggtcactcatacatccctgatctcttcctacttatcaggatgttctcagcaaaacaccaacacttgattctgtttttcacttaccatcccttttctccaaccctctgcctgatattcgaagtcaatcacctatgaagaaggtgactcccattcctctccctccgaggcagcaaagaggagataacattcattattcattgcaatgtttccactttgccaagatgtattctcttacttcaaattcagaacagtttattggcttctgggagttcaacagccatgggtggaggaacatgttcattagaggaagcacatgactctgccagatttaactgacagattttgaagctggagcaagcaattggctggcactcttcaggcatgaatgtcctttggcttgtgctgtgctcattgttacacaggtgctccttataaagtacgtgcacatttctaacataaaaccaataatgtcattcacataccaaaaactatagagagcttatgcccccgtgacaaatttgagatgggagcaatctacactatgatgtatatgtatagtatgatgcatatgtaactgactagattatactttgatacagttaggttgcgtttatcagactttgtagatttggagattaaaatgatttgcttttgaacctcatatgcttgggacaagaggttttgtctctgaaagccaaaagcgtcttgtcaaaaggccgcttccttaatattgcttctaaggtcagctttatgatgtcaggtctagagtataaacattaaactctactactgtttgcaaaaattttgaaacggaaagataccaaaccatatttagctcactagtaagtaaaacccaaagtgtgtgtgatagataaaatatgggcatgtgttaaaaaaaaaaacatgatgtatattagcagagttgaactgggtcccacagatacagcacagagaatagaaaaatacttcgacttctaagaaaacactcaattgtttgctttgtaggatgtatatagtctttgcctagaagagttttattctctgtgagggaatccacagtgtaccaaatattccctcttgcaggatcacaaatcactttctgaatccaaccaaaagcttctctgattgcatgtgtttatgaggctggtgagtgtccaggcctttgaagaaggaagactgtttgggtatatttgttacagaaaaaggaagttatggaggtttctctggagctgtttatcttttgtgaaaaagtagaatatgtcaaaatagagccacagcttaaactctggcagttcccagcaaataaacgaggcctaattatatgtaggacttcagctctatttaaatcaataataacaatggaaatgatcaccagatttttaatttttctataaaaagtgaattgaatgtcagcttcatatactttggatgaacctcaactcttcctagagtggaatagcaactataggaaatcaaaatgtaaaacctttttactatatggactttgattttcttcagggacagaattaaccaccaaagataatgattaaacctaccagctaatgaaaagacaatagtgagatagtgagatttgtagaaaactcatcatgtatatgcatgggtgtgcatgtgtgtgggggtgtttgtatacacttttagcaaacatcggttttctttcactggaggcaaatctgcctaaattcagggttcttacctgaagcctatgccttccatgcagatgaacaatgctagatgttatgagattatgaaaaatggagataacttggacaattagtatctcttccaaggaaaacattctccttaatttgatgcatgtgaatggaaatgtgttgagcctctactctgctagacacagtagggaatttcaaaatgaggaagccaacacctgcctataggggcattagaggttaggtggggtgggatcagggaaaggaggaattcagacacacagcttcttctacttccagatagatgccaacccaagtatgacacagaaaaactcttacaatgttagaattaggccaaaattccccacaaatccttctagtttcaacaacctttgggtaatataggcttacactgcttctgttgagttctaatgtctacacactttatctacctcacattttgccagaaggttctttgtaggctgaatatcagcagacagcccagccagatctactcaataagtgaatgcatataacaagacacttgcacagacttctaaatctaaccattccatcaaacagtaataaaaagtaaatctgcatgatattagatcagattattttaatgatttccttttaagagcagctgtccagtttgcatacgtcccttcctgaatcaaaagaaggggggaaatgcatgagcactgtggctccacacagttctaatcctgtctaatctgtaaatccctatctgctaatgtgtagcttcctgtcagtagatagccatagggataaacttaagaatattcagcggtgttatcccaaatcttaaagaaaccattataccgatgagatgttatcatctttatttttagagaaaattttaaagaccagaaaataatttgaactttttaaccagcttatagagttagtggctagaacacagtaggtatttaatatttgtttaaatgattgaatgcaagaaatattaaagaaaacctcagcctataggacaacatttccacagtgtgtgttacaggtacacttgtcccaagggatgctaagaagtcagcagtttggtgttccaaacagttacttccataacagaatgctggccgatggctctggccttgggagttcaagcctcctgtaaggctttcaaagaacctaggttacaagaggcatagcctggagtagtgaggggcacagtgtttgggttcaaatcccagctctgtcacttcctcactgggtagttttgggcaagttgctttagctctctttgtttcccttccctcatctgtgtaatggggataatgatagaatgtgccttatagtgttgtgatggagattaaatgaggtgatatgtgtaaggcagctggaatagtgtagctatgcaagccttcggtatggtgttcattcccatattggatagcctaccagctgggttcaatggcaagagttccatacctggtgtaagaagacctggatttgaaatctggttagctttgtggccttgggcaatttctttaacttttcttagccttagtttccttgtttctaaaatgaaataatgcttcctataactgctgtgaggattaaaaaagagaattaaatgagattctatgtgtacaaaaatccctggcatatggtaagtgctggataagtatcttctgagtctgctggatgagggtccttagagcaatggcccccacacccagccacgcttaagctgatctgacattcctggtatttttcttgccttatcttgcagctctactgcttcccatgtactgtgcattacgtagagagtaagtccagaggtggggaagcatcaaggctgtactggaagttccattttaggccgaggcttgctatgtcataaaagaaaataacaaagtatgtgttggtatcttttgccaagagcgacctaaacacatcaaagcctgacagttctatttatttggtctcttctgagatgaaaaggggtgaatggaaattctcgcactccacctcacactggttgcatgagctccctctccaccaatgacagtggccgactgatggtatagtttaggagggagagtctccctccactctagtcattactcttgttggggatctgtgtgaaatcaatttcattgcagagcagcaatggaagtagccgtgaattccatagtttctaaatgaagacacagcatatggagaatacagagtggaatttatagctcataattacacaggatatgttgtcggtcaagtccatcttgctggtgttcacagcaatccactcctgcccacattaaagcattgccaaattgcaataacctcctggccattttcccagtgattgaaccttgcacaccacttcaatccatattcgttgattttcgtcaataaaatgaaagcttattggtggatctatttgggtgacctcttagaataaaagcctcagtgtcacatggaaaaaacagcttatgaattctgctctgatgctctaatagaaagaaatacaaagcatttaacaggtgcccacctcacagttctacttttccccagatattttcagattttccaaccctgagacctaaggcgtcactttctctagtgattgtgtttgaggttttttatgaattctcattattggtttaccttttggtgccactctgagtaatgttaggattttttcttatggtatgcctgagacttaaactttacaatttatccagaaagctaatacattttggaaaaaagagaaattgggaccttgagcatggacatttatcagtaactactaatgctatgactagtgaattatttagagagaggcagggagtatggctgaggcagggttcaaggcagagaatatgtgttggcagaaaccttatagcagtcagactaaataagcttaataattttcttttcttatttaaacaaataacacttttactgtaaatcattcctccctgttttcttctttccctttctctcttttatcttgtttttcttttttgctgcatgtctgcctcgccttctctttcctgtttcctcacagtcctctctttcttttcctttccttttttttctgtcgtacattctcacactctacccaccagggctcaaactccactatagtctcattagactgtagtttatagaaggaaagtaaagatacctggaggctaggttaaagggaagggtcctccagctattctcttgtgctcgattattattttgaacactaaacagcaattcgctcacaggcaagagggatgtggcgttctgcattctactgagatgttgacttctttcatggagtgtcatgaacactgtttattaccaaagcactgtcaaactccctatttttggagatggaatacatgatgttacaatgtttttacacattcactattgaattgtactttatttaaataaaacaacattggggaaggaatcattaagtatatcaaactggcatctttcaggtggtatttccatgtgctgagttactgaaatgaatgcaaagatgatcagggattttcactgtattcctgaagatacagatggtatccaacatctcctcaatgaagcctttggctctgtttttcgtaaggttcccactctgttcatatgaagtagtgtatcttaaatataaacctatcatcaggtttagcaaatcaataccataagagtgtgaaatgttccccagaactctctacaagggcatttcacagtaaaagcaattgaaaaagaagctgcaatggaatatcttatgagatagccatttagatcacaaaagggccataaaagtcacaagcagtttgtgtgaagcaaggttcataatataaccatacaggactggaaagaaagaggaaaattgcaaaccaatttgtggttatagctttttctgtcaattctactgggatttaaaacttgtaaaaggtagaaacttctgccagcttacattatgtagagagactgtgataaccataatcacagtagccaaacaaacaccaattatttgaagccaataaagtctttattaacttcaaagcaattagtgcttcttggatttattaagccacagaatgagaagatgccacccaagaccatttgtcagcaacaaatttgggagtcatcccgggatgcttcatttacacatttcaaaatggttttgcaattgaaggatgaatactttgaagttgagtagaagaaagagcggccctgctttggggagcccatagaggctccaagatggcactcagaagcaggccctgtttggtatttaatgctgtcagacaacctaccatgtccatcatttcaggctctgcagacccagctagctttctcaaagcaattgcagtaataattgctgtctatactgagggcctgctgggcacaacaatttctatatgcatcatctctaatcagttcatcagctctgcaaggccttattctcttcttatagatgaggaaactgaggctgagaaaagttaattactagtagttgagaatggaacccaaggttgcttggttacctcacttgtgatcttgccaggttcctccttcatttgatgagtcagttgatggccagagccacaccacacacatttttctacttgagtcacgttgacattaccaaattgagactaatcttcatgtcctcttagactggaggcaggagctgacagatctcctggctatatgtaattctgtatttcttgctctagctttaaattaatctctcccaaacagtaagaaaactaattagattacaattgcaagtcttttagcatgtatctttatgattcactgttgattataagctgatgcacagccagtctatccagatctttatttccatctgagcaataaaagtagtttctggtttcccttcagttaacatttctctttaaagagcagcattccattaatgaagacatatgaaatgaaattttgttgctgctgtactcaatctgatttctgcaaacaaatgaaaagtattactgcctcatttaatatcattaggaaacctgacatctcataattatctttaggttgtagtatagctgaggcaagagtcctagtatttttgtgccacttgtgcatcactgaagttctttcctcaagtggcaaaacagattagaccggtgttcttgtcatcggtctatgtagtctttctgagaccagacgaaaatgtctatttctgtgttttgcaaaatcttcactcaccccaagaattcatgcctgtagagcactctcagcagatcactcactagtcgtagcttagctaagagtctggaacccagtaggtattatcccctttcttggcttataaaaaccaaagatgggaggaaacccagattcaagttgtccagaggagttctggaagtccccagggctcaaagccagctctgaaagatcctacaaaatgagtcacactctagtacatggaagtcggtgggcatccactacttgctaaatttatgggcagaaagcacactttgcctgagtgtatgctgcagcatcatagccttaggcagaactgtgacacaagaagctggagatgagacagacctgagccattctgacactgctgtgtttctaactctgtggcctcaaactagtctagtttccttcaagagcatcatgatttttaccggcaaatgggaataagtaaatggaagttacagtctctgcactggctccctcacaaggtcacttcaaggaacaaagagaggatgttctttgtccaaattatgtataagtgataagaggctataaattaacatgagattattctcatcatacagtatccaaagaggcaggtaaaacatcaggtctcaacatgccctggcctacagtaaacattagaaaatatcctatgaatctggaaaatctttcacactgaactataccagcttccttcattaaaggggaagcaaaggccaaaggggaagccctggtgggggctgaagttgtgcaggacacttgccatttctacactggaatggaattactcaggggatagcagaagccctctgtgtttctgagccagcctaggccattgtgaaatgtccactgtcccagcattacctccctggcatagaaactagtgatcacctcaaatagccagggccaattagcaacagaaccttgcctgcaagtcactacatgtccaaatgctctgttctccatccccattcactactggcattctaaatgtcaaatttcaattgcgttggtcccaaaccacgtatgtgtatcacaaataaagcaaggactctttgaggcctctggctactcaacctggaaagatgtctatcaccttgctaatcactgacctgaagctgatgagggtttaaataacacagtgctcctggtcccatggccactaaggcagtgctatttctgcagcttctgctggctgacttcagatagagtcttgggatgagtgatatttttgcaaactgcaaatgcctctgagtaatgggtttcattcatttcatcaaataccacattttacaactggttgtgctaagtggacatttaagaattcatatgcagccgggcacggtggctcacgcctgtaatcccaacagtttgggaggccgaggtgggtggatcacgtgaggtcaggagatcgagaccatcctgggtaacatggtgaaaccccgtctctattaaaaatacaaaaaattatctgggtgtggtggcacacgcctgtggtcccagctactcaggaggctgaggcaggagaaccgcttgaacctgggaggcagaggttgcagtgagccgagatcacgccactgcactccagcctgggtgacagagcgagactctgtctcaaaaaaaaaaaaaaaaaaaaaaaaaattcatatacaagccatgtttgtgatttgcattctcaacactgagttatttcatagtatctgcccattgcagtgcactgatattttaagtaatatctctgcttcttagagtaaaaattttaaaatgtgatggttattatagtcactataacccatttatcagagtggtacagttataaattgtactgctccaattaatttgtaactttagtcactatataaacacaaatcacaccaactagcatcatcttatttgcatgttttacacaatttttatcatctataatgacttacattgttgaaatagatttgttaatgttagaaagacaaaagcaaattaccttgttttctcttgtaactgttaataaggtgaaggctgaaatgcatgtttttattctgctgtaggtattatgtcatatttgggaaggagtggggttctctttctgaaaatgcattgggaaattctgattttgactgggtgagtgctggagaactagttcagaacaccattatgggaagaatccactccagaaagaaaagagtgatgatcacagtctgttcggtcttaaatccaacaatttggactgttcatttgctacttacatgtaattggggctttatattttctttgttgctgttgctgctactgctgatatcaggaaacacgtcttaggctaacgtcatcctcagtatggcagatatgtagtagactccactgggagccaaaagactagcactctcccaccaaatctgcctccaactcaggatttcactgttgtcaattccctttcctctctgggcatcaatttatgctcctgctgagtggaggaatagatgagacattctccaagttcagctctaaaaagtttgatgggaaattttataaatttggatctgcttgtgaggatgaatcatggaactgaaggtaccgcttaggttgagatcaggtatagcctgtgcaacttaatcttctgagaatttctcagattggaaacaagctagaattattctggatttcctggggattcacaagaaactataggcctgctgagaggctactgctcctttgtgggtttgaaaagaatgattttcttgggcatctaccactctatttgttgttcccttttgcataataggaagagctttggagtgaggtagacctagatatgactgctagctcttccaattataacttgtgatcactggcaaacttacttaagctacctgagcctcagtgtctgggaaccagctacacattaagaagcctttcttgcccaccttccagcatcaaactcataaacacagtctctctccggttgggttaactgggttccagcattattcctatctcttcaaagaatgactgtgaagattgagaacacttgtgtgaagtactcaacccccctaccactgagtagttgctcaataaataggttcttttgttcctgttttctgttattagggttcactttgtcagtcgttgaaaccatcaagcttaccataattttgaaaacacacacttttacatctattcgcattcattcatttgtgtattaaatattcattaaatgcctactagttctcagggactgttctaggaactagagatacagcaaaaaacaaaacagtccaaagctctgcgctagtggagtttatattctcttgggtggagacagacaataaacaatatgaaagtttaatgataaaatatattggaaggtgataaatattctagacagaaataaatcaggggattgtgctagagatggatgagttagagctgtagttttaaatggggttatcagggaaggcttttctgagagctgcatcgagcaaagaccaaaaggaagtaagggagtgagccctgcagaaattgcagggaagaacatttcaggaaaaggaatagcacgtgcaaaggccttgaggcaagagtatacctggtgtgccttagaaacagtgaagaagatagttcagctgaagcagagtaagcaagggtaagaatgttggggaaggagatcagaacttgcagtgggaattagactgtacaagagctggtaggccattaaaaagacttggcctagattgagtgaattgggagctgcgagagaatttcgagcagaagagagatatgatctgaattatgtcataatgggatcacactatacctattgtcaaaggactatgggaagggagcaggggtagaaacagagagaacagtaaggaagctattaccataagccaaatgagaaggatggtggcttgtatcagggtagtggtgatgagcggtgaagagtggatggattagtgatgtattttgaaaggagaacagataagatttgctaatggagtaattgaatagggatacagacaaaaaagaaaagtcagaaacaattccatgagtttcagcctgagcacttggaaaggtggtatttgctattagctgagtcatttactataattattatttacaggtagcatgataacaataagaccatatggaaatatttaaataattttttttcaataaacagagtgggagaatgttagctgcttgttatctattaccaatattgagggggaatgtccaaaatatgtgagatcatttctccttacactgaccagtgcttcctcctttccttcccacctggtcattcctttgattgactttcataagtccaggctagaattacatgcctcaactcagtggttctcaaacttggaaatcaactatggcgcttgttaagaaatccaggtatgagatcaccctctcatatccgtgaaatctgactgctgacgcataaacacacagcattcacacacatcaagttgtcacatatttttacatgactgaatcagtcaaatacctggtttgtggttgatcaccagtcagctttcaaaataaaatagctgggtgttttaaagaaaacattttttctgtccaggttatctgtactcatcagcttctgtccaccatcaaagtaaaatggccataaccgatcttatccagatgggggtttaggcagttgatggactcactcatgtgacctttacttccgtgaatgcagttttgtttggcctccattccgcttttgacagtttcaagagctggattagtaaatcttcaaggtcttctacacccatatgattctatgatactgcgattctgccacgttgctatgaaattgttattagaaggccatttaccccttaaacctgggtattcaaagaactagaaacctaaatgatgatgacagatatcttacttaaatttcatataagaattaattccaagtcaattcaacgtagcatagtagtaaaagatcatacagcctttgtgattggaaagagtctcattcgaaccttgatgcaagttgcttaacgcctctacacctcagttgctcacctgtaaagtgaaggtaataacagcatgtgcaccatacttgtattataaggatgaagtgaggtttcatgaaaagtagttagcatattacctgacacacagtatgtctcataaaagtagctatcaccatcaccatcaccatcatcatcatcatcattgttattaactgaagaatcatagataaacatgcattttcaattgtcattgaaaggcggagagaaggctgcaaataattttatgaaagcatatgtttaaagattttaggactagctcttcaatgggtttgtctgaatatacatatatggatgggtgattggttgaaatagagcataatttttcaaagtgtgtttaggcaaaacaaaaacaaccgaaaagcctaattttttttttctagccatttactggctgtgataccttggacaaagtcatggcacacattaagaactcaacaaacaaagttttattggtattatcattattttacatatatatatatacacacacacacacataatggtgacaaaagaaccatgttggacaaaaaatatttatatgcatgatgtcctaataactttgttaggtcttacactcaagcgttagactcagaagagagaggaacataacatattttgaaattaggtttatataagactttctctttataagctacagattgttgataggctaacaataagcttaaacttgtgtcatttgaaactacacacacacacacacacacacatatatatgaatctgtgcattcttatacaattctatgcccaaatttcatattcctatcatccttttctatatcagtagctcattttcagaggtaatgttattagtgctcttcactctcatggacaaattaagtccaaatcaacacataccagaccttcctgaagctctcagcggacacccaacttcgtgatccttggtttcgtgtgaaattgcctcctcctaaaggccagacgggaaatcaggacttggaataagcacagctctccagctctgctcctgccttggcaattttgatatttcacaagaattgctgtgttttttataagaatgataaaaaggcagatataaaggcaaatatcaagaagacttctggctgacaaaagcagaatttggagagaaatgtgaaaatagtgacttacttcagcaacagagggagtattttttatactttaggtttttttttttttgtaaaatcatgactttctagtaaatgacatcctagaagatatttatcaaagcaggaaagccgtggaaaagagcacctcgcattcactttaatattttgccttttcttttgacattttcttgcctagagatctaattccattaaatatgtactttttttgactggaagtcttcttcgtggatctttcagataaatcttaaaagtacataaggtctgtagggcagcttttttttaagtgcaaatgagacacacaatagaatattgtctatgagggtttccaaattatttatactcctgcagaaatttaccttgcgttttctgtgataatgataagggaaaaggtaagattccaatatgccttctgtggagcactgtcaaaccatattagtcctatttaatatctgacatgcaggaatttactttggctgatacccactttgattggctttattaggcattgtcaaggctgtaactttgtctgatggacaaggtaaatagaagtgtaatcaagtgtcaagttagcagcgcactcggtaatattccatcatgcctttgcaaagggacatggcttcactactctgcttcaccatgacacttctctaggactttggagtgaacatgtttgctaaattggaagattacattcccactgtggtgaattggaatgtctcctagtagacttccaagcatatactgttgcatccgtaatttcttctgttgcttttatttatcattccctatgcctccaactatttttctgcattcatatgaaatcaaactcccaccacaggattcacaaatgtaggtttttagaatgtcacattttatggttagtcactgtgggaaacgggctacagttgaggggacccaaagttggagttgagggtaggagtaatccagatttgggttatgctctgcagcagaactactacttcattactacatatcttctaggtgtgatcttttcagtacgtaagagcttcagtatatcaagggaaaatgcaaagtcattgaataaagtgagtaggagcactgagaagctacggcagggctgaaatactcaggttaatatgtgacattactcagaggctcagtaatgcagtgcaggctccagccttctcctgcaaaccagctcaactgatggctgccggctaggctggtagtcctatgggtcctatgggataggagaggagaccacagttaagaatagtttttcctttgcattataaaggcaggaaaaaagtctgtgattataaggttctctgcttccaaatgatccatctaaaaactatgagactagacattagaaagacaaatatgaggacccagaagaaagaagaaaagaaagggaaataaagaaaatcttctagccctaaacacaactaaatcatatctccagtccaccttagacctctggtttgttaaaaacaactttgcatgagaagagttgattcatttttcccccatatatatcttacagctttgggtcatctctggtcattagataattgtagtagctttacacaactaatttttctattgccaaagacaaagatgtgttggaatttttgcatggtggaggagatagtgggaatgaaggaagagtgcaaaatatgttgcctttgcaaaattgtcatcgaaaggatagccagaacataaatgatactgttttggcttcaaaagggtaagcaggtgtcttcaaagtcccaaatgagctgtgtacaagcttgtacaaacaagcgcagaatcaggcctgtttgttattcacacaaacagagtgtaaaccatgtgaattccacagttcccaggattcagatggtgcacaatggtccataatgagcagcacctgtgcttacctcaattaccagacagttctcaacagcagcagaaagggctcactagaattgtttttcaataatagatttagttatgtctttcataattggattcaaaagctcaaaatttcattttgcaacttgttcataaaatttgtatgaaaaagtctggcatttattcaaaagaaatagtctatgaagaaaaaattgcaaaacagccaaccgctggtaactaagcagccaaattatagtccaagcacttggcaaatacaccgtctttttattatttcagtaattgaatttctgttaaagcatggagcataatttaacatgaggaatttatttatagtacaatagtgtttcagtaataaatgcattatgattgtcacttttaatggagtcttatgtattccctctgagactgtgtggcagactttgagacagccactgcaccagtgttgtttgtagacaattgaattaattggagacatggtcattaactcgacctgaatacctctgattgcttctgtaaataaggttagagagcaaatggctaatcttcgttgtcattatagattcctcttacattttcacactgccttgtatattaagatcattttgctaagcagcttttgagactctccttatatttacagtattgtcttgcgtggcacataaccataattgtatcagacttatattacattctccatatctttataaagcacgatactaaaaaagaacctatgttgaatcacaactcataaaaaccatcagaccaataaatgaataaaccacagtgtataaaccatcgtattaaaggaaagtaaaaccacaccgcaaaagttgctttggtctcctcttacagatcctcttaacacaggatggcctcccaaagatgcaatcactaaagaaagagcacaacaaggaaagcattgattaaaatatctttatgtttcagttgatgtcatgccctttcttgcccttctgtaacaacattagtaacatgcaaatcacaggaggttaggttctttctccttgttcattctagaatggagttacataagaactatttcaaatacagatattaaaaacttttgaatatttgacttaccatgttatttttgtagcttcatcctgttataggtatgcaagatatttagaggggatttggagaaaaaaaatcttctccctttatgactcaaataattcaaaaagtgcatatactggaaacatctctaaaaatggactttccagtcattttataattcagacatattataaaggaccattaaaactgtacagcattatgttgaataatgagacatttacaagtaggataccacaaagagatgaaaaagaaggaagaggaggagcaggaggaggaggaagacaagaaagaggaaggaggaaagaaaaataattctgtgcttttatttttcccttggcaagactgaaatatactgaatatataaaaacgatcatttatactagctctgtataaattatctatactactagaagagtagatcacttcctcattgttgtaccaagccactggaagcctatcagttttcatgagttccatgcctaactgaaagtgttgacattttctttggatattaaatgggtcatgcccaaaagagaaaaataacgaccatttcaattatttcagactttttgcctttatatattcttattttaacactaatctttgtgtatatgatggaaatgttacatttgactctcatacatatgaatgtgcatatgtgtatgctagtaatcatggctagaacccaaatgtgggttgttgtatatacattggctggcagcaatatcatttttaataaatgactaatggccaacatgtgctgcagaagtcaacatttctgtccttagccagctaatagtaacattatttttaaattaatgttatgcacaccatttgaaggatgacacttctcccaatgttttcacttcttagccagccatctcaattagtgctgaaatgattctactttcttggtattagccatcttggattttaaccaacaggtgtacacactctcacatatacactcactcaaatgcagactggcacacgtgcattcatacatacatacatacacacacattcatccattcatgaggcgcaggtatatatacacatgcacacacatattatctcttgtttaaacaccttgaatttaggcacagttacctgaaatgagtattgaaatataattatagtgaaagggaacattttggcatataacctttctggaaaatatctctctgccagtgttttgcccaagtttctaactggcacagtaacatacccaggttttgtcattaagaagctgtagtagtatgggactcacagaaactgcactggattttgagatgttgataccatcagactagaaattactctcatctcactaaaagtacatgtctcccatgctttgcaagtgagaatattttgtttatttgtttgttttggacatttaaaccccaccccccaagttgtcaaagccttgtctacactataatccctaagatgtgcatttgtttgaatttagtaggtagggaccctgtagcattgtgatttgctgttgacatactaaaaggggatatgatgtaaccttcagaaaatgcagatttctagatttttctgatgaagtggttgaccacaaatgtaatctgcttaaccccagaaggtattttaattcctgttttaaatccattttattctaaattcttccttctttgaaattgctaaatttcctaaatccctcttaataacaaaaccaaacatcctgaccttattaccacctgcctgtttgtcatcatcacaggtcctgccagttcttggtgaaatgcctaagtttgtttccatttctttctatgtcagcatttaatagactctgtgttcatttgtaactcaggattgtcattcctcttgctattgatctagttgtaagccctgccattccacatacaggagtcagtgttgagtaaggctgcctgtcctcagctatcttatcactagtggccatgtacagacttcctcttgacgtcaaaggcaagttgggtacaatatcaaatgagttcccctaacatgaggaaattgtgttcctcttttcttctcccatttgcacttggcctccttcaatttaacattgatgagaagggagactattagctagaaggtaagattttcaggcagactaaagatctagtatttcctatgctgtcattcaaaataacaggcataagaacttctgtttaaaatagctgggctttttgactagagggcttttgtgtagaagatttaagatgtcagctttaaatatgacattgatagtctttggcaaagaatgggagtgaatttttgtagaaactgcctttttttctgattgtttattaatggtctttgtgatttatagtaaatgctggggaggatttccaggcccatttatcatgagaagggaacaccttcttgttcttaatgtgagtgtgtcataattagcaatgcatgtgggccaggagatttaactctgccttttctgaaagtccttcaacctcatatttaatcccaaactgactgaatattttttcttctttaaggaaattaattatgccactggaaaaatcatcaactagagagggagttgataacaggcacaatgtaggctgggttggctaatgtatcaaaatgacatgattagagtaactcacatcttagacaaattggaataatggagtcatcattctaattaaaaacaggaaggtctgtttgtatgtagcattcattttcagtaagaaccacaccatttgtttttcatgttcatgcatgtttgtacactctgcgacccatcaatggttgttgctctaaataccaattacattaaaaatatccatccagatactttgcattttgtcaatgaaactgaagctgaagaaggagttgggcactgtgtcatatggccagcatccatagaggcagttgaagggttacaacaaatccatcatcatgcaacctatttgcctgattattttcatcaaattaacttatgcttcatgatgtttttgtgttccataggctggcctaagtactggcttctgttgatacacatttcacagttaagtattgttctttaccaggtgactctgtttgtgcttcatttctatatattataaagccatctgaagtattttcttataacaagaaaattatatacaatttatcatgccggtcaccctgggatatgcaaaatgactttacattctggtccctgccatcaaggaatgtacaatttagtggtgcaggttagcacaacgaaataaaatcatctgagattaatgaagtgataaactgtgatgcaaaacagggagatatctgtaagaattaaaaagtcattagcgatgacttcatattatttgaatttgagcttgaaagataaagatttaaccaagcagaagagaggggaaacgtgccactgtagatagagcaaacaggataagcaaaggcatggaggcaatgtgggagcagagaggagacaaaagtcgcatttctgttgggaataacaatcagaaataaaactgacactaaggtagggtgttgatagagatctaactctgaaaaccttatagcaaagagtgtatatatctgccagaaagtcattgtgaattctgaaatagagagatctcatgatacaacatattgtcacagagggtgagtataaaagagcaaagcttttagttcaccagggaatgaggtcaaggcaagtaagaaaagaacattggatttgcggccaggcacggtagctcacgcctgtagttccagtactttgggaggccaaggtgggtgaatcacgaggtcaggagttcgagaccagccttgccaacatggtgaaaccccatctctactaaaaatacaaaaaattagccgggcatggtggcacacacttgtggtcccagctactcaggaggctgaggcaggagaattgcttgaacccaggaggcggacgttgcagtgagtcgtgatcgcgccactgcactccagcccaggcgatagtgtgagactccatctcagaaaaaaaaaaaaaaaatagaaaagaaaagaacattggattggcaatgatgagtcaggaagagaagggttgttgcgggcagttaagaagcagttttagtagccaaaagagtttcaaagcctaattactaggcctgaagaagtttccagtggtgaggaagtggaaccaataagtgttgactttgaccacatctttaagacattttcatggtggaagacagtcagtgactttttcctgattaggaatgtatgggctagtctgggtgaccacccagcagggctgtctgtacatcatccacttctcttggcaatatgttgtgttgctgccttgtgagggttagatacagcaattttgcaagttacagtttttgccattcacttagatttctgatgatcgtgtttacaatacaattatgaagtaagattcattcagtaaggaaactatatgacttttatttcagaaattgcgtatgtgactttgaataggctgactgcaacaaggttttcctagcacacagcgttggtgtccttcagtgttttcagcaccaaattcttacaaccagattcattaggtcagctgaagaaaactttttggattaattttgagtcttattgctttctgagatgattagaaagatgagttttgtagtgggttttgattgttctcattgcctctagcttgacagtgtttagtcgatggtcacagtagcctagtgaataggtatccttcgataactgttccttctaccttctagtgttcttgtggcaatcaaatcatgggagttaacttgcttgaaaactatcaagtgctctgcacttaaaagtattctgatcttattgatccaatgatgatgatatcctcttggaaccatagagtcacagagcaatagggatgttaagtgcctacccaaaggcagaggatatgtctgtggacagtcctccctgagatttatagagaagacttctttgtggctttactctagggtgtattaagcacactaagcattttacagaatatgtggttgataaagcctctggtcttagaagcttaccttctaaatcaagtgtctgtgatacatcaggtaacagatcagacatgaagggaagcagacaatactgataaggagaatggcattgaccaacatcacaaaagagatgtagtctaaggagagattggaagagcaatgcccacttcccaaattgagcagcaggtctaagtacattgagtaataggaaagaagacataaagcacggaaaaaggcggaggcttatgctaagccactgtgagactatcttcaggaagacctgtgcctgtctaagcatgctttgtactttcctagggaattcagcccgccatctgcctgggttctcctgacaagcagttgggccccatctccgggccagcttttggaacacagtggaggagattcctccatggaagcagtttctgggtttaagacacccagtggaagtacacagcctgctccacctacgatttgtaactgatatgattccttgtgggaaggtcttgaccttgttgtagactcctggaggctggccctttctgggtttcttgtgaatgcaagctgccactcaatcattcattctcagctttgcagaggccagagctcacgggagtcagtgttcacatccacttgcccgcctttcttctctcctttgctcccatttttaaaaatgggctttaaaggcaaaaggtacaaaaatacttggctttatatgattttttttcccacctgtttggctgtttgattgaaacagctctgtctcatgccagaaaagtcagtgtgattttttaaattatttccatagaaaccgaaatatcagcttattcttccatatgcaaattgcaatgctttgaagacataatggtccattagccaacgttggccagtcttactgggaacatgctgacatcctccatagtgtcacctcaccatgtaccatggtgaggttgaatccaggtgcctttttttcattcaggttgaatccaggtgcctttttttcattcctttgaaattgcaatattgaagttaatctcatagtatccttaaaactatttttcaacttgatatggtttggtgctacatctccgtattctcagctgtaaactggaagtagtaagagtatctaatttatcgtgttgtggtgcaaattaagggagaaactgcagggaaggtgctcagtagcccagttcctggcatataatgaacactagcactaccaggatgaattatgccctggatccccactacggccatggatatagcctgctatgaccctgacccttggcttgggcagtggcaagccacctttgaacgtcattagtgatccataggacgtgctcacaggaaagaaacatacattaagtgaactgctggtgtgggcaagtaggttcaggaaagtggtaaactgatatcccagcttatcagaaggaatctgatagaaattgttcaggaacaattgcctaaagaaagcttaaatttcaccaagtcagattaaaaatgatacaaggtagtcaactttctctgttgctaaaggaggacagaataattatgaaaaagtgaaattcacagttcaccttaaaattgggttttagcctttagtttcaaattcgtaactcaccaacttctttttctcccagtggctcccatctgaatagccccatgtagatattagccttgccatgctcaatgtggtccactgggagttatctgcatcacctgtgattatattggaactgcagaactcagaccttgccctaggcctacctaattagaatctgcaggttaataagatctccaggtgattcctatgcacattaaatttggagaagcatgggtttgtgagtttcctcacctaaattacctcatccagccctcttaaaaacctatgtgatatattatccccattttacaggtaaggaaactgagacccttatgttaagtgcctagcctaaggtcatacactgatgaagtatccaaggtgacactcaaaagcagatcatctgacttccaaccctatgctcttcccattgtactaaaactgactctttaaaaccagtaaggaaaatgcagctgtctagatatgtggcagtggattgaaaatgggagacggggcacaggtaggaaaagaagaggccaagtgcctgagtctggtcaatctacagaaaggacaaccaagccctgattagttgtgagtcaaacatggtgctgaaaagccattgccaaaatcactcataattatcatctcagaaaggaagtaggggttgagtaagttagaagaaataggaaccaacagctggtgatcgaaaaatgtaaaaagccggtcatttacagttatcataaaagttccaaacggtctgtttgcagcctctctggaagatgtaacctctcattgcaccattgatgtggcattaatctactagcgtctttttactcagagatctgcttcccagcacgtcatttagccatcaaggttcccttcccagggtgggcttatatgtttggacttctctgaagggaaactaaattttacaaacaaaagaaaatctgttcaggtgtaagagggtgcactcagaattttaattatttggatcttgtattaccttcctattgctgccgtgacaaattacctcaaacttagtgctttaaaacaacacacatttgttatcctagagttctggaggtcaaaagtcagatgtgggtctcacatggttaaaatcaaggtggcagcatggctgcattcctttctgaaggttctaaggaacaaactgtttcctactcaagtaagttattagcagaattcaattccttgtggttataggacagaactctccattgtcttgctggctgttaactgagggccagttccagcttctagaggctgccacattccttgacttttggcctccttcgtccatcttcaaacaccagcatagcaggtcaagtctttctcacatggcatcactctggcctcctcttctgcctccctcttttacttgtaaggatccccgtgattacactgggcccacttggataatccaggataatctccccatctcaagatccttaatatttacatatgtgaaatctccttggctatataaagtaacatattcagaagttctatggatcaggttatggacatctttgggtcagtcattactccatcaaccacagatcacttcagtcattcagggctttaagcaatgtcatgtatagtaacttgtctgagaaaatgaataggaatgaataggtgtggacctccttattactctttgcaagtaaattgaggcggctctatttcaaacatcaggatgagataacaggacaaacatcctagtgtatacatgttaggcaaagacaatctttttatgaagttatatcagggtgtggcccagatcacaactggaccataatcgactgtctgctcatcaatagcatcagagaattagcagaaaatatatttgattgtgacttgcttgtgatgatattgggatatgaattattttattttcaaattgtgctcagggggcatcccaaggaggtagggaagctgctggggacataggctccctcccctctccacatcccttgtttcttttttccaccacagcaattctgtttttatcggttttatatattattcttctgtgtacactttctattgctttctatttctgcatacactatttgttgcagaaatgggctaagtggattttcaggggacaggggagatgggggaagatttcaaaactgctgacacagacaaaatggaatcttcccagtctctagctagaataagttcagggttcagagtgtctgcctctggtggcctaatgtgatgaggcaggcataatgctccagttctggaacccagagttcagagacaaaaacgaaggaggaaggaagataagatcagctgcggatgttgattcctttgcctgaagttcatctgattacagcttaatgatgaaatcaaatatgaaaccattctaaattacctaatagacattttatcccagtaaaactggaacacagtcaagctgatgaaattcatgcaagtcttaactgaagaggagagtttcatgtaggactctcccattaaacatgtcttgctccatgtctttggcaagttctgggccttgtgaaatgtgttgccaagatcaatatgtggacttgcttatagaatcctcccatgtacatttcctatacatagtctggatgcccacacagcttgttggagcagaatggccaattcatcatctctgtttatctccagagaaagggatttacagttaaattagaattagaatcaaacagcactggtgcaggtgtttggctttctggaggctgttaatctgaattagtaaaaagtctgacttataaaatagcctacagaagtgcagttttaatcctgtgaggtttatacaataaccctgtgactgatagagtactgtagagacaggacattcctagacttgccttaaggagcagattggattgcacaaatgcctcctcacatgtttctcataaagtccataaacagcctcacttaaaatccccaatacactttaggttcataaggattataatctttgaattggaagacaccttaaattttgtgggtagtggggccagtggtgcaagtggtaaaggaatttaccaatacagttgtaggtaaagaaaggaagatttattaaagtatgaaaatatgttgcaagtttgcaacagcagagaaggggctgtctgcaaagaggcaggggctggagggaaattttacagggtcatgctggagggggctatgtgcagaatgaggtcattttgcccatgaaacaggatcattgtgcctgtggaatgaggtcactgtttgggattagccatctctcagaacaattgttcattgttcttccccacctgggccctcctacacctggggccccttcctcatttttgcttacttatcaggactccatactaaagatcatccaaccccacttcagacccacaataaggattcttctcccacattctttatagccactggctatctgctcacctaaagtgcagggttcactggcatgcaaggtagtgcattctttctgtggtcagctgtaagtttttaaaagtatttcctgatgttgaggtaaaatcttcctgactagatctccaactcattggttttgtatttaccgtggaagttcagaacaagcccactctttccctgctgccagggcagacctgcacattgtttgaaaattttcagtatatgtgcctctccccccatccccaacccagagtcttcttcaagcagaatagtcggtttcttcaatgtggcctttggcctctccatcttatctgcatctattcattaattatggtgctacacattaatccctttattgcagaagagtctgggtggtgtaagcatagaaagactatcacatatagagtctagggtgcccagactatctcttaaagcccatttttttcccctgtcactctcaagctttccaccagggtcaaccgtgtctggagaaggcaccttaaacgcctccccagcttctctcccactggcctactctctgatcgccttccccagctttggattcccccactagggtcactgacttgctaagccatcttctctgcccccagtctggcctatgaccatgaagacctaatgaatgggtttgggattaaaataaagcttagttctacttggtaaagatgaatgatgaatacgatagcaaattctgatgaatatgatagcaaaatctgatctttgagaaggttgagcagttgactttgaagtcattacaaatgtgggtcctttgagaagttttgttacattgtagtgaagttactgagtacacttttaatatttacagactatagagtggatggcttaatatagcaaatgttaattatttttagtatcagacattatgtttgttgtaatcactagcattctttttaaaagcagtttattgaaatatgaaagtaaatgatgtgtgaaaaataacattaatacagtcttagtgaatgaagaatatataaactgtgcattagtttttcatctcctaggcagaatcaagtattacatgggctagctttactcataaccactttcatgtacatctggaaaataaattagtaacgtatgaaaataaatgtagcagaagtggaaatttaactagctgaacagctaacagatttcagtgaagaactgaaagtgacatattatgatgctttgccaacttgaaagttccatggtatattccagacaagaatgtggccttaagccaactattcagacattgatgtttgtcctgcttttaaagacaatgtttcagttttgtactcactttttgtccctgggagcagtcccaaccgggcgcaaggtaggcccagaggaaatgaggcccagactcagatgtaaagcttacattccttagcagactggctgcatctacagtctccagcaagcccatgagcagaagatggagagtagaggcacaggaaaggtgctggtgagagcaattttgcctccatttaagcaaccattattcccttccacaaacgctggctctccatttccaactgtgcaacttcccggagaaagcaattccttttcattaacacactgaagtccttcacccctagtttgagttctcatggtgtcctccctgaattaaagtccaccctccttcttatccccatatctgtatgtgtaagtataaaaagctgatgtacttcttcttgttcttcctatactaatttcctctaagtgttcattgtcaaaattgactgtgttggagtcccacctgagaacacagaaacagatttagctataaaaattcttaggatacataatttcaggtctcatttcattgggtctcagtcaaggttgcccttatgtttaaaacagttttaatttcatgtctttctttatatctacttataagtattgtcaaattttcatatatgatttctatttacatccataatttcttacacttctgaaattcaaaaagttctgagaaccaatattttttctaaccttgagacaaactcatttgatgataaaacctgacctaaactgttgtaaagatatttatttaaaacatttatgtattcctcttactgtgaatgttactgcaacaatagtaacaagttttattaaggggtgcttatccagatcccactgagaatattatatatggtatattcagcatagtactttttaaaattaaaaacatccgaatactaaaatacatctgttctcagaagggctttagataggaaagatatatacaaaacacatacacgcacacacacacacacgcacacacacacacacaccccaatttttctactaaatccatggaactttgatttagctgaggaataagttgattttggtaaataaatcatccctgcttcatgtgtatcaccttaatgtatttggttttgaaggagtaatcccagggatttttttgtttcttacagaagttgctaaaaaattatctagtaagtggaactctatccagaaatattccaaagtcaacctagagtctattttagcttagtaatagcaggatgaccagcttcgtattaaaagaaatgagtgcataaatgtgaaatgatactaggaaacagccttttctcttgagaatcataaatgtggatacaaattagattttatccctcaatccaccacccagtattctcagtgttgcagatgctctgtgttatatttaaaacttcacttgggaggaattgaggccaagttagcctaatctctggattagtctcacttagatttctgttctctcaatctttatttagtaaccgaagacaaaaacaattgattagatttaaagagaactttgcataaatagggtatcattactgacactaaagagagatctacaaaggaatgcagggaaataggagccctgttataggtctcctccctttcccccccactgctggagaaagacacacagttcccaggagatacagtagtctccttatttcttgtactttccctaatctcttgatgtacttgacagagaaatgtacttgtagttcgcatttactaagcagatagcagtttaaaatgagctttcactatgttaaagaaaatgtctacctgggagattaaagggccagtctttaaggacacacggcacaggaagtggataggccctctgcactgagtagtgactgatgaggagcctgtgctggctttgaagggatcctattccttcccaagcagcagctcagtatggctccagctcagtgagtgagagttgtaatgttggagaagaggctctagtgagggcatagggtggggtcatgaactcgtttgggttcaggcaatgaataaaggtctgtgctccttgagctgggggctggggaattcttgcggatcctctttctcacatttgaacatggggccacaggaccaggtgacctccaggaccatactgggctctcttgactgagctgctgcttcagatttgtggaatgcgagggagagagcaagtcaggttgctgctgcatgcaagaggctgcgaaggcccagtagatggcaaacagacaaacaggccccgagcactcccctccccatgagctaaactgatctccaaagaggggttaggctgaagacacagagggagattagaaccttcccccaaatttagagacccatttctgagagaaagcaaaattcagtccaaagcaacaatgagaaaaagaaaggtgatggcataccccagtgtaccaagttgcagctgaggctgacttgttataggacgcagagagcaaacgatcggtatggaggagtattatttatcaataaaggcagagtagcaaatggtgtcactttccaaatgctttgcttggtcagctttacaaatttaaaatcaatcattacagctggttgctctcttatgatcataactccttgtaagagttacaaagaggttataaaaagtatggtggaggaggcctagaagtgtgttgtctcattcccttattcatgcacccaacagacagaaattgaggaccaactctagtcactttggggctgagcgccaggccctcagcaatgaatatgctcagcacagctagtgccctttgaaggagctggggggccagggtcctaggtgctagtcttggctctccaactagctgtgaggcagagaccagctccaccccctttctgaacctcagtttcctctaattaaaatgataattgaactcactccttcttggtaatagaactatataccatatgtttagctaagatcagagccccttgacgaacctgtggggtattgaacaagggggcaacaaaaaatgaaaaactaccttaactgaaaaaaatgggacagttcaacatctaaggcactacatctatatctgcatccagaaggcatgcaaacttggcttaaggtttttatgttgaatgagggtggcaaggcttttctggaagacaaggcagtgtgatggaaagccaaggaacttgcatacacataggcctggttctcttcaaagctttcaacttgggccagtcactgggcctcctaagcctcacgtttcctatctataaaatgggaacggtaaaccccactctacctgcatttcacagaccacaggcccttcacctgaactgggctgttttccatcttatttgagagtaaatgaggcaatgaattatgttgtttttctttcagcccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagaggtgagtgaaggtgccagggccctaaccatgatctgcctgtcccacaggcagcaccctcaacacacacacacacagacacacacacacacacacacactttcagcacaataattaataattaatttagcatgataaccacttcagaaaagtacccagatttttaacagcacttttaaaaagcatatattcacatactcctaacatgcatacattttttgctgtgtgactgatttgctgtgtgactcacttagcttctcttagcatagtaaaactagcatagtaatgaatagactagcagcttgtcttctgagagaatcaatgaagccagtcaagatccaattctggccttggggacactaacccttactctagattaaagtgattaaagtgtgaattgccacttggcaagtaagacccaagaagtatggctttccttaacggtaaaatgattatttaaatgttatatgttctttattttaatatgcatccttcaagtgtgtttgataataattcaccaaaacatttaacacagctccatgaaatactaaaataataattttgaaataaaagaatttgcttcacatcctctctgagtccaggatagccgctcaatttccctgagcctgcatttggtatagcaagtaaattccaccctcaacccccggctcttcatacacttgtttttcaataatcagaaaagaaaaataggagacaataataatattactgctattaataatagaaatacctgttgaacatggaccatgcatgtgccaggcactgtgctgagctcttgacttgcattttctcatattatcctcatgacaaccttacagagtacttattattatttttgttttacaaatgagagaataaggttctaggaggttaaaaagaactttcccaagacctcacagatagacagtagtagagccaggactgaaaaccctggtccatgtgtatccagagctgatgttctcaacctgaaagctccactgcccacagtggctgctgatacaacttcctcaacccttgcctgccattgtcttgtgcaggttgctatcacaactactcaagtgtttttaattctgtcaccctctattggctggtaccataagcctcagctgatggctttcaaaggaagagctcttctaataaaactgatggcagaactcagagttaggaatcaaggacccgaatagtatgtatcattgccatggtttagtggatgctaatgtctgcatgcatgttcctataaattggttattgcccatacaccgacgaaagctcagtggtttctattttttggaagtaaaatctttttgtccttcagtaaaaatacaaaaggcctgatttgtttgcagggaatgacagcatcacatagaaggcactggcactctggcagctggaaagcctttccttttgaattatacttgaggtgtgcttacgttcctttcaggatcagagactattacctttgcctcctggtgagaggttgagtgatgattcccacaaaggattttggaaacaggtttccctcattggcatccctgccaacccactggaacatctctctgtgaataattcttttcttcctggccaaactagagaatattttcagagaaggagtcgaaatgagcttaaataagtagactgcagctggtttgtatctgactatttaggtcatttgaatattatggatagtgggtatgtgcaggtgtgtgtgtatgagtgtgtgtatttgtatatgtgtgaacagtcacttgacatccaaagcttttagtagtagtctctgtactcagggttctcttgaatccttcccaagtgtaaaaatcattcttgctgctgtttctcaatctgcagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaaggtaagctgtctaaagtggcctgccaagtgcttgtgagcagtgtctgtttgttgtctaacttgatcttgagcctcatcttcaaggaagccaatggcagtgcattgcagattttggcaaaggtgatgatgctttctgtgggaaatgcagtatttgacatgaccagagaggaaaaactagaaatgatctgtagccagtggcaagagtgtccattatggcatatgagggcttatgatgtgtaggaaagaaaaatatgaagaaagtctccttacttaggcaaggcacgcaagtgccctcaatgtccaaatgcatcttctagggctttttaatttctctggacaaacattagcatctccacagtccagttatactctaagtctcctgggtcctaccaaccacatgttcttcccagcctgctgggatcactgatctatgtggtaggcttgacttgggaaaattttacctgcagaaggctagagctgaattccaaggctataaagtatactcataaggtgaaatccagagtggcccttttcatttgaactatgtctagagaaatggtttggtatccagtatgctcattctgtcgtatctccacatctcagggtactttttttagagtgatgttatctcatgatgatattcaggtaatcttatttctaaggctgccacagtggctagaaaggaggttccaagtcctttcttcatttattctgtccctttccaggaaagacttaagattcctcattgaaccgcagcccccactgtggccaggccatccgactgactaggatgatgcaaaaatgatggcagtcatcattcagcttgactttacaagttccaaaacagaggatattctctcggagttgcatacctaatgagagtacagtttgagcatcccaaatctaaaaatccaaaatccaaaatgctccaaatctgaaactttttgagcactgacatgacactcaggagaaataagtgttcactggagcattttcagattttggatttttgaattcgagatgctcaactggtaagtttaatgcaaatattccaaaattcaaaaatattcaaagtctgaaacatttctggtcccaactattctggataatggctactcagcctatattccaaaatagggaccaagaagtcaaagacctttgccctaccactgattctccacatttagtgatgacaacagtacaaccacagctgacagtgtaccttcaaaacagcacatgcaaaagtccaaaggtgtgctttgaacgtggttcatttccttacgtgatgctcattgtgtaagcaacctttatatgtcagccatgatccccatgctgcttggacaggatttatgtcacattcaagttacaatgttagtttctaaactactcatttgtgggggcattgttgatgggagaagtgtccaaaaattgtattaatagattctctttacttttgttgtgagattcccatgccacccagtctttacacagaggttcagatcacacagttgtactctctcaaatgccaacttctttgtaggactcggctaggcaaggttgattgcttttctgtctgatcaaaggtgcacatttaactcacctacctaatctagaagttaaaataaaagcaaactatgtatcttgctcatttttagtgtataaaatatggatgtctgaatggtgccatgcatttcaagctctgtgtatttttttccctgttaaagccaatagaagttgcagagaagatccctgagaagaagcagcgcctggaggaggccacaactatctgcttgctccctccttgcatctcaccagccccaccccacaagcctcccaacactagagagtgagtttgccctggccctgtctgatggcttggtatgattgttcagactcctaagaaatcctaattgaacctgtttgggggatcttgccccagaagactttaaggtaaaaaacaggagtctctcagtcaaggcctgacagctgtccctggccactggtctaacaagggtgtgataaggggtagaacatatgctgccagaattggggtgactccatgagcttttagcaacatttctttactctaattcagatttatcactaaaattagtcaaaacgaacttttagcactcagtgaagggtaaaaggaagtaaataaattaacaagaagcatcaagagaacccctatcactttaaccagatcacctgcttctacccaacattcagttctgatggtgattactcagtttccctggaaaagcaactccttgatcttgacagaacgaggcagctgcttcctctttgatgtcattacttaacattcatatgaatcttgaggaccagtagctatgtccggaactccacagaagccaagggaatgaaaaaaaaaaaaaaaaaaagctgtcttttcctgacacagaactgtcccaggaggagggccactcccagacagctcatctctctggcctcctcaaacatgtcattccaaggagctggcacctgttcttccttctctctgtgtgtggaaggttccagagtccagcaggaggcctcctggcacctcctcactcaaacagcttgagtcttcttcagagaagtcctgccttctgtttctgccaagcattgtgaccaagttatttctgtcttataaatatcacttaactaacaatcatgtcagcaacttgaaccattctgtctgagtaattattgccataaattcattcaacattagagattacttccatcaaagccagttttggagcctattagcagcccagagcagagaggcaatctggctaactgcagctaacaattgatttcacagattacagtttaacatcagggatatggcatcaatctgctacagataagatgtcggaaataagttatcagcttacatttgtctggatctttgttgttttgagatgaaaggaaagaaaagatcaattaccactagatctggtttaactaataaggagatttgggtcctgggctgccccctgcccccaggatcagtagttattggtgaggttcatcagtattctctgatataagtttgctctgaaacatcccttcacatacatacttgaagttctcagaactagagacccttccagtggagcaagctgaccccttcacctcagggtagaccaggcatgtgaggaagcatgctcccctgatggtaagacgtggtcattccagagccctccttcgttgtttgcaaggaggaaggactaaaatggcatagctgtggtggcattgttccctcagtttccaggcttggaccagtttgggccatccagccttgccacagcctttggtccccactgctacactctctaggtgacccagtggcctgtcgccttccccatcttataaaagagagatgaccaagtattacataaaggcctagtcatttgagttggttcttaccaaatgtcacactcagggttggggtccacccccagctgaggtctgaggggagtgtgtggatgtggagcagggagcttggagaacactcaagagacagcaggtaaatgacacatagctttatttagcagctccttcactgggtgagtgttacatttatacattacacaaacaatagtggctgagagccaggtggtgagcttctctgtgttacgtcttcatggctatgattatataagacatgggactgtgcacttgtgccccaatccactgagtcatctaggctgtttacctcagcctatgcctgctgccctatgcctgcttggctgcagcacagccatgttccttacaccaaatggtgtctttaatccactatctttacaatgtctctgcttttctagtaggtgggaaagcagtgtttcccttgtagcctttatcgttcagaaagagcctcaattagtttcttacgcccatcaaacagatgagttttctctggaaaactttctggagttgaagaagaatgaagcaatgactgacctcttaggggtctcctcctgggaatcccctcctcaagctttgcacctttgtgccttattaacctttcaaacaaaatgggagacaacattcacttttctaaatgactattctaaacctaacaaagattccacaccagactatgacagctatagttccccatagttcaacagaaggactctcctggacctccccttcttctttagagctggtaccttcagcaggccctctgaggaattgagtgcaggtggtgatgctcttcttttgtctcctgttctactctggcctattggaagaggtacccaaagacgcaaaagctgcttttctagttgtaagtcataacaatgactgagtggtctctagaaaatgctccctaggtgtctttcaccaagaaagtccttaaagaccccgtggttccagatcatgaccaggcagatgtaaagggggccaggtcacgggtgctcactgtacagaatgcactgaatccccgctggttgctttagtggcagacaggcaggcattgcatgactgtagttgccaatggcaaattaactgcctctcagaagcagctctttcccttgaagcccccagtttctcctcaggcagctcaagtagtgggggagtatttacagctaatgaaccaccattcacctcctgtagatgccacagcaatgcttgacatccacacgtataaattcccaaaggcctggtgcctttgtaattattacacttaatgtgatctgcttgttgtggagcttcctcatggacaagaatcttaatccatatgttcaccatcattttaatcaggcatcactactattttaaaatggttatacatgtcaaagcaatttttcaaatccattggaaagtatttttaattaattttaatcaattgaggtaatgacagaaacagttgcgttttttcagtttcgctacacaacaaaaagtaacatagggccacatttatgaaacaaaagatggagaagatgacacatattacaattggcaattttgtgcaacacagtggaagtgggccaaggagtctgcattgacttctatttcagggaatcagaccacttgaatgcttgttcatctttgatttgttgctttgagatattgtaaatctatatttctagacactgactgaaattgaccaagaggaaaacataaattcttgttgacttaatttgccattgaaaattgtagtcaataatcatgaaaagtaaatagctgcacagtgcaatattagttgtctaagcaaagattaaaattcaagtaatcttccttgattagtctaagacagtaactaaaatgaaaatccatgacccaattaccatgttaagcagctagcataaggtttcagttgttctgtttcatttgaagtctcagactatttggtggtgcccatttaatgggcagataaatcagtttgaaagcacgggagtacttttaaaattgcagatgtctagtgtgaatatgacaaaataacatttttaaatggagttttgtaaagtggagtacatcagtacttcagtataacaatttaaggtcagaggctcattatgcttggcgttggagtagaacattctgtatatacaatttgcaatgtatgtcgcaatactatttagtgcattatttatttctaagtaatgcgtaagcataatatttcttaagaaagtattcttccactgattctttattgtgccatttattgcatgattgtgcagttaagtcctagggcaaaataagtaggaaccatcctgaaaaatgatgggattaaagtcctcattgtattttccataaaaatctaattaacagcaatcttgaaaagttgaaaatatcctactgtagcacactccattaggcatttacatttgtcatggagttctgctgcaaagacatgagtttattcttggatacatatgtatgcatatatctatatttatatagagagatatctatatctataaagatatctatatctatgtctatatgcatttttagatatgctcttcaccataggtagagggacagcaattaaaatatgacttcagcttacagtactagcatcatggggaaaatcagaataaagagagagaagactttatgacaccctacacttcttgtttttcacagaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgtaagcatcttggaagaaatattattattgtcaggtagaaacaagttaaccagctcatctaacttgatcatttggggatgttgcaggaggaagggaggaagatgcagagaagaaatatgagaggcctgtgtatacaaatacacaaactttccattatttctttttgtatagtgcctagtatattgtcacaaatcattagggattataaatgatacagatgttattatgacaatgataatgcttaaaagaatctgcaaagtcatttccacaagggctaaaatctactggggaaacatgataaatatattaatatttgctcctagaaatatatcatccttcttagggaaatcactaggcttctctgatagcagtgagcaaccagtgcctcttcttgggccattctttctattaatgatttgaaatctaggagactttgtggcataatttttgccttagcctgtgattaagacacttaactcttgtatagtgctagcactgcaacaaatttgctcgataactctgggccaatcatgaaacatctctgagataataaaatgaggggatttgactagatgatctataaagcttcttctagctccaaaaacgtttgcaattttgtgctcgcagagtcttctctattccatttaggcatgaagtcctgtttattgactcaacaggtgagtgagtgtggagagatgacatttttatgtaacttacatgatcatggctgaattcagccatttccagtcagatgtgccaggactgacataaatgccgtgggtggtggatgtaatgtttcagggttcttgccacatatcttggccatagagacaaatgacactgtcttgggctggcctaactgtttggtctaggccaatcgggctgtggcagtggagacacgaagctggcttacaagttttttacggctctgtttcctttaaaatgtttgggttgaaaaaaaatctttattttcttcgtatccatcataacaatttgtagatgatgcgtaggttctcagcacatttatatcagtgagatctaggtggtaataattattttgtattcagaaggtccaggatgaagtgtaaaagatccacagaaatataagaaatacatttcacatttggcttttatctttaaagtgaccctgttgactatggcaagtgtctgtgcatatgtgcatgcatgcactcagcaaacactgagggcactgggctgtggggtggagggacagtatcgtaaatcagagatggctccagtgctcaaagaactctcagtctaaagtgagcaatgagacatatgctcaaaggactagaatataaaatagctggtgattggtgtcttagggcagggatagagacaggtctctgaatggtccaaggaggattaaagtacttctggctgtaggcataaggtagttttcctggtggaggaggcgtttcctgagttgatccttaatagatgagtagggtttaaaaatgaagggaagtggatgaagaaaatgtggtctatccacacaatggaaaaggaaggaaatcctgtcatattatgcaacatggatgaacctttaagacattatgctaagtgaaataagccagacaccaaaggccaaaaccatgtgattccgttgacatgaggtccctggagtagttaaattcatagagacagacagtagaatgggggttgcaagcgcctaaggcaaagggtaaatggggagacactgtttaatgggtacagagtttccgttttgcaagatgaaaagagttctggggattcacaacaatgtgaatgtacttaacatgactgaactgtacacttaagaatggttaagatggtacattttattatatgtgtgttttaccacaattatgaaaatttcaaaatgcaataaaaataataagttgaataaattatcaccaggtggtaaaaaaagaaacaaatgaatggaaggctttttgaaatctaaaacttcacatgtatcatcaaatcaggaaagtgaaaaaagcggggacatgttcagttcagttgaaactaaggttcatggaagggaacagtcagagattgggcagaaagctgcagccaaatcaggtagggccttgagtgccagcaaaggagcttcagccttgagtttgcatttgagtgcagagcagggagatgctaggaactttgttcaggaagctcaagctagcagacagcagattgagggtggagggagaagctagctcaagggctgggagtccagccaggagactctttgttagtctcagtgagaagccatgagggcctgcattttgaggctttgagggagaaagggacaaattcgagagatgttggggagatacaattaataggagtaattaactgcaattaactggtaatgttgagggagaaaaattaaagatgaaatagaggaattgttttcaagaagagttctaggagcattatcatttttcaaaatgaagtaatttacagaacttcaatatataaagctgattaaagcagagcagctcagatggaaggaaaggtggggagtctctaccttgccagtttcagtgccactagcccagatactactgcagttccctgtgtaactgtgccaaagtcagtttggaaactctttattgacacggagaaattcagctttgatgacagggaagaccatcctgccattaacagaaagacgaaactggtttgattagtgatttggtttgccaaaaatttgaggcgctaatggccatgttggtagaattgtcctaagatggtcactgtaggctggagctttggagattgggtaagattgaggtttccatttgggtgttacctacctactgttgaatctgtgccaacaacacacaagattgacagatcatatcaagaaagaagagaactgcggagtgaactttggggaacaccaatgttagagagataccaattcagaagagcagaaggaagaggaggcaccatgggaagtatggtcagacagagaacagtcaggagagtcccacagttgctgggggcgggagggcagagtcagccacttgaacatggcaggtagtcttgtgatgccacactgtcacataattacagatcttaccacctcctttctccatcctctctatagcaatgacagttcaaagcaaagcccttgtaagtatcttacccatttgattttggacctggtagaaatgaggcttcaccatcctaagattgcaaaacaaaatggagacacactcacatttcacttagctagaaaccaatcaagcgcctcacatgaacaaaagggcggcttcaacctcacttcagccagggcagggatgattagagtacaatttcctagtattttgctggactgtatctggtattttgcagagtgacctgaggacgttacttaccctagagaaagcttctgggttggttcccttatcaaaaatacccacagcggggtcaagggatttatttaatatctctatctctccctctctttgtccatgcatctcttcctttctccctccctcctcctctctcctctctatattcttccttccctttcccctcacatttatcactagatttagacctttgctgtggctgtcttaatgggatggtggagctatgtaatggcagcacccaattagcttgatgtttggtgtcataatagaacaaaagctggtgattcatggcgttcataaaatatccagggtcacctatttatcctcaagctgtgtgcattgttttctttctttttttttttttttgccttctttcgtaacgtgcttgacattcaaagcatttatgacaaggtgttttaaaaagctggacctaatggaaactatttgtcctcctttttcccaggagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcgtatgttgttccagattatcatggacagtttggagtagtgaatggggggtgggggtagcatggcttttctagtgctgtgcatgtgtcaccccaaataagacctcagcatcaaatcctatacccttaaaagtccaccccaccccctgcatacacactcaccactctgtccccaccaagaaatgtttttggcccattttaattaagcagcattgttactgttccaaaggcaggttgttctgtcctttcctatccatgtcctcacatataaccaacacacagatgtatagctaggttttgtttgatctatttggacaactgtaatggttggggttggagcatgtggttatttatcctaatgggccattatgtacttcagatttcatttacagtattatttcaaggttggttatgatatgaatgacagcattagtctgcctttttcaaggcattatatgggaataaatttatagcagaaaaggtttgatgattcagtcttttactgaaaagatgaagcattggtttctgaaagagcttgttttgtttatttagggttcacaatgctgattattacatgcaagaagctaagaagctgaagcacaaagctgatgcactggtaagtttcctttttctcattgctttgttcctattaaggatttatgtttcaaaggaaaacaaagaaagcacttttccaaacaaattttcagtatcacagcccacacctgcctgtcaacacattgctgccctgacatagggagatttgaactagtgaattacttagttctgtaattcccaaagttctcagggcttggttatcatgtcatttgttttcccactgttcttccccttaccccaacttcagaagctcaatggcatataccactgtcattacctttcaagtgattttggaatgacttatgaaacttccctggaaatgatgtgcttttttggtccagtaagccagaactcgtgtgggaatgtgagagttgtttagagctgtctaaatggcctcaaaaattggctttgggaaaactaggcctgaggaaaaactcagctccttgctgcatttgatgacatgttttcagagtgagccccacagttaggctggggccccaagcagagaagagaaatgctgtcatctggatttctcaagatactttgcccagctgcctccaagggttttagccacctagatcagtcataagctcaacattttgagttgtttgatttggctgaggctcctaacagtgggtctcaaccacacatcacattgaaagctttagaataactctgatgcctagcccatatcccagaccaatgaaataagaatttctgggactgggacccaggaatgagtattaaagctccccaggagattcccaattgcagatatttgagaacgactgtcctagggaaggccctaaattcaggcttctcactttgactaaaccccattgggttaaaaaatagcatcctcaaacattgcattgtgtcctgctaggacttagttgtcccagtggtgtttgatactgggaatgctgtgatgaaataccatgactagtgtgtagccaacatcaactgtccatggtccttacatctgccttttccctactttctgtcatttccccactgtggtacaaattgcttcgtgtctgcaggtgacctttctgtggtgtaaattgttccttagaagcaattttcccctgctcctgcagacaaaaatgacaaggcaggctgggtgctagctccattggagatgccaggacaacagtgcctgtgaccattgtataggtgatgagagatttgaaaggcactggatggtaatgctgctccctcaaagaccaaaggttttctctaaatgtcctcaattctgtgacactacagagcactcaagtgctcctagggtttgccatctgtcaaagcaggggttagggagcatacacatgttccattgacaagctgttacatgagctgatgaagactgggatatacataggagaccatgtaaatgaaatgtttgaagaactgagaaaaatcggtaccacagacatatatacatatgattatgaactaacatcactctacattccaaggttgtgtttatatgtatgtctttcaagggatcacatttggcctaatccatttagaatatgcattcccaattggggagatgctgcccctatgggggtaaaaattggttttggagatggggtgaaaagatcttagttattgcaatggggtgtgaccctccaaagggccacagggcataaagagagaataagtatatttcttgtattaaaatttcattgggggtacgtgaaaaaatacagtgatccctccgtatccatagaagattggttccaggaccccctcggacaccaaaatcctcagatgctcaagtctctgatataaaatggccatttgcatataacctgttcacatcctctaatatacattaaatcatctctagatcacttataatatctaatacaatgcaatggtatgttaagagttgttatactgaattgtttagggaatgatgacaagaaaaagtctgtatatgttcagtgcgaatggaaccattcatttttttctgaatatttttgatttaagattggttaaatccatggatgcagaacccacggatacagagggctgactgtatcttaaaaattccttggtggtggtgggggggtgatatggaaaaacaaggttgaggaacacttagaggaatgatatttttgctaggcttatgcatatattagcctgggaagcacccttatagtttaagccactcattttatggatggggaaacagtcccaggggtggggggcataacttggctattaattggcactatagtcatgtaattttctgtctggacatcagctactcctagggacgaaggggtttaggctaggtgatctctacagatctctccagctattgggttgtgaatgaaaagtcactttcagaaatcaggatctaagaacaatttccaaatgggagagccagtggagccagatgacctaaggaaattgtcctgtaaggcaaaagagaaagtacctagtttgcatatatgtacacaggttttcacaaaatccgcttgaatttgattgaaaccgatatttctccacagtagcttacagaaagaaaaccacagaattcctgcagctcataaaagctggagaacatttattgtaaaaagtcatttacaataaaagattctgcaggacctctagctaatcattttatagttgtacttaatcctttgctagagacagctactctgccattttgagaattgaaactttcacagttgcatagaaaatattttgataaaaggtatacaagaaaattaaaacagctaaatctgcattatattccttcttttacataaaataccatattagtggaattcttacatcctgctatcaaaaattgaaaatgttaaatcctgttataaaatactcactataaaagtgtcatgtataatattcattacacataaaaaagaaatcagtatgtctaagtcagtttaatcatgaccattatcagggctaaaacctttgcaataaaattttaccaaactaaaatatttagtagtactatattttttggctttttgacacactatttcaaactatcatttataatgaaagtgatgggattattgtcaacagtcatactacagcttctcatctttcatgacaatagcatcaatttgttaatcttctcctgagagtgaaattgatgtcctcacaaagagttctaaagcaaaaatgtatgtgttcattgtccatgagacttctaaaaagcagcccttagttgcaagtactgtctataggacactacaatgagcagatagtttagtaaatttcatgaatagaaactagttgaggcaatgatttggattcaggtccaccaaaaagatagcaataacagcaacaacaatgccacaaaccacatatgataccctgcctgcatttttctcttctcaactagccttggtgtcatgatgatagaaccttaagccggtaacttcattgtttttttttttttttttttgaaaatagccaatcaagtttatttataggtggttaactggaatatatattaagaatagttgggcattgaaaagtatacataggcagataggtggcatatagttggctaagtgttgctaataagtttgaaaaaacagttgcagacatgtcactgtccttttgtctaagtgaggcgatacgggctttatgcccaaaggaaaataggaaattaaacttttttttcatgagactaggtatcagaaaggccaatcaatatctttcaggtcaatggtcttctctgggatttgagaaattgactggtcctctatgtcatccagatttatcagacaatttctcccctatcttgcttattaatttggtggaaactgagacatgctttgttgtttcttgcctctggaggggacagacccttaggtagaaaggaactgtaaagtgcctccatcaccttcccgcctctcatttctccctgcctatattaatgaaagaaaattgaaggcagggtcccaaggcatgtcaagaagaattgcagattaagtaatgttgttgtgttattttaattagacaggctttttcaatcctagaaaatatttttttttctatttcttttttttttttttttttttttaatgttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttgtcaggtttgtcaaagatcagatagttgtagatatgcggcattatttctgagggctctgttctgttccattgatctatatctctgttttggtaccagtaccatgctgtttgttaagaccaattcatacattgtcttctgtatcagggtttcttagcctgggcactgctgacattttgggccagctcattctctattgtgggagctattttgggcactgcagaagtttataagcatttctggcctctgttcaccagatgccccctctccccaggggtgacaactgaaagtgtctccagacattgccaaatgttccctgtgggaagggggcaaaactaccccccagtttcaaaccactcttttatatgaaggagaaaacagagagtattatcttgacgagtcatcttcctgtttcagttcgagaaatttggcaaagctgtgaattatgctgatgccgccctctccttcactgaatgtggcaatgccatggaacgcgaccctctggaagcaaagtccccatacaccatgtactctgagactgtggagctcctcaggtgaatagcctttctgcaatcatcttcctacactcatttcagctagaattagaagctatgttttaaaaaatgtatcatttccacttattaataatttgtccaagccatcctcttagaagtcatcataattagttcttgccattttattaatatcatggaaaatttataattgatggatgctgactttataaattatcccctccagaagttataatgtgagtgttataattttcaatattcgtaacattaaaatggaaatgtagtgggtagaaataagtataatcattttaccgtttagcattgacttgtcttttcaaaggtgcagttttataattcaaaaaaatggtgctctcaggatttctattacaaaccatgttttctaagaatttttatcttggttattaaaaagggaggggcactgttccaactcagagttggtgtttaaggctgcaggtgtggagtagactttccatgcatctggaattagggaaatagatgaggtggtagtaggggctggcggtacagatgagaggatgagaataagagaggggatattaactgcacacattattggtttcatttacattttaaatgaaattttctggctgttggtcttggtggtgtagaaattctgtgttatcaaaaaattcatagaagaagaggaagaagaggtagaagaagaaataatccattctggtgttatccagtgatttgcagatatttgtacaataatttaatccacccctgaatagtggataagcaccatcgttcactagatggactaaataatcacttttgattgattgagtaagcagttttttacctgaaaagtccttatgtccagtcccatctggcttgattaatcaataatgccaggactggtttatactatctatcttgcttgtacctgcattaactgttacaaatctgaggatatttgtacctaaatcttcagacaaacactggacagatttagtgtgcatattttcccagtgacacattccaaaagataaaaagaactatttttttaaagcaactctgctcacatagaatcagaagtttagttagagccacaaaagtagggtgattataagggcagctctagccttgcctgctgagccaatcagccatctttctctttgcactgctctgaaatgtaggcactgagaaaagtgtcaagtatttctccttgacttattttatatactgtgaaaagcaccaccaccattctgtagctttcaaggagaaattgattgcccagtgtctagtcaaactacctgtgattttcaaagatacacaagatgaacatactggcaaaaatcataaggattcaaaactgaagggaaacattagtgaacaaacacagggacaattcatgctctctattcattcaaaaatgcaaattaaaacaaggcactttttaaattaacaagaaaacgtaacaatgataatatctagcactaaaaactacagcaaaaaaaggcctagcagtgaaccagacctctcctatgcagctgatgggaatggaaattgattattgtaaattgagggcaatttggcattgtgtagggaaagccatacaaatgagtattcatatcttttgatccagtactttaactgtggaaatctgagttttctctcctgaagaaaacaattgtaaagactagaacaagtaatcggtatgatgttcaatttgacattatatgtaatagcacacaattggaagcacaccaaataataatagaacagtaattacatagtaggacactcaacagaatactttgcagcgattgaaatacaacaatgacagagactatgcagccgcacaaaatatatttattatatgatgttaaaataaaatcgagctgcagaataacatgcacactacaattatgatcatgaaaagtttgtatatgcatctgaaccaaactggaagggaaatgaaatcatagctgtaataagtcagtgagattatgggtgatttccctctctgcatattcttctttcttattttcttttaagaagacacatgctgtcttaaaaatatgaaagtaaggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaatatgaaagtaaaatacaaatttcattttatggtaaaagtgcaacgtgaatcattaagtaattttcttttaattattcacgaaaaagttatttagggaaaaaaacatgatttatgttttattatatgctattttacttcccatagaagtttatttcaatgaaatctgaaagtcaatggagaatttacgagcattcactttaaagtcagtgtttttaaactttattttgaggtaattgtagttgcacatgcagttgtaagaactaatacagagagttcctgtgtattcttcacccagtctcccccaatgggaacatcttgcttaactatattacagtatcacagcctgaacattgacattgaaacactccgaagacttcattcagatttcaccagttttgttttgtttccaacttcaccatttttgcatgtacccatttatgtcttctctatgttttactttttttatactttctgtaaattacatgtgtgtataatatttttttaatgagaggaatttcagttgggaataaaatgagttaaagcaactaggtcttctggtccacttaagcaattgaaactccactatcaagtcacttcaaatgtggttgcaattagagggtgagtgtaatgtgaacatagtttttagtagtgcaatatcatgttgaagaaatttttattactctctccccgacagtatgctggctacagagagagagccccattttcttcattcaagtaattatagttgctctgagctctgggaatctgcaatagaaatgtatttgtgaaaacaagtggggcatcacaatgacttgacatttcagtgatccaactgtcaaagaaagctagatttattacataataaaaattcctttgcttaatattgcaacaaaggaagggacccacgttaaatgtacaagtgcctttcctggaaaatgttcactcaacagaactagagcaataaccaggagagcaaggcggctagaatgctgaggaggccgagtctcagggggtgagcctgggctccccagtgttctgcgggggaaggttgctgaaagcgaggagtcaggcatgccagctcagtggccctgcaggctttctgtcgccttcttataaatgagaactttcaacttccttctgccacactgaactccattacttattctactacaagtacctgtgaaattgcattaaagctcagacaatgattttatgcaatgaattgattttcaagagtctaaatgctctgaatggaatgtacttggctagaagaaaaaaaaatgggaactactcaaccttttatcaccccagtgcagaacagtaacaattaaggagaatagaaagacaaaatatacaagcatcataaattaagggtgcttagaccttaaaatgctgtgaaatcgaccttcctttaaaaaaaaaaaccaaaccactttcaataggaatatattcaaaacctgagccattagaaaagaccttttagctgtgtgattgaggtctccctatgctcatgtcagacatagttatatattatttacctaatctgtcataaactgaactgaaactgacattcttgtccacctctcattgaaaaccagtcatagtatttagctacagtgttcctagaaacagtattttaccagcatttagacacacacacacacacacacacacacacacacacacacacacactcacggtaattccacagcattgtcctaaggctcatgatttcactgctttctccagagttcaactctgtatttcacatgagtcctcttatgacatttttatcctcattttgtgtatgttttcggggaagcatgcttttgcccacatgtaccagtcagtcctcttgcccagaacaaatgtgggaataactcattcaggcaatcagaataccagtgactttaggcatttctgaagggtaatacagattccactttagcttttcttttctcttcaaaggtatgcaatgaggctgaagaactttgcaagtcccttggcttcggatggggacaaaaagctagcagtactatggtgagtcccatggaggccacaaggaaattgctgaaatgtcatggaaggatttgaaaactctagatcaacttaagctgcttaccccagatcattactcttgttttccattaaactattaaaggataactaatggatttcttcagtcactgactaaacatttactctcctaacttatacccttatcaaaatgggattttaatgcttgccccttccctctttagaatttctttatttacttatgtttctcaatctaaccataggaaagtaactgcaaattgtgaatcagcagtcttcttaacagtttataaagtttcactaagcactggcattaacagaagcctttcctcatcaccacagctaccgatgtttatcactcctctatttgagaatgtttaagctgaagaaggaccatgctatgaagtactccagatcactgatggaatattttaaggtaatgcttattttgtataatttataggtacaggatgataaaatcactaataagacacgacatgcaggttatcgaatgtcaaatgctgccaaaggcttaacctctctcctccctgctggccatggccgtcctacccttccttaagggctcagcaaggagtttatggctgatttggttccagggagagaaggcacgatggtgcaatctgctgacttttttccagactcaccaaatgacccttggcagtctcctggttgcagtgaggagtatgtcacctttttgctgctctgtgaggtgggcacagcttgtggctataggtttggccagtcttttgttaaatgataggtcagcccaggaatctctcagaagtgagagaagtcactgtggccaccctggctctatgtgcacgtccacaaccctggaaggcctttgtccatggggagtcttggagtgcagtagttgtaattaaaaacaactgattgctttggttaccaaaacaaacaaacaaagccatatcgtagggagctggggcttttaacttataagcacaaaaaatataggcaatctcaaaatgcaacgccaaaatttgagaatgagcccaggtaaaaattgcaaacagcaacttcatactaggcctgatcactgtactctccaacaacagtcatgatttagagttggggagactcaagctccttctgttgggcaggtctaaaaagaaaaggacatgattttttttctttcttgccaagtgcgtgagacctcttggctaaatcataccaaagtagttgtttgaaatgagcgaaattatggccttatgtgaaacatgcagtgagtggaagtgcacagctttatgacgacactgtggcacagttgggaaaaagagcatgtttcccagctattatgtggtgtggccataatgccataaggctagtattgatgtgggtaaaagggagtcatatacaacaggccctcttctcttcatatgcctacactcttaacttctgctttagaaagttctttattgaacttcagtgggcatcagaatcccccagagggcttgtgaaacaagaatgccttgccccagctcccagatacctgattctgtaggtctgaggtatggcccaagaatttgtattgctaataagttccctggtgatgcttctgctgctgttcttgtgatcacactttgagacccactgatgtaatatttgccctctttggcctaccctctatagtttacagggtattgtaaaattccaaacaaatactaaataattcattcatccaggagtatgttgagccttcttgagattaaaaactggagtctgcagaatgcaccttaggtgtgggtctacaaagctccagagaagtattccgttctcactggactcccgaaaatgctgactctttccctgaccctcctttcgcaaagggggctgggctagcagcaaagaggcagaagatgagcatcactggggatgtaacttccgagagcaggtctgagtcaggcacagtgccatgagtgtgagttgtggccatctgtgctgcttgaccttccacctggctaggccattacaatgagcctgatccctgtcctgtagtggtaatgctgaatgtcagttttccctctgatccacaagtgtgtggtcttgaaaatacaaggaagcccatcctttaaaccagcccacttccatcagaggaacaaaggcatatttagtatttgattgcaatgcagccctggaccagtcactttgttaaatagggaagctctttagccatgagggtttgcatgtaaatagagcaaatcaaggtgattcctgaaaacaaacaaacaaacgaaaatactgcttggctctgacacattcttggattattagaaatgacagctcactctgcatcccagggaaaaagtttgcaactggagctaaaggtgaaaagcttacttgcactctgaagagcttgtttggcagaataaatttcagatgaggataattaaaccacttcttggagaaccgagtctgatttcactgggccttttagtatataagatctttcatcaagtgactttcatggtcctgattggagcccactaattatcctaaccagctattttcatcgagtgtgcgtcgtggtgtgctgacgtgcacatacatcccagctctgcatcccgaaatgctgcaatcaatattaatgtactctaaatcacacttccatctgtttctgaattaataaaacacaaaatagatgtccttatttccctttctcttctctctctcttttagcaaaatgcttcaaaagtcgcacagataccctctccatgggtaagcaatggaaagtaagtattttctgaaaattgctttttcgtgaagatgagtgattcaatagaccccagatattttgcattgacaagtcaggagtgaaggtcaattctagaactacagtcatttttgtgcatacaaaattccagccaggcttcggctaatggcaagacagaaaagtttaaaaagatgtgcttcagagttatttaactatttgatctttaagccaaattatagccataaaaatatctgctaataagatggcaagcaccatgccattttagggaggcaggacaaagttaactccactgcagtgatttttcaatgattcactcaataatgaaagaccaatgaaatattcattgatatatggtaagtgctgtttaataaaaccaaaggcataatagtgctgaaaatgtgaaggcacttgctcagccaattatccaagccttcatgataatttttatattaatactaaaatgccctagcctaagatagaaaagcatccactataatgctgattggaggctcagggaactcacctgcgcctgaggccttatttagagttctatctgcttgggacagctcagtcttaatagcagtggagtaggggcccaaaaaccgttgacctggtgctgaagctgcccttggcttacagggtaagctaagagggccccttcctctatctgggcttgttctttatcgctaaaatgaaggggttggacccaatgccctcgaagtcccactgaagagatgtctcttatagagagtgagttcgaatcccagttctgtgtcagctgtgaagttagctaacttgcctgagcatcagtttctcctctgatttccaaataccccttaccagcccaagcccacacccctcagtgatgggaagggaaactagatgactgtggacatagaccgctttataactccaagctgctttttcagtttttcatcatttcaaaattcctgcatctctgatcaaaataatttcttcaagaataaaacagtctctactgccactttataaatatctagaaaacgtactccaaaagcaacgggacaatgaactctactttgaaatcataaaaacattcagtgcgagggaacagatccattgaaaactacacattaactcaattacttcactgaaaggaagcactgtttaaaatgttgaattaggtcttactcttatattgacgaacaaaagagaaagagtgcttctctcttaagagaaaaaataagttcagaaaataaaaataaccggagaaaggcccagctctgttttccctgagcacagagtaaagtaagggcaagggcaggtaagcagctattaaagaatcactggggaaaaaagcgtttttttaaaaaaaattctgaaacgcaagaactcaaacacaacctaagcttgggaagttgcatgaaaagcctcctgaaatgattcttaagcagattttgcatgaagaaagcacattccctttggtaggccacagagcttttgactgaggcaactcaaaacagtcactcaggggttatgtctcgttcattcagcaaatgctttgcgtgcatctgcagcacgatgggctggggacagaaagctgaatttgatatggtccctgcactccagaagcacacagtccagtggaaggaggtgacaggtatgaacaaggtgctgtggaagcctaggagaaggagcttgggcctccctgcgtgaccaggaagggcttcttgtctgcaagcaagattatggccttgtttctctgtgaatgagggtggtgtcccccaaggagggctctcacagcaccttccaggagcagcaccctctgacttcaaaccctcctaggctggctagcaattggggaagtcagctgcccagaggtggttaagggctctgcaggaaattatatggagagatgagcagagggttaagaacagacattcaggaactgcttccatggaagctggagaaagaaagtgcaaagaagcaattggaaggagaagcagaaaaatctgctgagtttacagcaggggccaggaaactttttatttaaagcaccagacactatatattttgggctttgtgctaagaggtgaaaccaaggctactatgtagaaaaatatgagagaaaacaaattttcacaaaatttttactgataagattcaaaatataataacaattacatataatttttgaaatacaagtctattggtgagaagaatgtaaatctttttcataacattttgcttaattggggttcaaagttagtgttccctctcaacaaatcgattgcaaatgttcatctttcgcaaactattcagagcttacagcccatacagaaacacaagatgggccagatttgctgactcttgacacagggttctggaatccacattgtggagagtttaaaaaggctgagcaacaatttcgaatgtcacagagagataataaaaagaaagaagctgggcaaacatggatggcaggactttgaggtgacatggtggaatggaaagagaatgaagagaatgggctttggaggaaaatggacctgctattagatcctggctttttggctctctgggctctgtggccctcaggacggagctgaacttctctgaggccagaaacagtggcagcagaactttccctgcagagttatggtgaggcttggacagaatattggtgaagccctgaactatgcttggcacatagagactgtgcaacaaatgatggctgctgcagctactgttgccatgattactgttgtaattgttacctatttaagttagaaaagataatgatcctacctctagaattcccacagcacttggttagcaccacagttttggcacttactccagattgccagaaaagaatgtaatttgctcctctagtatactctttgctcttttgcaataagtagccatccatcctatcattccccaaatatttattgagtgcctaccttgtgtgagacactctgccaggccttttgtagacatatcccctatcctcatgctatatatgctcttctccttctaccttccagagcgctttatatgtagtagatactaaacaaagaatagaagcaagtcattcatttattcagctggtgttcattgagaacatatacgccagacactgttctagatactgaagtatggcacagagtgaaatagacaaaaaaaaaaaaaaactgccctcatcaaggtcacattctgttgaaggagaaagataacaacaaacatgtggcatactaggttgtgggaagtgtcatggagaaaactgaaacaaggaaggcaggcagaaagggctgctgaggataggggagggagcagtggtaccatgctgaatcttgagtagggattttagagaaggatgatggtagagaaagccatggcaatgctggaggagtttcttccaagcatagggatggcagctgcctctgaagcaggagggagcatgcctgacaagttcaaggaacagcatggcagagtgtggcttagaggtgagaggatggtgggttggaccagggtggtagtggcggaagtggtgggaagcatgtgcttctgtgtgcatgctcatttgcatgtgccatggaaatgtggaaaaaagggtgagatctgcaagcagatacacacaaagaacaggaagggaaaccccacgcagtgatgagagctaagtcagagttggagagcacactgaagtgagtgggccctgcatcagccctctcttagccacagtcacaacttcttaggcaggttttcatttaatgagcacaaggtagtgtgcagacatgtgcatcagaatatgtcagaccttagagcctggtgtgagaacagtaacaattgaaaacagacacttatcctagctgttcttgcctccaccactgagtatttaaaataaataaattagagaatagtagggagaaaagtccccaataacacttcagtgtaataaagtaaaaagggcttttcaagatgtatgtggtaaagagagatgatttggtttctcctgtgactcctggacatgattggaaatcattgaatccaaccttttcttgcagtcaagaaaagtaaggccaagcaaggagaagggatatgctcaggggcacacagcaattttatggcagggccagggctagagtccacatctcctgggattccagcacctctttccctgcaccatgtggtctctctttcccttttgttttctttttttctgtcttttttttgggagatggagtctcactctgtcacccaggctggagtgcagtgtcttggctcactgcaacctctgccttctcagatcaagtgattctcctgcttcagcctcccaagtagctgggactacaggcgtgtgccaccatgcccagctaattttcgtatttttagtagagacggggtttcaccatgttggccaggctggttttcgaactcctgacctcaggtgatccgacccccttggcctcccaaagtactgggattacaggcatgagcccctgtgcctggccttttttttttttttttttttttttttttttttttatgatacagccttgctctgactcccaggctggagcacagttgtgcgatcatggctcactgcagcctcagtctcctgggctcaagcaatcctctcgcttcagcctcccgagtagctgcaactacaggcacacgtcacatgcctttctaacttctttcgacatttgtggcacatgacaactttgtcattttctctaagaattacagacgagaaagtctttctttcttgccataaattgacatttaagagttaatgactaacactggggaaaaagactaggaaatagcttttgcaacctaccacaacaaagaaacccagctttcactgcctttttgtcatttcactgtcttctgtgcctagaccccttagcttggacatctcctcatcccactcctaccttaagaataaatctttctatcaagaagtgacgaagtagctcagaaattataaacatagcagaaacactctcgaacccattcacaccagacaagcacagagcaagtgtgaggatgaacttgctccctcagaccagaccagaacataccagaaaatagatggtttgcagaaatggtccaactctgtcctatagctgtaggcacagcctgtgtgagtctcaagagcattgcagttgtaattgttcccagatctagtcagcagcatttcagcattttggtatgctacaattgctgtttccccaaatcatctgtatgtgctgcccgtcagggtgcacatctgttctgggagccacactggaaaactagagttgccaacaatagcaactggtaagggggtggggggtggggcagaagacagagttccttgattgtgtgataaggtgtgttcagaggaataatgaagagattctttcaaacatgcagactcatggagtcctaaagacatcttccctccatttcatttactcactcattatgttctgtcctgaaaaattgatgcgtttgcctgggcagatgttcatagtgtgactggaggaggagagagaaccagaggggcacacagaccttgctttagtgactgttcctgggcaagccttcaggttccttaggtagccagatctaaccctgggccctggaagaaaaacgacccccatgctgtatacagccagcaggtgactccttgttgcgaatattaaagaatataatgaaaatgtgtgtctaaacactggtactctctgaagtggaaaccctgaagacttctttttataaatcagcatgcaggtaaatagtcagcaattaacagcccatctctgtagcatgtcttaaagaatcctaaagagagagaatactacttttcccagcttcccaaatactgctccttggggggctgtaagaattgcactttgcttattgtggtaacagtatttggagcaaactgacattgtggtttccacaaaacactttgatgatagaccaatattggacatcaagtgttttctaactgctgatagccgttccagcagcaggtagagaaatcatcatagctctgagctgtttctttctctgaaacatcacaacacttgttatatgtattcaaaggaagagctatatttgtgggtagaattaatgccagagaaatatccacccagccctctctggtatttgaagacaaaagcagtggtgtgcatggagccctcggtggtggtcaaaggcagtggagactttggtgtttaatgttagaaaagaagaagagtgggcctcattctatagtgtggcactgtagctctgggtggcttggtcagatgaggcaggtatggggtggtaataatctctgtatccactagagcccctggaaaaagctattgtgttgacaaaagctattgcattgacaaaagctgtagctgtactgtgagaagagtcagtgggatgtcagaacaagctccactctgatggggcttcacatgtgtacgctatgctaaacttcactccagcaaatggcattctgatgagatcccagcgtgatggggaaggcctagaaccccactgtcactctttcctaccagcctaacaaggcttgtctctttccatttcccaggaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaaggtatgctcatctgttctacccatatagctcacagaccatgatggagttaacttcactttgaaggacttgagttgtacttggtggccttatatctttctgtctctctgatttccagaacttagataagggaagacagagttcgctcagggctgacacagtgacctattattcctgagagcataaaaaagccccggaattttgtcctcctttaaagcttaaactcatttgaactgtgatgtgttttgaatttcactcactgacaaagatcaacacagagaaacagaggcaaagacaaaaataatggtttacaattaattatgaccctgttggctcctgttattattgttattattatttttttgagaggtgaggttgaactaaggccttcaaccttcaatataattattagctccagttgagtacacgataacgcagcttgcatttggaagcaagggccaaagttcagctagtacttttcacacaccgatggctgggatgaagaatcagggtgctgttcatgatgacacttgaactttgctacaaaacaaatgcaaagaggaccctgctttaccagagtgaatccgtggtctttggtgactcatgcagacatctgtgaccttagctgtcattgaggatcacaacaaagcctcactaccctaatgaaggtgggaagtaaaattaaactgcacatttgtctcagccattcatttgacttggctgattctggcccagcagtcacagactgctccacaccagtcaaggtggggacaaatgtgggctacccattactactgtatcgctgagcatgtggggaaaccatctcattggaataggaaggatgcagattttgcaacccaatcatttaagtttgaatcctacctgggtcatgcattacctaggcaacctaggcaagttaattaaatctgtgagctgcttcctagcttctgtctctataatggacgtaatggtgatgatgatggtgaaacgtcccagatggatgatagagatgggttgaattaaataatgggtgtaaagcacctagtataaaattctgagttcaaggtagaaattctacaaagatttattatctttccttactccataatattatgtatctatataactcaaagattttgtggctcacaaagcacattccataatttgagacctcacccctcaacgcagctataaatttacactgactcctgggaatatctgcatgtattggttccacaggtttgtgcagcaatttctatgtgccaggaactgcactattgctttatcatttgttgtctcatttgcccttatttcatacatgaggaaactgaggctctatgagattaagaaactcacccatgttatcacagctcttgcttgttagaagcagaaatctagaagtgtctgattccagagtctcatttcttaatcaataggctacactgcccatctagagagcaagattaatgacaggtcctcagagacctttggtgagatcccaaaccagttatctgagcaatggataattattaaattgtctacttttctacacctctggaaactcagagacaactggcctatacaaccagactcatccaggggttctagaattgcaagtgaagatagacacatcttaagatttgcctagcatgtctgcctctgctatttctctcttattttgtattagtaactggagggcagttcaatatttatggatttcctttatcattgcatccattttcaaaatctgttaaaagtatttccttctaaattaactaacttcagaactttccaggagcaatgtgatggctgtgctgatgttagggtgaaatggtgttaatcttgtcattagcacagtgtgtcaaagagttgctaaattccctgtgtcatcttgaatgaaaacaactccgtcactctaccagcagagagaaaatgtgtcctgttaatgctgtcattggggttttcagcggactggggagaagactagtgtgaaatcttctgctcaaagcctggagtttcatactttgtcatttctgatctacttagctttggggattctattcacatctaccttgtctacatagaaaagagagaactgaagagcttcccttttggttgcagctctgcatctcactggagacaaccacgtatttgcacgttttttacccagtggagatgggtgaagttggttctcccagtgaaaggtctccactcctgcctcatactgcccacaatgcagctgcagatggcttattgtagaaggttctggtgctgaaatgagccaatggcacttatgctgccctctggcctttggtctagaagcttacctgcccagctgcttatactgctcatttggagcagttattaaaatggtgtctaattaagaatgccacagagagctttgtacagaatacccagggaacatcctggctcatatgaggctcacattcattcaacaatgactaggtccttaaatgttttccttaatactgtattacataggaaaatattttagatgccagaaataatttactcttttatcagcagaaattattttattgcatagtacaggttaaaaagtatcatataatcaaatgaggttgacacctagagaaggatcccatatgttatatataacatgaagagtaaatgcattgtttgatgaaattccatctgctgagcaatcaagcacatgtaacccatgcatggaaatcactttccaagaaggcaggagagcatcccacgttagggcagtctccagtcctatcccctcaccccaccccctgacacggattccttgctgccagccagcacatagctgaggctgcttcctttgccagagagctctctcataactaagtgccaggcaaatgaattcgtacatgaaaagggaacacctagctagtttttagagatcatatagtttttcccacatagtacttctatcgcctaaggcagacgttccaaaactccagtcgcgctagttagtagtgtagcctcagggctgcccccttccctaagtgaaccaaggggaaatcagctgggcattcttaccattaatgtcctaggtcaggggctggaaaagttgttaagtgacagatacttgcaggccattttccatccccaatgaaattggtaagaagacttacagaatcaaattcctcctagatgtttatttagctgtggaggctgacggctactattaatgtccagattcatgggccttgtctagaccatgccaagaaaactcagtaaactcggttcatttagacaaaaggaaaagaggatattttcaattcattaacacattgaatgacaaacagcttgacattagatagaccatggctccctacaattttgtgtagaaatacccttttctaaatataaatgtataatctatgaaaacataaatgtattatgtactgcagagtttttggagctcactaaagattaaaataatagggcttgataaacttgtggagttttggtctcctagtaggcactctataaatgtttgttgaatgaatgaatggacaaatgaatcacatttccattgtccatgtggttgtggtgttgtgtgaaagcagcttctcaatgtggtgcatattttcatgatatcatataaaggcctaactgagaactgctctgcttttcagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaagcagattagctgctactacttttaaaagacttaaggtcgggatgcctttttttccatgtaaggaaatgaaaagaccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgtggggagggcagaaagggggtgggggtgggggcgggggggtggggggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagaaatcctctttgggatcagaagatacctaaaattctccccttttgcccacttggttagatgagtgatatattctttggatcctgcaaagaagagattggtttattttcttttctggtggtggtagtggttgtatctgtggctgtgatggttgttgttacttgtctctctctctctctggctctggcttttgctttcctgctagtgttctttctctttccaaacaaatagttaaattaaatgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacacacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcaactggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 5139 - DNA, 500054 bp, human; identical to SEQ ID NO: 5138

SEQ ID NO: 5140 - DNA, 403378 bp, human
cgagaaccgccagcgagctgtgccgagagccgcgccgacccgctgcgatcagggacaggcgcccgcccgccgccgccgcctggccgctatggatctattcgactttttcagagactgggacttggagcagcagtggtaggtgttgatttttgccttctcctttgatgagcgagtctcctggcgaagtctgaggttttcgcctttgttaagaggagctgaagctgtcgtggggggcgccccggactccctcccacttgctctcagccacctctggccccggccgcgctgactcctaggtcggatgccggggtggggggaggtgcgggaagagggagggatgcggacccgaaagcgtcgctttgcgctccaagtctaaagagttgcatttggctcacatcgaattcggtgccgcccgagggctgaaccgcacgacctcccaggagcttttctctcggagcggcttgccggtctggcctccttgagccccggatgccgcccgcccgaaatgtctcaactttccaggtgcccaacgcccgcggcgggccatgggggaaaggcaacggccaggtgcggccagcagccctctgcttccttggtggccaccgcccccgctgccgccacctccatccctgcgctgcgcggcgcgcacacctttccttctgccgactcagcccaagttccctgcactcccgggtggagcagcggctttgggggccaccactcaggggaccttggttcgaggccgacttcggcgcttggctttcaagactgagggttttcggagttggccccccaaatccgcagctctgatgtcaatgcacatttaattaccggatggacccccttcggcctcccactgggaggcagccgtagttttttgtaagggacctccagctcagattcaaaggttgagtcagctcttcacaaaataccctaaacttgtcgctgagacattttgaaagatggtagaaaggtgactggggacctggaaagttgttaactctcttagagatgtgcgtgcgcgtgtgcataaatactgatatacatatctattaacttttcaaaaacttcacctactacaaacattatcacagtttatttgtcataatacttaaacgtatcagattccccccgcagtctaaggaattagatggggagggggcgcagtggtaaccgcttaaaattgcattcttggttattgccttttaaaatgtatttagaatgatctgtagtacctaccaatagtgcgaaatcttttgcaatgttaaactactagcggccgttggttatgaatgctgtgtatttttacaaggatttcccctgttgatgtgatattttaggcaatttccttctttaaaaaagggtcatatgcttagccaacagcttcattatgccaatcatgcctcctttagttgcaaatccaagatagtcagaacttaaatacattttattttacagcaattccggataaatccttgaagcgcaaattatgctgtatcagtattaatctataaggcgttttggataccacggttttatcagctctgtagaaatacattgttacattaaaaaatgctgttatttgaaagtaaaaattactataaaattattgctcaattagatattatgcttctgcacacagcctttactctgcttcactaatttattttgcagacaactgataaccatagcactctatttgcatacaatttgcctaatatgtggtgtgggttacatcgttaatttaacagacattgttataattaatttcatgggtatagttcaaatgttaaacatatacaaggtattaggtttttagaaacatgttttttatattaattccggtttaatcttatgcatatgcaattgcatatttaaagggaatggactcttttatgtttgatttctttaaaaaaaatgataggctccctcacccctgtgggaggctttctttttcttatcttaaggaaaatgcaaaacctttttttcctccagatccctaactgagacacatcagttaagaagcatagacttggacacttcgtgaatattatgtgaaatactgattaattagtgtaacgcatctgcataaataagcctgtcctttccctctgtacatgatccaggaaaatttctccttcttactgctcgtgagtggcacacttcgtgatgcatctctgtttataaacatttgtaatgtggttgtgcttttgtgttttgtatagctccacagagaaaaggaacataaatgtgacaatagtggatgaactaaaaagcttgacattgtcttgagtggaaattggtacctttcccacttctctttggaagtccagagcatgccagttacgtgttcattatatgtttacttccattccttgggagtaaatagctacttaaagtgatggcctccactccccacgcccccaagcccccaggagggccaagaaaggaaaaaagaccagcaaagttaacgatcttatttaccttgaatttattcttaacattcacttatggaacagtaagctctgagctgtctctactgcaaccctagatgtctgacaataaatggatcaggacagcttaaaaacaaactcattttcctagacataatgaagaaagactttacatacacaggcatatgtgttatttgcaaacacttgactgtagtaaacaaaaagtgtgtgcccatttataaacacacacatttgttagggcaaatgcaaatggaaaggatggggtactaatgatgctgcagtgtgcatgttatgtgcagtgttttggaatgctcacatgcctaatggaacataccactggatttcacaaactgcaagaataacttaatgggtcatgctctggactcgattaaagggccaaagctcaagttctttaagattcttggatgaatgagcaatgttcacctgagtctgaatttaatataaaccattctgtgaaagaaaaagatggcacagatgtctgtctgtgtgcatgaaagacatcacttgctcttaaagaaaaagataaattaaaaaaaaatcaaatttcttcatttaaatcattccatagacttgtttttggtaaccaagtaaatgaatacttgaggtgactgaagatcaggtaatgatgtcattaatccccatttaagagggaaaaaaagcaaattcagagggcctacaaaatgtacagcctttcagttctgtaagcacctcccacccagtattgattaggtattgctttgtgacaagccaaggttctttgtggggatgcttaccttttcttcattggaaggaaggaaaggaaagaaaagaaagaaaatacagaaagggacacattcttaaaaaaaagaaaagaaaagaaaagaaaaccaccgtgatagcaaaatcagaacgttcaaaagcctagttaaaatcgtagttaagtgactgtgacagtggctggcttctcaccgcaagggacagcatcaattgtttgtagtttttatgtgatgtctcacaaatagcctaattagaggcaagcttgcaaacgggcagttatacaggaagagacttaaactcactaaactgttatataaatagaaagttcaaaggtctgtgtggggctgtcaaggctgagaaggggccatgtgccggccaggcctctcctcctccggtaaaggcagcccccagggcctgccccagcagtccgaactgcactttccccagttttcttcgaccttgcgagggcggggcagtgccggagaaggggcggggggctgctttctagacaaaagtgaactgtttcagctccagccgggcatggcccatgcactgcagcaacccggctgcctcctcctgttctgtgcgcacaggtcttccgaggcctcgttagctacaatcctccagaagagcggaacaggactgtttatggatgggaaggtgtgggagatggggggaacacaacctttgccaacttggagatactagggctgtggtggggtggggggaggggaagtcctgttttgaataaggcctagagattcccagcatttcttgttctctacctccatccatttatctttcccgttttccctctgtggtctcttaaaagggagactgcctatggtctgttttctttgctagtacagtatgcattctcccgtgtgtttgagcattcattcaacaaaccattttaggttgtgtttcttaagggaatgtgtgggtaggagaaatttaagttggtgaaattcactagtaaggtctcctccgcaactccccaaaccctccaaagaataaaagctatctcagtacatcttaagaggcacatctattggacacggaagaaaattatctcatggtagaaatcagtttaatgatacatgaattgttttgctaatgattcagtcaagcatttaacaactttaaaatatacaaatcaaggtagaaaatgactgcctggaaaatgagtccatcattatagacatgaatgagattccatacatttaagcatcctgtagatggatacaaattatattgtatttaaacatgctaattattgttgaatagaaatggctttaatgtactaacctttaacatgtaataaatgcccatgattcttagctaagattattttgccatgcaaaatttgcacttatttaacataatttcaaaattgtagaagtccaatgaaatggccttctctggaacaatttagagctgtggccttaagagcttgtaactgtaggtcatacctcaaagcggaaaactgccatatacttgattagcctgtcacgtagacaaaacaatttttgctgcagtgactgcatttttcacttgtaattttgtttttctttttctgattgctgttggataaagagagatttcaaaaacttgcttactgataaatggaaagaaatgttactgattaaagaactcaagaccaaacttgaagaaacctttttgagtgtgtgtgtctgtgtgtgtgtgtgtgtgtgtgtgtgtgtgttacctgtggtagaactcaacattatcattgctactataatttgagtgtttactctgtgccacaagcttggactaaattctgtaaagactcaatttcgtttaatccttccaacaactttctgagataggacctgttatgatccctgttttacagatgaagcaatgaaatcacacaggtactcactcagtgatgcaatccaggtttcagcatagatggagctgactccagagcctgcatcatcaacaactgacgttttgtctgagcctttccaacatgtggaatgctcttccacatgctatctcatttgatcattgtgagttagaatgttcaggggttcttgccattttattgaatggcaaattcattcattttttgtgtggatccgaatatttatttagccgtcactgaaacaaatggattggattgtgtatattgtacttgtggaagaaatctgtggaattaccatgtaatttgaccagccatggaactctgctttttccttttaattagaaagagaacagtctatatactgatacaatctcttagcatgtcatttatggatgcccccttcatgaaaatgtgagaatggaaaattatatatatatatataaaggagacaaatctcaagtccttgagaattgttcatttaaatctgaatgctcaaattttgaagatttgatacttgaacataaagaagaccatggtatattttttggctcatttggagcctcaaaactggaggtgggaagttggtaacatttctttccaaagctttctaatcttaccatatgtattaattgattggaccctcacaataaccttaaagatttgttaggattgatattttagcttcattttgtagataataaaacggaagttcagagaggttaagttacttgcctgaatttgcacagtaggtgaatagtcttaggatatgtgtttgttgctcttttcgctgcatcaccactggtgcattaagttgttaatatttaaatatccacgttgcttcctagagaatggtgtgtcaccctctggcatcatttagcacagtgtttttccatcagaggtactcaataaacatctgttgattgatgttacagtcacattcgactcaaagactgttccatgcaaatgcaggtctctttcaaggatagttacttactaaatcctagtgataatactgtccctctgcctgtgtgattgtatattagttatttgtaattcttttcatgtctcttagccagtctgatctttttgcagaaaataaagagaataaccaatggatacagaagaagattaataggaaaaggcaaaaatagtatccatgtaattggcatgtttttaagaaacagaatttctatgaattccaagatatgtttagcccaaaagaaaaacaagaggaaagaatatcttttaaggtacagcattataggaattaacggactggtattgtgtctcaatctgcattgagaacattaataaagaatgtgtaacaaaaatctgaggaaaatatgagtggtcggagggttgggattcctccagctttccttgagtttcagtctttatgacttgtatttcatcatgagaaggctgtttttctacttaactgtagcagatccacaccataaattatcatgactgttaaacaaaggtccagccctgggttcttctaatgtaaaacttttatgttacactttaatgaaattttatatgcatgttcaaagcaaggcacactttacaccgtagagagggtgatgcactgaattgttgaatttattttgaagtaaatcttttagatgaccttagcgtctaacatctacctacttactgagctgaaaaaaagttatctgagagctgaaaaaaatgacatgatttaagcagagctgacaatagcactatagctagaatgtgattttgattatggattgcttactttatgggatgctgtttttcaaacatacctgtgtattttgcttcatttgaaaaataaaatcagctaatgtttcaaagtaatcttcgatttggttcttcagtaggtacgttctcttatatgaaggtgtaaaagccacactttgaggattaagctaaggaaacaagctttgttttcattacaaaatcaaaatcactcatctgtttatttttccaatgcttcgtttgttggagaaataaaagacattacttccatcctatggagaacagtttgttttgttagatttccaaataatagttctctgcatcatctaccatcttcaatgaaaaccagatctcagtagcagatactggttcacttggtgacctttattaaaccattttcctggagtcagtttttgtgttttgtaggcaacgtatctcctggaaataaatagctttgaaatggtttcttttttgtataagtaaaaaataatatgctacttgttttgtagtggtgctgaaattgaaatctcagctttaacaatcattggaagaagttgcttgctaaaattgtgatgtcttcttggtgtttgggtttctagtatggtttgatcaaaccaaccaagcagatggaatgtgttgttataaggtcattttaacctgtagactacggcaatatgtacatgacaacctgactatctgttgaacaatgaaaaatgcaattacgtaggctttatttcccccttcaggatgtcagccaacaaattttttaatgaattaattttccaaaggactgattgttttcatgccaggtcggcacaaccacagtgactaaattagactcagtgtgatggatgtttctgatgaagtgccgtggagaggtctcatcaatttgctattatttatttgctgccaaagtgcttggctttggtgtgtagacgttaatcaggtcgtagaagctagagttttaaggctggagggcccctttggatcatgtgatccaaactcctcattgtacagataaggagactgaggcccaggatgggaaaatgacttgcccaaggacatccagtcagtaattggcaaagccgggtcaggagcccttgtaccctggttcagtgtttgtcatctctcaagaactgtttgtattgcctacctactctgtgcccaacactctgctagtcagtcatttttagggagagatgaaaggaccgtagaagatgacctctggcctcacagaatttacattggaaagtataattagaattagggaaatactatgacatggactgtaagtaaaacaggaattctgggagagagagagaatgcaagctaagtaggcaaaacagtcctggtcaaggcccatgaaactcttttattactattagtgcacttcagagtgaaatggaaatccagaaatttttattgtttaggggacccggagcattgaatactcaacataagacaattgactttggaccctgaattatctggtttgacagtagctcacattcatcacataattgcctgagtcctcttttgctgtgtgaatggagtattctcattaacacagaccaacatttgctgagggacaaccacaaaagtctcccaagaagagctttggaaacatttgtgcaaacattcttcaaagaaataccaaatgaaaatgtgttttttttctgaaataattgaaacaagtgtttgtaaattggtacaattgctagcaaaatggccatttttcaaaagaagggtatactgtagctcttgagatgttcacaaatacattgtttcttttgctctttctccttttctaaaaatataattaactgttttgtttgttaggtgtgtaccaacattttaccattagaatttcttttttcctaaaaagggagttggtgccttcgtactgtgtgaattgtgttgacatctgtgtttacgattagctgtttggccaccaagtaattctttgcctggctatgtcattgttcaaatctcaactctatctctgggaagctgctagtgagcagcaggacctcctgcttcctccgtccctcaaactcccatactcctacccagtctgttcagatgcctctcctctgtgctttcataccttcctgagctgacttccacctgggctggatcctgctttctcccttccccaactcttcccatgcaactttgttgttgtgaaagatgagaatgtgtcttttatttttgtgttcccagtccctggcccagaataataacctaatgctgccagttcagagtgcagcatcattcatttattcagttcattcaggcactatgctagttcttcaaaatattaaatctagctgagaagacctaaaaacggtattaatagtaataatttaagctaataattacaggtaacatttcctatgttacaggttctgatttgtgttatccgatttctctattaacagagcaggaaactgggacagaagggttcagcgacttgcccaaggccatactggtagtatgttgctgagcttgaattaatccacaggccatgtgaatccttagcttctctgctaatctataaggataccctaggatagatgctatactagtggcaagccctgcttgtgcttgggctctatagtagactgggctaatgaggactttaccactcatccttagtatttacaaattgggtctaagttcattatcaaatatgaggcatgactttccagatatctactccaacaagagacacacaagtctgttcctctttggtgtaagtggcagattctgatcttgggaggaaggtatactggttcaaaaacctgaacctaattcaaacttgacaagaatgtgagctcattaagggtggagagttttgttggttttattcactgctgacactgcaatgcttagaacagtgtgtggtgcacagtaggtgctcagttattttttggtgaataggtagatggaatgatagacaaaaacctgcttaatactttgtgtgattaaatttgtgaagagatagctcaagaggtgtaagaatgaggaccaagagaagtgctaaaatcacaatgagcagacaggtgggtacaggtaggtgtgttgccttgccttctgtacatacttttctgaaataggatgcttatagaaatgttataaattaaatgttctttatgtgcatcttacttgccaggaataccgtagggaagtctttgttgatgagcaaaatctctcccaaacagccctaaacttatcagatttgtgtacagcattttgagattttagatttttgtgtacagcattttcttgtcatgaggtatacctacatttaatatctgcaacagtgctttaagggtaattgggcagccttaaaaaaaaaaggtgtagtaacttgttaccatccctgaattgtagctttcatctagtacaaaggggggataacagacttcaacatttgctgagtatttttctccgcgcttttgtaacgttgtctcctcttagctagatgcccgtttgcttaatagttcccgctttggaggctaacctgggatttgaattttcctaacatatatttttacattgaacacattttctatttatgcctctggaggattcaaattacaatttcatcccaaggatgtgcagaaaagtttccacacgtgctgattttaaagaaatctataagataatttggtagggaaagaggattagcatttacagagcattatggcatatactttacaaacatcacctcattgaacaaggaccctaaaaaataagggttttcacccccattttacagacaagaaagatgagaatcagaggggtacacccctaactttctcaaagtcacatgattagccaacagcagagccccaagtccaactcaggtttcttgggcccaaagaccacatcccttctgctataacctgccttcacagagttgaagatgagctgataatagagtttgttgggtaccttcaatgtactaaaagtaatgtggaaaaacacccctgaacattattttattattttcaaattgcaaaattaaaggtgtcaggatgcaggtcaggaagacagacagaaacatgagatgacaaagaaatttaggaaattttagtgggagtgaaacacccagccagttaaatgaagcagactttaagctacatattaggaggacagactgtagataattaatgggtctttaataaattgggtctcataatcagaaatgaaacttatctgaatattaattacagatccagaaaaaatgcaagagccatgatggacctttttaaaaaaaataacagttaaatgttaactatatctcttttgctacaattaggcattttggccatttagttttgaagttctgtaacagtttaaacttcaacagtgcaaatatattcagactgtaagtggtaaaacttcctgtcaagaatgatgaagactgttttcattgtattctgattagcatcatacttagaaactacagtgaaatgccaatgagcactctaatgccattgaaaaaggacacccacgacacacgtctgccatacatactttggtaaacaattgcagtgactcatataccttgaacaaaaaatagaaatttgatccaacctatttcaaaaggcttgaaagttaaagcgaattctaaatgtagattagtagcaaatgatgacagccaagccagcattacctcagttgattaatttataaggatattggtcaatgattttacccaacagctacgcatagtagaatcctaatgggatctgtctgttaaaattacataaagtagggcatttgatttatttcatagtttctcagagctcaattttaacttcatacaaataatgcattagtcacccaggataaatgacatgctgaatacagttgtgattttgtctgcttctcataatcagatttagcaaaggattacatctgtctttgtagtttattcctatcctaaacatttgtaggtagagtgggatcttttctcttgtttcatatctcgttagatgacatcggaccatccagccctttccctgcctctgggtttctggagtgtgtaaggaagattcactgatttaggggtagtactaagaactaccacatctacagtgaggcacatagaagggtttaaagacgttgctactctaaatatatcattaggagtatatcactatctatttatatattgctgaacgattttatttcatttttaagatttggttacattcttaaacctggagtacatattattataaagcaaattcagtaaaataacactaaaatcattcaaatgcgctaaagcaggtgaaaatgtggggatcaccaaactttgcctacgtgcctatactccaaaccatcatctccctcacccttgaccctggggttgggagagtcttttctttgtgctgtgaatgctgcagtagctgctccagggatgtacctctctgagccttacagtgtcaacccaaatgtgatttcaatgccaagacctggctgacttttacactctgatcaccattatttctgtcttttagtagcttcattgccttaatggaggacggaaaggtgagtttgcccaactgaaaaactttgaaatctgttcggcctacacttgcacaccaaaattagaagaagggggaggttttaaattcgtggctggctggaaatatgtgggtttatatttttaagatgtaaaaaatatgattaggagaaagttctcagaacttcatggacatcatgtaactcttagaaagtaaggtaaattataaaatatgggataagttttcttaaattgaacataatcataaaaattcaaggcaaagcaacatattctgcaaaatttatgagatttgagggtgggggaagagtttgcaaagcttgacaacctccagtgcatctgacctggcacattcctgttggtaatgagaaccttatggggtgctgggcctcggttttcttaggcagggcctgctccccaagggtatcataaatgatacgcgagtcaggaacttcatggctcatggtatttctcagggatattttagttaagctgtcccacccagctacagtggcagaagttgggaagagggcccactcataaatctttattgaactttaattaattaattaattatttgccattgttcataggaatttgaaagggaaagacatattgaataaccatgcctatctgactttatagaaatggtccaggttcttggggttaatgtgacttttattatttgataggcacgcatttgtttaacaatgacaataaccggaaaaccacagaagtataaataccagtaatgaaaagttcaatgcaaagaggaaaaaaaagaagaagaaaaagtgcaatgccaaagttagggctatttcttctggtgttttcttatgttttgtctttccttttctttccttttattcccacatgccgtgaaagtttggagttggccacaatctcatttgtgaatttgggccttccactgtaggatgtgtagggtggtcagtcatgaaatgtgtatttgtaaatacgtgtttgttcaaagcagtcttagcacccggatttcctgaacatagttctgatatggctttattctcaaaggacttctagcagtgatgctacattttggtgttgaccgttggaggcaaggaaatgtccaagttgaattggtctatgtgatgttgatcctttaactatgagtgtttactgccttccctgggaacttggagcttagccgactttaacagccatagaagacaagcctgatgttacttctaaatacacaaccctcagttctctatcacctaccctcctctttcactatcttttaaattcctgacatttattcatataaacagttcagtagttactgttttatttggttccttgaataggtctgacagcatttggaaaaagacagcttatgatgtgggcatcatggtcttatttcactgtcatccttttaattgtattacttacatctgataaattttcagattattttctaccttttattactgatctaggatacttatggcagtgttttgaaaggtgagaaacacaacactgctttctgaattttttctaaagactatggtgcattttatgagataaatgtttaaaaggttgttatgaatgagacagcctacactgaatgactgaggagactggacagaatgaaaccttattttaaaggaaaaataagccatttttaccttccgtaagtttactttgaaaggtaataaacaaattgtttcctcactggaaaaaagggaggaaataacatattcgggaggcagaggcctttaatatcttgcaggctgtttgactgtattctgaatttcatgtccaaaactgtcgttgctaatgtagacttatgaaccatcatttaaaaaaatccaaggaggcatcttgcatttaaattgtagaattattagaccttaattttcaatgaaatgaaaagacactagcaattctagctgttttgctttagctaataaagccatacttgtttctatttccagtgtcttatttccaggaagactgaattttcataaataggcaatggataagcaagccttcttagctttagtactgatactttgtatccctccattatttattaactggacaattaaggccctctgtgagatacattttttttcataatgatagtctcccatttaaaaatagagttgtaaaaatcataaaagctataacgatataaaaagaaatgtgatcaatttttatgaatcagtgtgaactaatttcagtggtgtgcaggcaaaatggtgaatgcagctatggctcagttctcgtgcaatgtatgatgtgtaaagaagaaaggagaatctcccattggttctttgcaatggttgctcctgattcatgtcccagcagtggtataggatcttagaacttcagatctgtaaaggtccttaagggggatgagagtgaggccaaccccttgttcagtctccccacaagtaatcatccagcttctgctagccaaaaaacaaaaacaaaaacataatgagaatgaaactgcctcctatggtagcaaatttcttcttttttggataggtcagaacaaattccattgtatgtgggcaaagaagccttctttgaacttccagcccttggttgcagttctgccctggagaccacacaaaatagtctaagctcttcagttcacgtcagccctcccaaggtcaaaggacagcttgcctatctgtgttcgctgtgttctcattttttagggcaaaacgtcccaagccaagcttggagagacttcaagaaactctgtctagatatgcaggtgggaggtgactgggccctaaaggctctaactctatttttaggttacatagagcagggagaggcgtctttatctcctgcatataaacttttttgagggaacatgggctgagaagcagatattcaacatccttttcccaggaaaacacccctccggatatcctctctaattgccacaatatgagaaccccaaaagatcaaaaggctaacaggaacgtttccaggaggaatcaaataactaatgttgaagcctgatgcttcctgtgaaaccatacatctctcactgtcaccatattggcatatacttggcagatgacaatggccctcagagttgagcaactactgcacgtcagacactcatctgaacactttccatacataaactattaatacttccagtaaccttgagaagtagtaggcaagcttattgccatttttatgatggggaaattgaggcccaaagaggttgagtcacttgcttaagatcacataagtaagtagtagagctgggatttgaaccctggcactgtaacactgaactgtgatacagcttctcagagataagtcttgagatgttgctcaacgttggccccctctgaacaagctactacttggaagttatgaaaagccactcttctggctgtgaccatcgtttcatcctgtaagggggagattgggtcctagtattattcattccactctaatactacatcattgaatagctacattctctttgcagtctatttggtagccgagcaccagctttgtgatgagtgaaatcttaagtatagtgcctcctgaagagaggaataggcattcattcattcgttcattcaacaaatatattctgggtgtctaccattagccaggcactggggatatcatagtgatatttgtataaatggcccctggagtcagaccattaaatacttaaagtagaacaagcagtgggaaaaagtccaatgtttttctaagatgccctagatcatatctgaaaatccttctggtggcagagattgtggcactttaagatgacaaaaacagatacccattgcccaatcctacccagccttctcttcagtaccactgccctcgttgcttcatgctggagatttatgtgaatgagatcagcataggagatggaattggtcaaaaccacagcaaatccaatttcaatgaaagggcttgagtcatctgtcatataaggaaatgcatggcacagggcatctggctttctttgtggctgccaggatgccaagcggacccaacactcccttgaatgattttttgtgtctagtactcatttttttcacttgttgtacaagaggcatcttaagtcaaaatctaacccttagtacattgtaccacattgttgattactgcaacctttcagtcattattcaacaaatcatttcttgtactgcactattgattagttattataaaaccctgaattcaactgtacagtattggttctttttgccaaagggactctaaattagaaaataattttgatggctgggcgtggtggctcacgcctgtaatcccagcactttgggaggccgaggcaggcggatcacgaggtcaggagatcgagaccatcctggctaacacggtgaaaccccgtttctactaaaaatacaaaaaaaaaaaatgagccaggcatggtggcgggcgcctgtagtcccagctactcaggaggctgaggcaggagaatgttgtgaacctgggaggcggggcttgcagtgagccaagatcgcgccactgcactccagcctgggcgacagtgcatgactccgtctcaaaaaaaaaaaaaaaaagaaaataattttgtcaaatactattgtcacagctattaatggggcatcccaagatgaatagtttcttgctaccaaataccttttataaatattgcgtttagaattgagtctagagattcatcttgacttggggggaaaggtctattaaaaggactttatattccattttgctttggtctggtcttggcacgggagtgtggattttgctaaaaaaaccaaacagagccagctgttttcttccagagagccaccttgactatcagtgtgggtgtcagataacagcctttgtggtgagaagtttattgtatttacttgggcggtggtctctagtatttgcagtgcttcattggcatagtgtctcacttctgcaagagaagttatccacgaccatgggtcatttactgtctgtcaggcgagacatttataaaccaatgtcctttgtgttctgccctgagcaatgacccctcatgggactgagctttgatggagaaaggaaaaagtggtgtgttgtgtttggtcactttccgcttgagtggcagttacctggtaaaatttaaggtggaggagtatgcatgtcttgtgtttaagcaaagactggatgacccttattaggaatgttgcagaaggaattccagcattagataaaggttgaactagatgacctttgaggttgtttcagctgctgagtttttatgatgctttaaaatcccttaggagaaaagctgcagtgtagaccattggctgtgaatcccaagcttgaaattgttggaaaatgatgctcaaatcaaatcacattaaattcactttaaagtttagaaatatatgacttaacaatattttgtctgttgttggttggggtaaaggggagaataggaggaagattattgcaacataaaatacaacaaaccatgaaaacagcatcatacatcaaaattaaaatttttttctcaaaaaattaaaaggattgggaatgactgacctatatattgccttatttttctttttgtctcatttgtgagctcaacaactccagcgtattaattactgttgcctcctattgtcattttaatggcaccttatataaatagaggcagtgaagctagttgctactctcccaacacaccccattttttgcatttctgacgtagtgcagggacccttctccatttggttattggcctgcttgttacagaagtcagttaactattcttcaggtcagaagtgagatgttagcattctcacaatgaagaatatatggtattctccctcttatctactcactttctgtgtgtttttaaaataaaacctaagcatcttctttgttcatagcataatggaataaatattacagtctttgaacacattcttcgtgaaatcacttgcagcaatttctagtgtttggtttgtactagacatctcccactcacgtagacatgaaaataatacgaagcggaagaaactacaaatgaaaaaagaaaaccagaaagagtgtttacaaattcagagaagaatctaaactattcttgtgcttatgcattaagggcacatactatgcatgtgacatcatttaatgacattagaatgtgccattcggagacccgaggaaataagttaataagaatgtttacctgtgcatatatacagtgtgtatatatacatacatatgtacgtatacatacacactgtatatacaaacatatatataagctagttgtagagtctaggcttttgtgaaacttaaactcttaagatatgtggtcctaataccccataccacctctccccactccatatatacaaataacctttcttactctgttagcctttttgtctggttgaaggctgttgtgtctaaacatattatgacattttgttttaaacatttttttagaataaaataattaatgctagctgccctgaagatttgtgcatttaaaagtaaaataaaagtatataaatctagtttacatctgagatgtttcaaagagggactttaactatctaacaatttaaaaacttgcaaaatcccttaatgtccaagatggacacacccagctgtattctgggcctgctgcttgtctagaactattttcaaatgcttttggattcagtgaaacccgaaatgcatattgcctcaagccctttttccctctttaactttgagacccctgtgtatttggaaggaaatgaaatacatgtgtttctgatttatttacactcatcaaaatgttttgtaagagcatttgatgttctagaagcttttgtgaatttttgaaaataaacttttgcaaaccttcatcaccactctcactgccgctttccatgaaaaagtcatatttagctgagggtaaacaaattgaaatgcccaccagggttgagttcaattctttgtagcttaggcagagtgtcctgggggctccaggtggtaggcacccggctcccacgtttttgtgctggcgtaactgggctcagcaggttgcaatactcttctggttcttcttaacactggcccagctgttctttcttttggatgcaatagaaagaatttccaaatagatttaaactgaacagagaattgactcctgtaaccagaactttcactgaactctgtagaagaaaggcctttatccttatttgttatgtgaaataaaatgtcttaagtgggaataacttccatatctcacagtgccttttacttcagactttagagctgtgttaataattttaatcactatacctacagttcctttttctaaaaaaaatattaaggaatctgatatacagtaatcagaaacagttttgatcaatctctttcattgtggctggtggctctagccttttttgtaaagtaatttgtttatgcttacaattacaaagtgctctaatagccttattctataatgacccagacagtgcctctgagaagaagtctttgtgtggaagtcaaacagtttagtggagcataaagacggcagacattgccaaggccaggaaagccatttatcagtgcatggcctactatgcactgaaaatgaacttggatagaagctaccttaagtctacttccttctcacaggggtttggcttgagggaagcaggctttcagggttgcagtcatatcagtgcatcagtgggtcaccaggtaccatttgtgtggaggctctgataatgtcactgtcaccattcttgcaccctgtgacaacacagaggactggccaattacaaacccaggaaagctcctagtaattattcaaattcatggtacattcaggtataacttacaaactgaatgtaccacattcaggttccacaggtacctgaaaagcacgtgcatgcacacacacacacacacacacacacacacacacacactcactgagacttttgcctggatcttgcaaaaaagttaccctaaaaaataatatgtctacctttggtggtaactaacactgcagcacatttcgtaggaggtagtttttgttatcaagatatacttcccctctatctcataaaccttaagaaggtattagaaacaaattacattgcatagtttatatatccatatctccaaggatttctatatgtcaataaaatgccaatcatcagatttgtcctgatgtgaaagtcagggacaaaatgaccacctagcttctcagttgaggctacatggaattacgtatgaatatttcagataagatcagatctgatcataaactcttatttttgtagcatgcaagtgtgtggataatgtgtaaaaaggaagacataagtcaaatgtgtcacatctgagactctcttgcactgagattgaaaaggcattgcgtccatgaaacagcccttgtgccgtccaaaagcactgctcctttctcctcagttgcatcaaatttctgtggaactcataccattgccagattagggcaatcaacaggggcagagaacttcaaatgaaacttccgccacagtgcaagcatttgtcaccatattgtcggtgagccaaaatctttcccctttgtgctgatggctaaacaagaatactctcacaatctcccctgttgttctttttctaagtgtgccctgaaaaagttctgatgcaaaatagtcaaatcacggctgttacttgcttgccacctgtcctgacgacaagaggaaacatgggttgcacctactggacctaaagtcttcacttcttctccaaggattgcaggtgtacagctcactatatttaactatgcgggctgtcccagagggggcttgtgcatgcatttgcatggggcagaatgatcagctcttgcctccagtccatctggtgatagggacagtttcacattatatgtgtattttcgggaacattttgtattaagaggtgagagtggactttctgggcatggaattgtttgtttatggaaacaggcatacattgtgtctacaaagcaatagggaaaaggctttgcgggaaaacttcagtcccttcctgcttagggaacatgctgtgggaaccttttaagtttttctattcactattttactgttctaggtctgcattgagtgggagttaaattttaaatgctcatcgggtctttgcaaagccttttagtatacaattgctggtacagttgcttatacaattgtacagttgcacaacgattacttatgattgatgtgtatttagattggctttggctaggcaagagtggtatcacaaaaccctgctccagttttgaaaaaaaactactttattaatatattcctatcttgttgatattgtcatatttatacgttcatttcttgcaactaaagccttctggcacatccatttataaactattccaataacttagtataaagatctgctctacgtgatcacacatgtgggcatgcaaacactaataaaaggagaaactgaggcaaggaaatcatgcaaatttcctgaggtcaaattttgtattgtgatagtactgagaatacgtccttgaaacaggaattcgactccagtgactaaaacacttgctctctgtagcatctttgtgaaatgcaggggtgagatatatgcatatatatcatcttcattaagaggaaagtgagatatttatggtagctgctaatgttaatatcaattttcaacattaataataaaatgagcagaatgaagccaatagatccaggtcctgtatatgattaaatttatttattttcatttttaagtgaaaatgttaaatcaattgcatgatttcctttgaatttgtaataatgacattataaaacatatacatgtacatataccccattcatgtaattaaacagattcatcaaacatattgttgaaaaatcttggaaatgtgtgggacagaggattaattaactcagaagcatgtaaactctaaaaagtttgttaatctattttcattatacatatgctctccatgtatgatttgtgacagcttaaggacagatggccgagtaatttacaactctgacttcaattatataccgtgttgttcaaatgaaaatagctctcttgcagcatagatagagatgttagcaaccatttataagaagtgtttggaaattaggatgaaagacaaagcctgctttgtttgatttcatgcaaaaaaatttagaatgcctgttcataaaataatttccaaatattagtctttagttcttgacagtttcaaaattgtgcaagtgtaaaatggaattttaactgcttttcttttctctttcatgtagttcatagcagatatttcaacactgtcgctgctccagaaaatccttggatccagttcctccagattgagaaaggaatgacatactctttagggtaatcgtgtaggcagggatgaggagaatggttgaagagagaattctgtgttttgacttggaaaggcacccactccacccttgtattttcaaagtggctcttagatgtcgggcagtatgattctcattcaaagcctggaacaccaaagaagaaactctgcatcttgccacttaaacttactgttagcacttcggtactgatgtacagctttggttgaagcctctctctctctctctttctctctctctctctctctctctctctgtgtgtgtgtgtgtgtgtgtgtgtgtgtgtgtggtttgaaaattgtatcccccttcagactataacctagtcttttaatgtgcatgagaagggtaaaagtaaatatatgcccctatagagaaaaggaggtaatttatttattgcttttccatttttaatttgcccattctaaacaatgttccagaaggatttgtatgacttaatactttccagaaaatattctgtttttgtaggctaatggttcagtttacttctcatttcttcattgcctttcagataagtacttccacaggaacttagcattaaaatttgccttttcaaatgtaccatatggaattcccaaaggaaataatttttaaagtaccagtctcactcaatttggctgtagagctgagttctcttcctctcacaacccccttccccaatttaaaacattttcataaactcagaaacagaggagctaacaagaatctctggatccattaacattcagtcatgtagaatttctcagaatattcccatcttaaagaggatgtggagacaacatttgaatggatgacattatgtgtgtttcagaagccaggtgtaaagagcacttttccatacattttatatctgagttaccaatgcctcatcttccagagagcaggcagtaggcggcatgtgtgtcctgggacactgagcttgccttcctttactaagggctgtaactgccacatcaccatttggagtcatgacttgtaaagtactcagtcttatttgttgacaactgttgtgggcacctctcccttttaagtgttctaaaggaacaagttttgagaaattaggtcagttgaattttctaatatttttggaatgtaaattaactgtacaaaaagcttcaactgcagttgtaattgtagcttgttaaaaatgaaaaacagagatgtcagaattctattaggaaaaaataattatagtaatattttcctgctatattgaccctgctaattgtataaaagaaagtacattcaaaatttaacttatgtgtacgtgtgtgtgtgtgcatgtgcaggagagagagagaggtgttagagccaccagtttgctgaagtaataactttccttttcttcttttctataaccaagcataatatataaagagagctttgacataacatttaaagtctaaactccagccaatgtcaatattatatagcaaatattgactttaatcaaaaaggtctgactgatgttacagcttataagaacaaacaaaattgtaacacttatcattaaattaccactatagaaatatgtagatgataatctcagcccagtgaatgagctgattctcaatagataatggtcccattagtcagatattatcatttagcttatctatattacttagaaatagtttatatttaaataaccagaatagaagacttcataaatacacattaggttgtgggctatagatttcaacactatctatctatagataaagctataaatagatgaatattgaatatagtaatttaacacttaagtaattttatagtatcattaaaaggaatcacacttgagccattaattgtaaggatttgaaatgttagaaaaaacagttgtgaaattcacagagaaagacaggaagaacattctaaacatcatctattttggagatggaaaacaacatttgatttcatgtatatataatgtatcccatagtagggactcagtgtcagtaggctgagataacatacgagaaatctgaaagttctgactgctctgtgtgcttaggacctccacagggtaccagactttaccaacttcaggacttccactagtctgagtagccagggcacaccagtcacagctcagagagacacatccttaggtttgctgaaaacacctgtttctgagagcaatcatagtataatagctttgactcaataaagtgatcttccgtgagcaagaagatcagttggcagaaaaggaaaaggaaatgtggcacaaaaaacttggcactccactataagaaataactttacctttgttaattcatttagtcggtggattcttattttatttaatgagttataatccattactatcatcatttatttatttattgctaaaatttgaggtaattttagattcacacatagttgcaagaaagaatatacagaagtcctgtgtacttttatccagttttccacagtggtaatatcttgcgaaactatagtacaatacaatcttgttttttttttttttttttttttgatgcacaaattttcccagacttgaccagtgggagctgtttctagctggctcctatgtccttttgattatgaatcacttccttaatttctggaacaaaatacttcaggttcacctggtactttctctgcttcagccctggattcatctctcttagaagcctaatttcctttattggaaaatggtacttatagaacaagatatagaacaaaatggtacttatagaaaaggggataggtatacctttactaccggagtgccattatttctaggccatctcagcaaatagagctaggaaatatatacacgtacatgcacatacacatacatgaacacacatctatctctatttctatatctgttcatctgtatatacagcatattaaaatatcatgatgttataatgatctcaccaattccaataaaacaccacattccagtctttccccttttcttaccggtaactcccttctctaaaattgagaaatttagctcacatgatccacaatatacttagttatttagtcaatccaaatgtgctaacccctagcactgtgaaaaatcagttcaggtaagagtcatcaatggatcataaaagcagtgggtgaaagtttgaggagtaatgaaatatttacataatttctaagtatttccctacaaaatatttattaattgcaaggggaagaagtagcaaattggcagtggagaaacctggcagacaccaccttaagcaagtgaccaaagtgagcatcatcaggaatgagacatggagacctcctgtgcctcctgatgaaatgcactgaggggaacacaagatcacttttgtggcatttctgccaatagtacataatctggatttaactatgaggaaacatcagacaataaacccaaattgaggcacattctacaaaataagtgccccttttcttaaaaaaatgtcaagatagtgaaaaatagaactggagaagtgctccagggtaaaggaggctacagaaacatgaaaactaaatgcaaggcatgaatttagattggatcttggaccctttctttctttctttttttctataaagtatattattgagacagttggtgaaatctaaataaagtttgtaggttagataacagtagaatatcaacatcaatttcctgattttgataatcatattgtggttatgtaggagaatgttctttttttaggcgatacacaatgttgggtttacaggtagggggctatcatgactgccaattaacactacgtgaaagatatataggctattttaatgttcttacagcttttctggaagtctgaattttttttcaaaataaaaatgtttcaaaaaaacaaatgagaaatgttcccccgccacctcatcctcattctatgcattgacctttgtcatttcctggaccagtaattgggtcccttctaagtcacctgaaaccatcttgtttgcttgccctaactctagtactggctcagatgagcctgcctctgtacctctgtatcccatttctcctgttgatttctttcttctcctgacatcagaaaaccatttgaaggacagtatacacattatcctttccttgactctttttagcagctctccaatgaccatttgcctttagctgacccaagaaagtgatgcgctgctaaccataggtagtgtcctgtaattgcagatttcaactgttttcatatgcttagagtagcctaaggcaagtaacaatctgtgctaggagaagagcaaagactactgtaattcactttactttttaaatttacctctggaaaagaaagaacaagagagccaataaaacttgagggatttgttaatttgttaatttggtatttgatttgcccttacagctgtacctcaccttttagatatttttctactttgggaaaactttagcacactagtcaattatatattattttaacttctcgaggtgagcttctcatttaaagggaaactgagatcaattcttttgtaaaatcagtcatcacttcctactcttgttaaaggaatttttttctgtgttgatatgtcttcagttgtgaagtgcacatatatgttatagaaattctcatggcgttcctggtgttcagccttagacctttgacaaactcctggtaacatggtctcttgaaaggcagagtggaaattggggctaggcatgatgttatggcaatcatctggctcaggaaagcttctggaactagggagagaagtgccttcccatttacattttggattcactccagttcacattttggattcatttcagttcattaatttttttcataagcactataatactttaaaataataaatatttctaaaagaaacaatccgttctcaactcacttaaaccaatgtattcaaaaagccatatgaatgttattttcattcagaaaattacacatctgggtatggaatttgcttcaacttcaccatgttgagtataagtggtccctatttttttttaataaagggcttttctgtagttatctgagaacattcatacaaatttctttcaggtcattaaagtaaaaattttgatttaatgcggataagttattttaaagattttccttaagaaacatcttctgttttcctactgtgctcataaagttgataatcataacttaagttatattgatacaaattttgtcccagattccagatctgaaatatcatcaatcataaagatttataaacaagccagtaaaaataagcccatctgttttctactccaagggtgctaatggaggtgcacaccagtgtgatgtccaggacattttgtctgcctccttagttaatgagaaaatctgtggtagcccagtgctggctttggtaggttgagggagtggactgccatgcatgaccccatgacccttcccattccattgaagtttttcttcacccatgatgacatgaggcagtgtgttatcattaaaggaacactgagagcatctatcaggcaccttttttgttcctatgcaatggggcctttatgtacaaaaacaaagtataggtcaacacagctacagcaactggctaatcagtaaatgagtagattgtgcttgtgttgacatttctgttgtcaacctagtcatttgtttgtttaaatgatggttgttaacatatcaaaactaagcttgagaaagtgataaattggatgcgtgtttgtccaatggtttctgatgcaacatgatattttagcaaaaaccttctgatgtgcgcagattctccgatgaggttcaaggagtaaataaattattctgagggtaggagtactcccaccacatggcaacctgctttgaggcttctagcaccctcatcaccagctttccaaaccaaagaatgaggcttctggaaaacccacccatattttactaagtatcaccagatggttgtaacgattattaaaacaaaattggaaatggttttcctctgttgttgggaatgaagtgacataagtggctctcttggaatggctaaaatgataagcagcaagtgggtagtcaggagtttctggaggtgccctgttgcccatttgaatcttagcttaaccatgtaatcctgcgactttgggcaagtcccttcccctcttggtgccctggtttccttatctgtaaaaaagggtggttgtgcttatcagacaggttaatatgtgaaggggctgagaagagtgcctggcatgtggcaatacctgtgcctacttcatggggaagtcaggagcattagatgacttcatgtgtgtcaattatccaggatggtgtctgactcatattgagcacccaagaaatgttatatcgctactgttatcattattgtcattctcaggtcatctgtgggcagatttgccagccttttccattgaagagcagatactcaatatatggtagctattgttaatattatataatattatgcctggcacataagtgctaaaaaatgtcagtgtcactactatttaaaattgttatcacatcatgaaaatgtccaggaatcttccatttggttgaattaaaacattttccaagttaggtgacttggcaagtgttgccttggggtgatttttgcagactgttcataactccagtctttcattcccatcccatgccttcctcttttgatatgaattaattctatgcgttgagatttcctaagtctggtggcaattcttgtaaatttgctccttttttttttcttgcttgcaatgtcttatatagttaagctgcaattccccacatcaccagcaggtgctgaggactaacacaaaatatgtttcattctcgaattttttaagattgggaagcttggaatttagggaaaaaatagtgttatacttaggaaatgagaatattggaaattatataaaataagttggactacaacaagtatatcctataggtatggtaccctgactattcttgagagagaattgaaagcttaagaccatcctgtttttgtctgtttaatcatttacatttagcacatgtttgggtggctctgccaggtgttcagctgagtgctgtgggaccaatgatgaggaaaaaatggaaaacagacattaactttgccctggctttttctcttttttaggcatacagacaggaaaaatggccagtgaattgttcattaagaaaaatataacttctgtttattaaaatggactttattaaaatatatcagaaaaatgaaagcaaaaaatatatggtaaaagtatgaacataacattcaaatgcatcttgggatgatgaggtagaggcaaacacaagtcttccccatcccccatctgacacagtcttcacaaagcactgtatttgccaggaggactgaatattcgccttcacaaaagaaggcaatgaaatttagtactgatccaaataaaatgaaatcccatgttccagaattctgaatatttattttaggtacaaggtaaagggcaggttggaaaaatgtggcttgtttatcatcatttcatagaagatacagtaggaaaacattcagcattatggaacacgagatttcatcttcaggaaagttgccccgagttctactgaggcaagaggaattcaaatatgcattcatttgtgcatgactatttattataggtaatgcatgaagtagaaggaggagcatgggacctctctgagcctcagtgtcttcatctgtgtaatggggttgttgtgaggccctagggcatagtgtaggtgaaaacgtttgtagactattaagcagcatacaaatgtggaagatggttaaggggttaacgttttcccaaatattgaatttatgtttgtaaatgtatacagcatctatctgtctatatgttaagttggaagtatttgtatttttattaccaggaatcagatatttgactattttaacagctacacaagtcagctggatttcctcagcttttatttttatgtatttgtttattttagaatatttgtatatacatatgagaagaataagtattgatagaagattaattatcttttttttaaaaaaaaagcaaaatattgaactagctccttcctgtcttatttgttcaagtgttgttaacattctttaatgggggtttttaatcagttcatcatcatcaccaaaagtacatcactgaaatctagatttagtaagccctactaagacagaacatacaaattgatatttgtatgttttcttgattcccattttgtgcaaggctaacttaagatgccagtgactcacaaaacatattgtttaaacatgttcagattgctaacagaccgtactgttatgccttttagattccaataaaccatatgaaaatgctaattattgagtctacattaatttgtataaattatgcaaattgagtagcaattaagtattactgtagttgaggtggattccatgccattttttaacttaatgttggactgacacagactccattcactaaaacaaattgttttattgttgagtgtttacaaagcaattgctgatggtaattggttgtagatgacactattgtgcatttcagtaagatttatttaaccatatgcaccacaaccaaaacacacaaacacaggaagaatggtcaaggaatgactttatgacagttcattcagaaaaaacagtttctgtccatgaaaataggcattctttaagaaagttattttagaaacagacaaataagataaaggaaatcacttggagagatgtagttaaagaacaattgaaagaagtagcatttagcaagaagtcaaggcatcacattcagtgttttaagcaggatattgggaagtaattataatttgagctgcttccacagtatatggatgagaaattcagccctgatttgttcaaactaattgtgtatacttttgccatggtgcacaatgattctatccaaattacttagacataaacaaatattgtaaccaaattgtgagcctggatgtgtgtgtatgtgtgtgtgtgtgtgtatgtatttaacagtcggtcaaacagtgtcttcatactttatcaaacattaattagctaagttatgaagtgttggcatcttgggagcagcttagccaatttttagtgatgtttcatagaaggctaattctggaagagatcatctcaatccattatgtggaaaccaggaatttgcagtcacgctctatcaccactgaacagaactcaaggtcaattatcttctgtctctgggattcagagtggcttttgcaaatgtaaaggttatgcacattgatgcaataattatgaaaggaaaacaaatctttcctttcaccaaaaagtgttgtgttaaagcgtgcataaattatgattcacaaatatagtaatggctttaaggttgaaatatggtatccaggtgattagtagattgtgttaacctttgattattatttttttttttgagacggagtcttgctctgttgcccaggctggagtgcagtggtgcgaccttggcttaatgcaagctgtgactcccgggttcacgacattctcctgcctcagcctcccgagtagctgggactacaggcacccaccaccaagcccggctaattttttgtatttttagtagagatggggttgcaccgtgttagccaggatggtcttgatctcctgacctcgtgatccgcctgcatcggcctcccaaagtgctgggattacaggcatgagccactgcacctggcccgataatttgttttatgttagtttctctaatcggcggtggatttggagaatctagattgatgacaagtgatcttcctgaaaattgaaccaaaataaagagaatatgttatgaaatttctgccagggtcatatttatgccattattctaataagaactttaataaggcaaatctagaaattggttttactggcttcataaatttgtctttcatagtctccaactcaattttcatttgctttgacttaaaatatatcagcattctgaaaattttgaagagtgaatcattaaattcaatatttattacttaatatcttaataataaatgttaaatctcttaatggactgtatttcaaatacagctcactaagtcctctcgttttcttttaaaaaccatacttcaatgtaattcccattgccacttttgccagacatcctatttccctggcaaatctattgaggaaaaatgaagttttaaagcaaggtctgtgcttggaaaatctaattcactctaactcactaggtcacttagaaccaaatgattcaaatagaattctacctatagcaaaacaatggaagctgtacatagggatgtgagtgaaagccttgctgcttttctcagatagggtgattggatgcaacagtggcccagcacttagccacaagtctgaagacccctgcctaggaccagcttcatggctctcggcaagctgtcaaactctgtgcctgagtgtcctcatctgtgactaccatgaagatcaaatgatacacataggtgaaagttctttggaatatgaaaaggatgtaaaaatgacaagaattcagacttagttaatagagcaaggcatttaaaagttggcatcacatgtttattttggctcaaactgtggcactgcatagtctgcatttgaattccagaactatccatgttgagctatgcaaccatggacatgtcacatagttttgtaggccccaattcccacagctgtgaaatcgtgaaaataacactatccacctcataaggttgttgtaaaggttgaataaagtaatgtctggcacaaaaaaagactcttaataaaggttagatgttactactgggatacattgtattaatgatgacagaaagaaaaaccactattcttattttgcaagtaatagaagatgtctgactaagctttatttctttttgtattcattatcttccttccagaagttttgatcctcaaaactttattgaattgtcctgagtatcccacatttgtccatgtagttttgtttcatttctaaatcacatatccaatcttgttacctgcttgctcaatagaataggatggctcctcaaatgacaccctgagctgtcgtataaggaaatgataaaaggtgtggctttgtggtcagagagacatggatttgaatgctaactcttctccttactcatcatgtggcctgggtaaagttacttaaattctccatgcctcaatttcatcatttggaaaatggaggaaatcatagcacctaagtcatagggtacttgactgtgaggtaatttacacaaggacttggcgaataatagtcactcaatatgagagctgctaccaccatcattgtggttattatgatgtgattattatgattattaaaaattaaatccaaactcttgaggctgacatttagaagccctctataatgcgatctacctttattcttttcattccttacaaaacagttttttttggtattagtatggcccaaatattgcatgaggcatacttatattagctaatcattcactatgtgtctgaaattcaaatttaactgggcgtcctgtgttttcattgactaaatctgtccaccctactcacacatctatacctcccaccagtacctccaccttacttcctgccaggggacagaaagacttccagaaaggcagagtttcctaaatttacccatttctgaagtctctactcaaggcggcattcaggccctgtgccgggcattgtaacaagaaatattttttattatttttctttatttatttttattaacatttgttaattcttacttcccaaatatgtagtgtatagaagattggtgggcctactcactttccccatggctatagccttagttaccccaatcactatcctgctctgcagccccctaactgtcatggtggttctctgccctggcttcatcgtagctagtggcaacagattttatgatggtgtgactcagcattggcatgttgtacaaagctcctctaggcaatgccgatgtgcagccagggtgctgaataattgctaggcttctgcttcaggctgttccttctgcctagagtgcccccctcattcccattcccacattttttctttaagaattcgcactttgggagaccaaggcaggcggatcaccaggtcaagagattgagaccatctggccaacatggtgaaaccccgtatctactaaaaatacaaaaattagccgggcatggtggtgcgcccctgctactcgggaggctgaggcaagagaatcgcttgaacccaggaggtggaggttgcagtgggccaaagattgtaccactacactccagcctggtgacaagagcaagactctgtctcaaaaaaaaaaaaaagaattcgaccatccatttagaccctaaaccatatcactttattcatcttccccagactcaacactatctgccttccatcagcaggcaatcttgtgcctggttgtgggtcctgcaagattgggaagcctggagggctgggggtgcctggttggattcagtgtcccttgccccagttcccagcacagtcccctcagcattgctgacaagccattgatagctgcccaattgaaatgactgcgatatagaggcccaaactttctatgaagctaatagagacagaaactcattataacttttctaagtacttgtttatgaagaaacctatgcagatatctagtaatcattttatcccaaattgagataactgtcaactacctgtgttgaaactttaataaagagaataataaatatcttcatagaaaacattaactattatcaagctttgatttttagttttacgttgctatcctaagtccggtaaggttatttcaaaacccatagaggagacattgaagtggcttaattatttaattagcagtagtgaactttgggaattttggtctctgtatgtgactcctagacacccattgtgatatctgcatttttgcttaaaatagattaataagccaataggtttttttttagaaaatcttttcccatttcagtgaacagtgaaatctgaatctatagcttgcaactgaaactatttttccccaaagccattgagggcttttactcagtctgttgtaaacaatttattggtaaagtcttagaatatttgcattttaattaaagaaaattttaattaaattctaaactttgctcagaaaaggcaagtttgggcagctaatgcatggtaagatgcctattcagagatgacttaaacttcaggaattctgtgtttggtgccatttaaatagcaaaggaatgtgtgtctttcttgcttaaaaatatttcccagctgcctttggggaccctccccaggagcatacaagaggtttggaaaagctacagactggttagatgttgagatgttttagacagacagagatggatacaacaaatctgattgtcgtagaggtggggaaagggttggtgaaagatgttgcttaggagagaggtacatattaataggtacaaacatttactaaacaccttctatgtgctgggcaccaagttaccctgaattcaaagatgagttttgccaagatgatttacgtggtccaggtataagttgatgagagagcctgctctgtgatgggagctgtgggaatggaaaggaaaggaggagaaatttgtttctaaattttgattttttaagttttttttttttctttctagctaatgcttatataattggagcctctcggatcctgccgttatgctctagggcatatagtttgcagtgtatgtttttgtttatttccaggaccttttaccgagatccattcactgtcaatcccctggctgcatgtgttacttttcctccctgctgcttagctcagggcttcccatagagctgcttcgttttgggaggtcaggataatgatgctgcccctttgttctgtcctcctgaaatgaagcgctgatagcagaaggtaaaaggcagtgggttagggagaagcagaaatggccccatcagtcgcatcaagattaaacgattctcccatctaatggtaggaaatgaggcgttttctgcgagccaaaccctgatagctgtgtccttgtggtgccgcacaggacgtgcgggggtgtaggtactttgtaatgaagcaagttaagaaatagactcagacgtgggccatccttcccctcccctcaagggcagacttcagtgtcattagaccaaccttctacgtagtatcaaaacctcttattcagaaacactgacgggtatttgactgaattcaagaaaatgtactgtttctaatcttgtaactgtttattaaggaataaaatcaagcaaaattatgaggacatgtattggatgtttccctgtgtgtaaggcattgtgcctaatacagttgttctcaggtataggtgagcattagagtcactggactggtagaagcgtgcagattgctgggcctcaccctagagtctctgcttcagtgtgtctggcgtgggacttgagaagctccctttctgacaagcttctaggtgaaggccatgctgccggtccctggaccgcacttgaagtatgaggctgaaggtcaacttacgaggtccatgctttcaaaactttaatgtacacagaaatcgttcaggaattttgtagaaatacagattatgcctcagaatatctggcgaagcactgactaaatttacctgaaagtttaagcaaagcctattgatttatttgcctgaaaattttgatttatcaaaaacagtatttaaaaagaaaataagcctttgatcacaaatagctactgtttcttaaatccttactatgtgcaaggtcttgtgccaagtgctttgcatgtcttgtcttatttagtcattacactaaccttattaaagtgaagacaatccccgttttacagatgagaaaactgagggctcagagagattactcaagtcagacagctaagtaaatgacagattccagatctgaacctaggtgtggctgattttgaagccccgtgacttttatactacactgtttctcttaatagctacccaagatagtttccactctgaagacattaatttgatatttaaactgtctaccctactgtcagttatgttccttgctgatccttctttgacttgtcctctgctgagcagagtatttatggctagacccagataagcagacaggctctgctaaccagaaattaaaaaaaattttttttcattaagcatgtgatgggttatagagttgtaatttttcttacattttgggcaagctttaaatgtagtatgccctatgagagttacaggaagacaaagtaatctaattcattaagcacttattatgtaccttgtgctttaatatcttttttatcttgtaactctcttaaccatcctgaaggtaggaattaccctccccattttatggatgatattagagaagtttactaacttgtttagcatcatacagctaaacagagacttgaattgtgattggaagctggctacgttagatttctcagccatgctattttcgttagatcatagtgcctctcggtttcctcatctgtaaaatgaggagactgatactcattatacaggcaaataataatgtctgacattgattaggtgttcagcacatggtagctatttattatttttatgagaatcaacaagaactggaagcaacatagatccacaacattgtacaccctcatttctctttctcttgctattctctcctctttctgttgtcctctcccctcttccctttccccacccaacattctctaagattgaactatcttttttttttaaaaaaataaaacattgaactagctccttcctgtcttatttgttcaagtgttaacattctttaatgggggtttttagtcagttccatcatcatcaccaaaagcacaccattgaaatctagatttagtaagccctactaagccctacttaggctgcagtttggacacagggattttcaggtcagtagtgttcaccttgaccctcacaattacaaagaggagtgccattagattcccattaattaagggtaaatgctacctgtcactttgaaagttttggtcttagagtatgtctgtatctctgctttagaaagacacgatttaagttgctagatacaagatgtcatttcttgtcttttctcttagccctaaacatcagcttgctttaattagaaataacagtaaggcatctgctgaaagtatgtgcacttccattaatctagggttactcaagagaatggcaaaggggtttctatattacatttgctaataaagagtataaacagtatttcaagatgaggactaaaatgaaatacctaaaaccttaccaggtccagctggttcatatttacattgccagaaggagggattagagaagcactgcaaaagcacaacaccttctgcattcttaaaattaaagggacaaattgttatctgaaatgagctgcaggccagagggggaaagataaccatatcagcaggaacaaaggttgtggctgaccagctaaaaagtgaccttttttttttttttttcatgttctcagaatctaaaaatggaatcccattaaaatgcattaaaaataggaaaaaaatataatataaaaagccagtatagtcgcagatgctaaatttacacttcccacaacagggattgtgccttagtgtcattcccatcaacccatcaactgagcttccccctaagcagacaccacttcctgggagtaaatgaagcatttttgggagctgctctcccagttggtctcaggccactagggtcccattcagttagttattacttcaggacacttactggttccctagtggcctcaaataaatgattgcagctcctaaaaatcctgacttccagaagtagcttgtgcatgaggagaatgtgcaaaactcacgcaatgagataattctgaggcttccagaatcctgttacatccagtataaagctgtgaagcagccacagttggtgtctttcgttagtaaaaatcatggacatccttcaggaaagcaaaactaccctctcactgctagtttccttcttcatagccaagacgcgagaaaaaataaatgtctaaaaattagagatctttcagctacgccagatgcctttgaaaagaaacaactcagtcattcaaacagcctgattttatgaggtgacattttagattatgatatgacattgcagatttgacatgattgtgctaattgtgagaaaatatgctactttgatcaaactagaatgaaggaaataaaaaggcactgtggctcaacttgtaataaagagcagctcatcctcacagctttgtgattgttgctatagttatctattcaacatgggatgcacaatacagttaacgtttcattaccagtagcctgttgcgtgcttattgttaaaaggaatttaacatacaagtttttgtatgttttgttcgcctaattctgattcctcgtgctgactggcatgagacagggagctggattgtattaaactggttttattgtgatgtgactatgatggatgtgacaagggcctctattattcgctggggagtgtggccattaatgaagccattagctgagctaaggcaagtgaagaaaatagggaaattaccactattctgaagccattaagttgtaatccaccactttctctccttactcaaaaaggcatcttctttttaaggcctccctgactgtcctttaaagattcattaattcattaactttccaaggagatgggggtggatagcatagttgaaattttaatcagttcagtgtatcatattattaacattatggcagtgtctgtgctcattgctggaccacatcaggttaattttaaacaaaccacattacagcagatgtctttctgttctatgcataacagaagagcttccatttgtagagtactttagatttcaccatgctcttttatgtttggttgatacccagggcaggcactatgtacctctgttatacagatgagtgaactgaggcttagtgaggctaaaataacctgagggatgaagatcagccagccactagataggcagaagtgggtttcacccttaaattctcactgaacctttgtattaggaatcatgcttttcccatgtatagtctctgctggaaaaaagaaagcctctggtgagcacaaatcttttgaaaatgaataacttgtgtttattctgtattaaatgtttaaaaatatttatttagctaatcagggatttgcatcttttaaaaacaatggcggtgtgctctgtgcaagtcatatatgtgatatactaccctgtgggtggtttcagtttacttataaaacgtttagctcagtcaagttgggtgatgtctactacttggcaaagcagagtgttcttaaagacacaagctttggctctacagcccttagcgaaccaacatttcccaagcagaagttaggacagttttttcttgaaagggatagtgaggtcaattctatgctcaatccttgccatgctaagaaaatttgggacccagaaccagtgccttagcacatccccaaattgatgcctcttctaacctatttgtgtagatatgttgcacatataattgttgctacctattgcaaggtccaaatgggtaaaggatacacattttgatcttctatactaggatattcttgagacctcctaaaagggagcatgaagaactgaggcttggctggctgctgggcagaccactttgcttagcagccatccatgcagacaggtgcccacaggctgaagggctgtcaggggaaggcagtcacagcaaggaaggaagtgggataggaactgaaacaaagattatttctcctcatatatttatgagttcctctaggtgggctagagcctagagcgaggagaaactcggtatgtattgttaaacagaatggattaaaaggaaggggactgtggcttaagaattcattgagcagtctatcttttgggtcatccccgtcttcatcacaagtaagtccacacctggaaatggaacttttccctccaaaccatagagttgatcaccagggggagagctgtaatgaaatctgtttctgaaaccagttggccttactgcttctgtgtgagttggtgttagcaaatggttgcatgaaaccttcctgatgacttaccatcctctagagggcagagccaggactggatccgggcctcctaaattgtagaccctggtattcaaaagggggtccatggaacagcagcatcgacctctcttggtataacttgttggaaatgcccaatgtcaggtgccagccaaacttcctgaatctgagtctgcattgtcaaaagatccccagggaatgcatatgcacaataaagactaaagagccctgctgataggcttggttcattgaaatgtgaatcttatgtgcaatgactaaagattgtgttcttttgccttacttttacaaaagaagaagggaactgatcttgattggaccccctaccctgtgccagtaactgaatgtgcctggcatcctatatttctgcttgttcaaccttcacaactaccctgggagataagcactgtcttcctaatcttatagacaaggaattctaagctgaaaaacaaagtgacttgcccaaggccacagggtaattgtcaaggctggggtttgaaccctagtttgtgtgatttcaaagccttccgcatgacagcatgctgtagtagaaagcacagagagaaaatctggagatgtaattgcctagttcctcggggaacatctctagaggattgattttattattgttgtttaacaaccctaattatttgagtatattttttgtagtggcttacagcatctcttgataaacatgcaagaattgatatttggcagtattatgaaaaataacattggtctgtaacagtgttttaagtttagatacttttgtttaatgatctgcacgtcttactttcaactttttattaacagggttaaagtaagtgaacaactcttctgctcctaccatccatatcacttatttatttttgtccctccatgttctgtgaaggcagaagtcttttaagcctcaacagctaattacctcccctgggagaaagctgggaagacaagaaacatcgaaaaggtcaactcagtttaagctggtgatttgccacaatgtgaggtgaggtggtcactttcgaacttggagtgaatggtcactaagcggggaccttgccaggcagcaagataaggaacctcccagggccacccatttgcctcaggccttgtgttttatttcatagcctgctcgaattcattatatggttacatttttcccaaacaaaatactcaccgcttaaatataatccagtcctttccaagttgaaataattttgggatttgccatttgaattacccacaagacatctttcctatatacccatgactgtttcttaaaagaatcccagctgggaaatgatttgctgccccaaggaaacaagcaggtttacatatccccatccccaccctgctttcactctctctctctctctctgtctctgatttcttcaacttttccactagggccaactgagaatcctcccaatgtgtgagtgtgcacacatgtgtctcagtttgcctctgtcttagggattggggctgctgtaaagcagccttataatgggcagattttcctacatgttgattgttaatgagattaatattttctcccttgttatgtagggcaattctgtattcacaagctgtcatctttttctttcttactgtggggctttctcaactgtcatgccatcaggctcatgagcctttcatgagaaagacatgggcctcttatgagtccactgagctctgtccacatgaacagccagtccagtcactggcaggatctgttggtactgtgttacgatcaccacagtcatgagtaaatttgagaggagatgctgtgaggctatgcaaatatcccattgtttcttagagcttcacccactaattttagcatccattgatgaaagttgcctgcaggaattattactatggtgttctaatgatgattttctatttccctccttccatcaacctttactaatttcttctgtgaagaatcccttcttctatttatgcattattcaatttgtttttttataagttgggaatcatggatatttattttattctatgagttataatcaaatactgttgttatttattttgttgctgaaattgttctagctgtagctaggggttttctacccccttcatttctggttgaggaacaggctggagaggggaatgccttgcccaagatcatgcctttggagacagcaccagggttagaacacagatctctttttgaactcacagttcaggcctgtctccattatactgtgccactttatgaaacactgagaagtatctaggtacactgtctcactttgctgtgctttttgtttatcttttgattaatacagttttgattgtccttcagagttgggtacaggaggaaattttgggtgtcagcctgctgtgttggaaagcctttttgtcacagacaaataacttcactagcttgatctactgtagagtggaatttaaaataagctggatgccttttgtatcccttttaggttgttatccgataataagacagcataggtagggtgatcatgcacactggtttgtcttgagtagtcctacttagtgtctgtttttcaggtgtaatcatcagtatagtaccttttccccctcaaaagtgtgcatattttgatgatcagttatatagtcaccccagtccactggttttcaaacttttgctccacatcagagttacctggagggcttaaataaattaaaaaaaaaagagtcacctcgagggcttgttaaactacagacagctggatcccaccccccaaatttgtgattcactgggtctggggtggggcttgagaatgagcgtttctaacacgctctaaggtgctgcaggtgctgcgtgattaatgtgttgattaacatcaataaatttcttaatattgtaatattttacaccttgacatgatgctatggaatagatttatattaaaaactgcttactttttctacctagtaaattatgtttatagagatgtagtgactgacacaaaggtaagatagtagtaatagcactgctaattatattgctgtacataaaaaatgacatcactattatccagcactgttaatagtcctaaatggagttggatatagtaaccttttatttgaatataccctctaaatcttgctgaatctttttcttccctacagattttaaattttgcatagactccatagtttttatttgaagagaaatggaactggtaggggagccagcataattttccactctttatggcactgactttgggattgacacctgcgcaggtagaggacctttttatctgataggctaagggcataaactgacctcatgacttactctttcatataaaggagacacaaaagatgcatgtgtgcatgcacacacactaccaactgtgatgatgacaacaaatttcctttgtttgctttttcttggtaactttttggtgactgtcatatgctttctttctgcatcacttccccatcgtagtagaggattatgtatgaagaacacaatgtaagaactgaatttgagacccagtgtgtatcattgtatcatgctctgtttccacattgatatttccctgacatttcattaatattgtttcattaatactgcttcaatagtattataagcacagctcattttcttctttgtctatgctggagagaatctcttggatgggtacatcaatggttctaattatgtaatcaatagtaaaccaagtcttgaggccctgtgcctcagtgtttccttctctgcaggccagtatatttagtgtttttgtagtattgggtttagatgtatgatactgctttgtatttgctgtggccatatgcaaaaaagatattactactttagcactgattgggtctcagttatttgtgtgttatcatgcatgtatttaattgagcagctactacatgcaaggagctgtgagaaatgaacatgaggccaagatattgaccttgccctcaaggaatttacagtcttgtcagagagataatccatacccacaaacaccgtaaaaagtagacagaattaagaagtatgagagctacacagagaacatgacgggaattcaaagaaagtactactcctttctttcagtgaagggtccagagtggctctgaggttcattttgaacatgacgggaattcaaagaaagtactacacctttcttgcagtgaagggtccagagtggctctgaggttcattttgaacatgacgggaattcaaagaaagtactacacctttcttgcagtgaagggtccagagtggctctgaggttcattttgtacatgaagagatgagaaaggacaatctaagtggaagatacaggagaaacacggaaacaaacaaaagaatatccagggaactgtttgcagatccctttgtctggttgcatgacacagaatgtagcagaaagccatgaactagctgaaagtaagaaggatttggctggctgcagacaggcagtaccaaaatgtaagggcatactaattcactgtgggccagttactatgctagggatcgtatataccttctctcatttcatcctcaaaatttctctgaggaagggagtgcttttattctttccttgtattaaggcctatgaatatatttcaggagaagagcttccaaaatacttccaataaatatgtgggatggttaagcaatggcacaacaaatttagttgccgtgacctaggtctgtccaaaggcccctgtacaattcagaagctctaaagagagaaatatcaacttcccaagtgtccaggtttaataacatttgaacaaagaaaaagtccttcctaggagacctccatttcacctggaggtatttcctttctattagttctacctgtctatctacgtgtgtaccaagaagagggtcactttttccccttcatcctgcacctatcactctccactgctcataccgctaagctctttcatcatccgacattgacttgtaatttaacagaggccatgtgctaagcaggacattgcagtattggctggccagtttgactcagctgtcttcccactgcaagtcaattgtttttgcctaaaattatttcagcaagctttgtgctgtatctgtgtcacacttttggccagtttgttaatgtaagtgctccttggtagtaggagtaagatcaattcctgctttacctacctatggcccttggacaataccctctacccagtgggtttcaccaacagacactttgtggtgggcatattggcaaaaatgtttgactcccaaccactacttcccaaggttttgccatgcatagagctctccttatttgcacactggggctttctgtaactgcaatgtccatccatgtctaaggatgcagccaaataaagaagctgcttcccttttattttattttattttattatttttttgagacagagttttactctgttgctcaggctggagtgcagtggtgcaatcttggctcactgcagcctccgcctcccgagttcaagcgattctcctgcctcagcctcctgagtagctggaattacaggcatgtgccaccacaccaggctaatttttgtatttttactagagatagggtttcaccatgttggctaggctggtctcgaactcctgacctcaagtgatccacccacctcagcctcccaaagtgctgggattacaggcgtcagccaccgcacctggtctgcctcccatttactttaaaacatctgttttcgtcttccagtgtaggcatggtcataaggtgggaatacctttaatagttaaaatggattctgaacaattggctcatgaaattaaaagaagataaaaatacaatctttttggtatgtgtgccgtaatatatactggctagatacatctttaatcatttttaaagtattgaaatatcatccgtcatgaaaataactctgcattgctataaaatatttactttttatgatgtttttgttttagttaaaaagattcataggctaaaaggaactttaaaggtcatcagatttgttctcataatctaggaatcggccattctaggcgagtgaaaatgtagtttgcttctaacagtgtcctgaaaaataatttttcaaccttgaggtggggctatgtcaactatttccgcatcccattccttgcttggaaatagcagagactcaacaaatattcactgaaaaagcgaatgagccttaaaggaaatgcatttaattgggtagaaagcaaattctgaacacatatttgtagagtgaatgcgtggaagaaggaatggacagacaagacactaggaaattttcggatatagctaacctgattttctcatgttacagatgaaatcagtttcttcttattcagtttgcacagtgtaagtgagtttcctcaactagtcatcataccctctctatttgaaggaagttattaattcttccctcagtcccgtctcttctggctgagtaatcatagcctcgtttacctttcctcataggttcatctttccaagcctgtgagagtctctgtggctctctgatccccaaatacatcataatcctctctccgttttagagcctaggcctagatatgccaatgtgagatttacagagggattagtgagcattttgtatctaaacctggatgatgacaatcacagacttcattagtgcataaagaaaaccataagacaataggggttttgtgggatttgtggtgagtttttttcaaaattatgtttgaccactctttgctcttctttcccccagttgctatttctggaactcacagttgtgattagacagcatcagaaaaggaggctgctacctttcactcttggttattaaaaacaatatgtctaatagtttattatacattttcaaatagcttcctctaaaaactggagaaagatttctcccgccccatacaattctgtggctcagagattgtcttttagctagaaatattgatttgctgttgtttagcccccagtggattgcttcttatctctaagactggatttttgttagaatgagagttgacagaattcagatttagtcaagtgaggtgtgtcagagttggtaaaatgttaaagtttgagaacaaattggatattaactcaggaaattttgtgtgaattttgtcaaaagaagtgatttcaagaatcagggcctttgtggtgtatatttgcagagaataattatttaattgcagaagataattatttaaatgcctgagtctccttttgggggaggagaactgatttccacagatttgtttatacagattcagtcctaaggcaaacctgaaatgaaaaatcagtccaaatttttaacagagaattgcatcagatttggtacattcctatactggatgataattaatttttcttctttgtacttttttgaaatttctaattttgttttacagtggccctgcattacttttatacatgctcatatagcaagtaaaaaaagacacaagcatgtatcaaatatgacccctattttatcaaataaaaaaatcatatacaaatgctcccccatcaagctatgattttttgaccttacagtggtttgaaagtgataagcattcagtagaaaccatacttcaaattagtaattgaaatgcattttcagcttacaatattttcaacttatgatgggtttatcgaggggcatctgcgaatacgtatgtgcaggaaaaaaactagaaggaaatataccaaaatgtattgcgttaatggttattatcagtgcttgataagattacaggctgctttcatgtatttttcattcttctctatattgttacagtttaaagaacatgtatatgtgaatcagggtttcttaattttggcaccactgacatttgcagccaagtaactctttgttgtgaggggccatcctgattatcgtcctgagtttccctgacctagatacacactagataacagaaacacctattcctccataggtgtgacaaccaaaaatgtctttggacattgcctaatgtctcttgggagggggaaaaatcagccctgtttgagaaccactgatataaattaaacaagtgtttctttagtaagaaactttcaagccatatagaaataaaactaaggcttaaataactacaaataaggtaagcaacaacatggctcccctacactactctcttctctttccattctcagaagaatgaaagtgtgggataatggcctggttgaagtttacagagttgtcaggcgatgaatgattttgataagccaccaattccctccccataaaataaatagactacataaaacaatatgggcatagagatttcttatatgtttaggcacacaattagcacttaatgtatgtttaataataagcaatgaaccccttaccaaattagtagtagaacttatggtccttctctactctaaactctcctccagatgctgggaagtgaaaaaaaaaaaaaaaaaaaaaaaaaaagaagaaagaaagaaaggaaaagagattgggcaaaagttgagttgttttctgcctgtgatccttggtatcacaactttaaaagttttgttctggagaccctgtgtattgcaaaggtcccattcaagaagaggacttcctctcttttggagagcacctgtgcagtaaagggttaacctagcaagcttggggtgttccaaccctgcatattccaaaaacagggccaatcaagggcttctgggagataacttctaggtccttggaatattctgcctgatgagagggtctttgtatacctggggagttgagccacaccagatagtttatgctaacaatgtgggttatggtagtgtccttgggccactgtgtatcagtttgacctctggaggggctggagactgagtaactaaaatcaggcacgtgggtgctccatgactactgactagtcctcaataaaaatctggacaccaatactccggagagctttcctggttggaaatattttgtacatattgtcacacatcattgcttggggaattaagcactgtctttactactctcctgggagaggaaaactagaagcttgtactcggtctctcatggaccccaccatgtgtacctttttcctttgctgattttaatctgtattctttcactgtaataaaccataaccatgagtatagcagtttctgtgacttgagtccttgtggcaaaacatacttgagggtggtcttgggaacccctgacacagccacatgtcctttaactcacagagagtgatggggaaggtcagggttgaagcgtggtatgaaaaccccaaagccttgcccagtgtgtgtcaactctgacttgatgtacagcttgaactggctattttgtcctctagtaggcagggtcttcacaagccaggtgaatgttggaacccaaggacctgactggggggaaagctgcacttcatacctggggttctatccacctggggaggatattggtcagtatccccttccctgagaatcagacacatgtgtgcatttgccagggtttcccttgccaggcaagcatagcagaggtatggcctttaattgcctttggttctcaaagtgttctgagcagtatacctgaaccactatgcttgttggtctgctcactttgctgttttgttttttgagtagagggaataggtttaatattacaaaacaagtcttggcttgacagcacagatagatgcctttgcatgaatgaaaaagtcaaatctgggagaatggagaatggaagaccttagagctttagatttttctctaacatgttttattcaaagcctgtttacctctggatatggaaatcggggacatcctttacttaaagcctctgcagtgataacagcctaagttagggccccagctccattctaggtatttgttgcttggtaggaagaaaatcaaaacagtaagaaatgagtggttttacccatagtagcttgatcctggtggtaagacagggaattgcaccaaagatctgacaaatggtggggatttaaaaaatgctcaggatggttctcccctctgtgtcagaacacattatttgaggctaaaaggagaggagactcttctttatgtactttttaaattgaactgtaactaatacacaataaaatatacgggtattcagttcagtgagttttgacatttgcttacatccaggtaactgctacccaaaacaagacacagaccaactctgtccaatagcaatataatacaagccacatctacaattttaagtttttttgcagccacattagaaaaggtaaaaagatacaggtgagattaattttaacactatattttcaatccagtgtatttgagtcatcatcatttcaacacataattaacatagaaattataattaaaattcacattttctttgtaacaagtctttgttacaagcatattttatagttacaacacatttcattcagatgccaatattaaaaaaattgtggtagaaaacacataacaaatgtactgtggccttctctgaaaggggtataaagtgctcaggctgtgaatgagtacaggcttctggaacagagagctgtccttgggtttcacttcccagtgactttgaatcctgaatccctgtggtcagaaggcagactcctagaacttgatctgaagactgaaactgtagctgagcctctatctgtgtcctcaactcattctttgctgtttgtttatttcttccgtgtccccagaccctaacttccttccactaatattactgagaatttgccaatgaaggacaatctacagagtgctcccaagagaaaggcattgtaatccctggaagaacttataagtcagtggaagacacttccagacacctttaaaaactatgacatagccctccgactagaggtagcctatggttagaggaagcttcctcaggttagaggaaggtacaacatggaagtatggctaggagttgaggatgcaaagaggagggtctaagaatgaatagagtgtgggttaactgtcagatggccagctctactatttataggctgtgtcaccttgagccaattgcttcatctctctcggcttctttgccattatctgcaaaacagggataatacacatatttaccagagctgtcaaatattaaacaaaaaagaatattaaacatttgttgcaatgactggctcatttgctcactcattcattcaacagatattttaaaacatcaaccatatgccaggtgctgggctagttgctgcggatacagcaataaagtgaggtaggcgtggtctgtattctcttaaagtttgacatccagttgaggagttaaattaacaatatttattatcatggggagaggcagacatgagaaaggccatggtgcatggtgcagctgaagaaaagtgagaggtttaaatcaagtttacctgtgcctggagggagacagggctggaggttagcagagggtgataaaactgaaggagttagatcgggtcccccatcacagtctcaatcctgctgaaaaaagtttggaaatcttcaataagttttccaatatttgggattattcaagtattttaataaaactagaatagactattgtttctcgtggggataatggaagacactccagtttaatttgcatttgccatgtcttaccatcctgatttcagactctttaagattagggagcatgctatccctgaatcttccacccaaactgcttttgcagtgtagcttagacttagattcttcttgactctctgcatatgttggccagaaccgggtctggcacagaatgaatgttcaatagatgtgtgttgaatggctggatgggagaatggatggatgcccaagacgctggcagagtcagtctggctattccaggctcctcccacaggtcaacccctgcagagaagaggcatctttccattcaacagaaggggccctggcctagaagttaagatgtctgggtcttagccctgtctctgccattcatttgctttgtgatcttgggcaagtcacttaactcctctgggcctgttgcccaacctgcaaaacgaatgggctttgacctctgggatcgcttctgtgtttcacatttcatgatcatctggctcccaaggttcattttctccagtctcctggcccctgacactcacatgttgtgtaagctgctcactagcctatattgtgtggaactgaactcaagccaattaaaaacagagtacattaacaagagtttcagtgaagatgtctgatcccattgttgttgcaaaggattagtgaaggggctgcgagaggattatggtctctgttgaaacctgtgtttaattattcgttcctttctctgtattttcatcatacacccactgagtacttgaccattgctgtgcatgaagaagaggaagaattaatcctcatctgacctctatttaaatgatacattttagttttgacatagagtgattccaagttctgccctgataaggccagtttccgccacctttttgatctgtaacacgttctgcttcctggtttgagcattggacttggatttgtcaagacatgtccctcagcaatatcagcatttcttttttgggacagttactgattaagctcacagcactggggagaaagaactgaacagctagaaagatgacagccaatgactataggtttcccatcccatttttgtcatctctcacaaaactaaaatcaccataagaaatctttctgcatatgtaagagtctgtattttcagccttggaatattcattcagtttttatgcatctgattatgcacataccaataaccctctaatttatggatgcttgctattaggttttgtttaaatgagttccttccaaaaggaaccagccttctgttctaaagagacacgtaaaccacacgaggtgaattttcctacaactgatttcaaatgtggagttttcagggtgtaatttagatgtagctgtggtggtttatggccacagaaactgtaggtgtgtgtgtaggaggctacatggtacttacgaatgactggaagccagagagcagagggagagagccagcggtggagattttagctcagtttcacatctctaccccaaggcattagatgccgctaattcttcaaaagccgaagatttgttttacagaagaaattctgatttgattaagatattgcttccagacctaatgttcctttagcaaatcatgcctacatccatgattagaaaaaaactgcatgttatctaagcatagaaaagcctcatgatttgaaagtattctacagaagtaacatttagtgtaattacagtacatttagattaattatagccgtggttccgggcgccaccatacttaaggttatatcagcatttttgtttttaaccctgcgtggagtaagtttatcctctggctgcatatttttttactccagaaaatatttgagttccacataatgtgagaccaaaattgaatggccttttctacttttaggctaactttaaaaagatataatttcagagaggctattctctttaagattgctgtttttctgtagaatctcaaaataggcagagattaattttgaaaaaaatgaaaatggtcatgatgcttagataagaagttgacttgctataaatggcttgtgtttccctttgaaaggctttatcgcattggccataaagtaaaacctggttgacatttaactgccatgtctgtccagaacttacctatctgatctgagtgtgtggctccattcaaattgggcccttagggaggcaccatcttattccaacagttctacctgaccaggcaggtaacagtttgaaatttcatctttgtgaatggtctttggaatctgtggctggttcttttttaatatcatttattataaactccagattttcatttcttgatggtagtggtgattgtgatttttttgaaacaaccagaaagcaatttggagcaagatttggtgagtaaggaggctgataaggttgaatataggttttactaaaaaatgagctgtggctctaagataatgagcctaattttcatgcatggttcataactgtagctgaaggtaattccctcagagcagttctaaacatggttgaagaatgcatgtctccttgagggtagtgtatagtttcctcatagtgttgcttctaagagtcagcatttatttaaatgttaaatgtctggtagtttctcttatgaagagtctcattgtcttatagttatacatcatgtaaataaagggagatttctttaaattctaagtattggactgtaatgaagctaaaaattgttatcacttacggcctattttgctgttgctataatagaataccagagactgggtaatctataaagaacagagatttatttgttacagttctggagactgggatgtccaagatcaaggagctgcatctggcagagccttcttgctgtgtcctgccatagcagaaggtggaagaacgtggttcctaactgtagctgaaggtaaatccctcagagaaagaatgcatgaaaaagagagagaaagagagagagcaaggtgggagcaaggagagtgctgaactcttgaagatatcacctctcaacactcttgcattagagattaaatttctaactttgggggagacattcaaactacaacaacctgtcacgtataataaaggcatttcctaaatctattatctttatacaaatgcatggaaacattctcaaaaatatttgttaatgctagctaatagttggcattttattgagcacttaccattagtcaggcagtgtgtttcccgtgctttaactggtttacctatgactttttgagaaccttagagacccatcctttcaaatggtgccaattatattcacagagaggttaaataacttgtccaaggtacacagcttgtaaaatgctgagctgggatgaaaagtcaggccagtctaactcagggtctgcacattttgccacacctgatgcttcaatacatttgataaacacatgcatcctgagtagagccacagattactgcttcccagcattctagctgttctcttggttgatcaaggcaaaaggaaggactgttcagccatttattacagagcaagttgtatcaaatgaacaaaagaatcaaggcaaaagcagtgaatttctccagccctcacttggttttatttgtcttttccttttctattttgccctgctaggttatattttaccttttcacggtggagttgtgcgggcgagtggctcttatcaggaacaaatgatgccataaatccgggctaaaatcaatgaggttatgagctctaagagtgagatgcagttctgtgggcccaagtgttttcccttcttaacatgctgcacctttgaagccagaagccagaggcttgggtgttgttctattcgcagctagttctgtcatttacagacatatatatagctgctctgtcactgagctgggttcccaatacccatcttcccattttaaacaagaggaacgtcaagaagaaataatagagagtacgtatgctctcatgcctgtctccaaacatataagaaaagagacagaaaaggaagcgccaaacaaaaccaccttttggtaataacactgtaatgtaaaaattatagcctggaattcttgcaaatggcttcatcttcctctcttggagagactggcaccatctctttagccttactcagctaaagggaactgatttaccagtgccaaatgcattaatttagtaagaaagagaaaaatagcaatggatgccattcaattttctgatgactggttatggccattttatgaagtactgaattcgcttagaggaaacccatgaacagacaccaggcatcctaggtagtggctgtgagcgagaaacatgccactcaaatactgtgtcttccattctcagctgttggtgcccttagtgtgtgagatagtggtaataggagtgaccattgagatttccactccaaaaagacaggttcaatcctgtaagagaagctagtttggcaactggagttggcctgttctagttgactagttgggaaaatggacttcttttctactccctcatcacacagatttcttggcttggggaagggccattactagggtcacaacattttaaaaatatcactaatcaagatgaataatattttaatgtggtatttgtgaaaaatcaagacgcatgcagaaaaatccacaatgaataaacaatctgatttttttttaaactttaagttctgggatacatgtggagaacgttacaggattattacgtaggtatacatgtgccatggtggtggtttgctgcacccatcaactcgtcatctccattatgtatttctcctaatgctatcccttctctagcccctcaccccgtgacaggccctggtgtgtgatgttcccctccctgtgtccatgtgttctcattgttcaacacccacttatgagtgagaacatgcagtgtttggttttctgttcctgtgttagtttgctgagaatgatggtttccagcgtcatccatgtccctgcaaaggacatgaactcatccttttttttatggctgcatagtattccatgatgtatatgtgccacattttctttatccagtctatcattgatgggcatttgggttggttccaagtctttgctattgtgaataatggtgcagtaaacatacatgtgcatatgtctttatagtagaatgatttataatcctttgggtatatacctagtaatgggattgctgggtcaaatggtatttctagttctagatccttgaggaattgccacactgtcttccacaatggttgaactaatttacactcccaccaacagtgtaaaagcattcctatttctccacatcctctccagcatctgttgtttcctgactttttaatgattgccattctaactggtatgagatggtatctcattgtggtttttatttgcatttctctaatgaccagtgatggtgagcttttttttcatatgtttgttggctgcaaaaatgtctttttttgagaagtgtctgttcatatccttcacccagtttttgatggggttgtttgtttttttcttcaaactatactacaaggctacagtaaccaaaacagcatggtactggtaccaaaacagatatatagaccaacagaacagaactgaggcctcagaaataatgccacacatctacaagcatctgatctttgacaaacctgacaaaaacaagcaatggggaaaggattccctgttggaaaaactggctagccatatgcagaaaactgaaactggaccccttccttacaccttattcaaaaattaactcaagatggattaaagacttaaacgtaagacctaaaatcataaaaaccctagaagaaaacctaggcaatactattcaggacatagacatgggcaaagacttgatgactaaaacgccaaaagcaacagcaacaaaagccaaaattgacaaatgggatctaattaaactgaagagcttctgcacagcaaaagaaactatcatcagagtgaacaggcaacctacagaatgggagaaaatttttgcaatctattcatctaacaaacagctaatatccagaatgtataaggaacttaaacaaatttgtatggaaatatctgatttttaaacaaagacaggatctgtaacagtgccattctgagccatattgaagcctgaggcaaaaggaaaaaataagacatttcgatttttaacagtattgcattaaaatttcatttatcttgatgacagtttttttctggggggggcacctcctgttctcctcaaagtccagctctaatgctttctctctggggttttacctgatttttctctgtacccctcgccacttcagtgtgaatgtatttcacctctggtcatccatcaatactttctgcagatctccttatggtttctgccatggtagaccatattttttatgtatttgaagtatttgcgttttttgtaagacaatggcttccttgaggatgaagtctatgtcttttgctttttgtatccataatgccagccagacattttgtaggtaataataaacatatttgttgattgttaaaaaccaaaacatgagtgaatgaatgagttaaatgaataaatgaacataacatttgagatttcttttagcattttattagtggatttacatttcaacaattttcctaaatataaccttgggtcaattttgacccttaatttgggaaatcaaagtctcctggaaagaactggctctagggtattttctcttataaccatcaggcagggagtcttgtttgctaaatgggtaatgataaagtcatcttcatgaacctatccaagcattgaactcattttcattacatagaaaactcaagagcaattcagcatcaaattagtcagtcttaggacagagatgatattttgctgagtgtcagctttcagttgatgcttcatcaagcctatctggctttattctagggtgtggtccttatccgggtccctgcctcagaatcaggagtggggtgggcttctctttccagatgccaatccttacctgtacctcgtctcactcctactgagccaggatctctaggggttgacttctttggtcctagaaggaatgcggtggaatacactgcagcccttagtaatctaacctaaatggtctgtgtggccaagctgtttggaagcctactttacttttttgagggctacattttcttacccatttttatgacagtgattcagtggtgagtttcttttagctgaaatggttcaaccaaggggaaataatcttttttactaaaagaaaaaaaaaacagaaccagagtggggcaagttatacaatattcatgatcacttcaaattagagaagtaaaagtcaatgttgaagtggccccttgcatgtggagctattatgattaggattcacggtctgtgaaatctaatcctagttgcaggacactatgaaattattgaacttacatatgggaaaatgttaatgaaagtggtgagttcccacccactaacgttgttgcttgttttagaatttaagacaacagttatgccagcaaatgacagctttgttctgtctacctgatgtcaaatgactggtctgactgatttctttttaaaccacatttaatcaattgtcaagtcgctttggcatcacacagacacagcctgtgctgtgctgggagctgtgtattgatttagtgttaagaagccatggctgaatggtgagtaaaagtcatgcaacaccagaatataaaccatggaaagaatggagactcataatcacagacactgctgctcagctttcccaagttcttcagaaaagtacaacctctagtgtctcccctgggccccttgttttctgcaagcaactctccaaaagattctaaacctcactcatagctacgggtaacaagccaccaaagggcctcagttttgtcttctcatgtaagcagtcattaaaacaatctgtctaaccatgctttcttcctttgcttccccaagccctctggaaaccaaggctagagacataggtcagcttaactattccaaacaaaaccccaaacaaacctgaagacaactgagttcaggctgaaggtgatttcattgttattcccaagaataatagatgtctcccttcctctctcttcctctctttattccttcccctatctcttttcctttcttgacctcctgaaaggggcctgccaaactggaggccctgaactaggtactgggggctcagtggggaacttgatgcctggttgcatggagtttacatttcagtcagggtctgcagacatgaaaaaagccacaaagaaaggcacaatccagtttcagattgcaataactcatcagaagaaagtaaaacaggttcctgtaatgcagttacagaagaggaagaggccgactttagccttggttgtctgagaaggccctgtttgagccgaggcctgcaggatgagaggaagctggtcaagtgtggatcttggggaagcatttcaaggagacagcagtgcaattacaaaaggccctgaggcagggacatgcctggcttgttcacagaataaaacgagccttgttaaggatggtaactttatagaggatgaggttagggatgtaggcaaggatcagacctgtgggtacttcaaagggccagataagcaattggaatttcattctacctgcaatgggaagcgtttggaggagtttaagcatgggcagggggatctgatttacattttaaaggggcacattggctgctatgtggggaacaaaatgtaggaaggcaaagaaggcagtggaggccagctgggaggctgtcattgcagtggtgtgcaccaaggcagtggccatggaaggagagagaggttggaggtggagtccacagaagttactgatggatcctgtgtgtgtgtgtgcatgctgggggtgatggaggtgaatgaaagggaggagtccagtataccttctcaatttttgtgttgagcggccaagaggatagtggtgccatttgctatgctttatgcttatataactcggacagtccattgagatggtttttcacaaaggactaatctttgccaagtaagttttatctctggtgagacaacagtaaaataaaactatttgcagtactcaaatggttgtcttttactagcagattcacacattcatgtgtaggatttctaacatctggggactgattttcagcctgggttatcttccagactgtgagctacttgagggtaaataagacaccatatcttatttctcctggtacttctagtgtcagtgtcagtgaccagcacatgccaggtgttttataaatgcttgttgaaaggaagagaggaaagacaactgaccctctccagaacttgactatcttttgtttctaatgcttatcatgacaatgaagaggacacaaaaaggaaaataaaataagggcatctctgcagattaggaagaaaatttcaatatatcctgaagggaaaaaatatgatagaacaaaacaacagacatgctgtagatcacttcttccctcactgttgaaatattcaataaatctatagcagcacttacctaactgtctggtagtatcttagtatttaggactaaatttcaactcagttgatcctttgaattcaatcccagataagttttaaatatatatgttgttcatgtctgagacacttaggatgacaggtatattatcattaggctatattcagtaactaataaagaaattattaagaaagggaagtacaaaatgcctatgtaattgtagaggagctgcctcattcatttgatgcaatagagtcagtgagctgtctggaagaaaaactattttcctccaaagcatttggtagttccctcttgatttgaaaaaaaaaaaaaaaaatcaacgttactctgcatgccattttggaggcgttttgacatggccgaaacctgcctttccttttttcaccccagcctctgctctgccattttacaccattttccattcttaattgcttactcttctgtgcctttagtcttgctcttccagtggccaggaagatatctccctcactttctctacttcaagtagcctaattatccttcagtgctcagctcagatgcagtctccccaaagcagccttcctggacttccccaggctgaattcataccttcctccatgtttcctctgctttgtattatgtgcagcttttatggatgcctcctacaactacattgtatttatcttccacagttcctaggtagcacattccacacagtaatactcaatagaggtttattgagtgcttaagtggaattgctttaatgtcatggtcctgtttcttattgtcttcctctgcatcagaaggaggacatgtagaattggctgctctttgctttttacagcaggtcaaaataaatgcaagctctgacacattacatggaattgaaattaagaagaaagagtatgatgcttgttatcagtggaatcatgggcatggtaggagaaaattatgctagtgacaggactgctagtctcaacctaggaaactggcagtagttggctttgtgactgcagccaaagattataccatattatattagttgaatggttgaatatatatctgttcttgaaggaatagtatgtaattaatctctagtttttaaaatatatttatgataagaactctgtttcccctgtattttatttttcttaggttgttaaaaaaaactactgacatctttcaaacactttactcaatattcccccaaaagcatcagcagcaaaagtttatgaatatttttattagagatgatttggattttattcctgcaacacagagctagaaaaattttaaggtcattagccataagagttttaaatacattgtcattcgagtatgttagttttagcttcatagttctctgttatctttagcttttcccatttttaagttaataatgataaaaataaatttcatacttattagcttttttcatcctaaggtgtttaacaaaccttaggggtacaaatataatgtgtagcaatccatatgcttgctcataggtttatggccctaagagcatcatttgatcacaattatttttgtttcattgacattccacacaatcaactgaagaattgggtcctaagttactggaaaagtacaagtagaaactcttgtctagccagttaacgtgtctttgaatatctttatttctattcttccttcctttcaacaaccctttgttacataacagctatggttgggttcagagcccaagactaggggtataaagatcaacaaggttgttaaaagttcatatatatatatataaaatatacatgcatatctatgagttaggttaaaggtatatataaatatgtgcgtgtatagttagaagtataaatgagaagtacattgtcagatgtgtatacatatccttagtaattttaatttcctaattgtttactctctgccaggcactgtgccaaatagtttatgtgcatcatctcatttaacacttgcaacaactctgtgaggtatcattatcgtatggtgcaaataagaaaaccaagactcagaaatattattattatctattttgcccaagtctgtcagctaacagttgtcacagtcagggttgaaacccaagtgtgtctgacttccaagctcattctctttccctatgtttttaagtgtctctggttgaatcagatgctgatttcttcccagaagtctagattcagaattaaaggaacaaaagaatgaaagtattaaaatggttgcttgaatatcaaaactggatggtcatgaataccaaagatctatttgttttattatatatatatatgctctggcaatcctgcattggagtagagagtcagttctcagacaatagttctctatttgaatcagagcaatgaaatgcagcaattcagtgacagttgcatcccccttaggttccccaactgaagaccaccttctggctggattactttatggtgtggtccttttggtacttcagtagctaagaaagtgttttcagattaataagatgttgaaacaccagatgagccatcaaggggtgtgcaaggtctctatccttaagaatctccatgttgagaaaactgttcatcctagatagctgaaccgttcacctcttgggatctttgacaattctgtgatttttgcaagacatgcacacttatcaagttaatttcaccttaagccaaaatctcctttgtagctctttataaccaaagtgccagcaaatcaacaaggtgtctctgaccacccttggactggattagactctctattaggcacttgtggtactttttgcttcatagtatttcttactcttagagttcagtgattatttgtgtaatgcctgtctgccatgctggactatgaactccagttggacagagactgtatttgtaatgctcagtactccaccttacctgcggtgcttaaccttgtggctggcaaatagcaggaagtcaatatatatttattgatggaaaaataaatgactgaaatttaatagaagactgaacacatacaaccatgcagcggatttagtgttgatttatgctacagtgattctcattcttaatatttaagcacacccctagttcaatacctctttcatgacctaacagctctaggggttttatgtgatggagggcaattctgtttgcttggtgattacaagaggacagatacaatatttactagccttagcaattcctgagcaaatgtggtccctggagaagggaacatagtaataaagcagggaaacctagccgttatcttgaagcaaagccacacaggcatcaaggctgcagctcgcattcctgtggtctggagctctggagttttcaagggttatttatggtgacactgatgagacacttcatttaaatactgtaactgctgaagtatcccagaatgaaaaactcagcttacggtggagtcaataccttgttatttcttttaactctctgatataccattgtttcaaggatttacactaaaatacttgagtcttgagtcctaaaatgacccaagagagataaactgaccatggctgcctcctgtacataggatttggtttcttaaaatgaagctcactcttatctttactcagcccattgttctttaattggtcaaatgacgctataaatgaaggactttgatagcaaaaaataaatgttttatacattgctagaaaaagctttaggagaaaattttagcaaaagaacagattctttcttgtttctatagaaaccagtagtgatcaggaggagcgaggtgttcttttaagcatacacattagtaaggccagctcagcagtctccagcatactggagagctggagtcagagacccactagctgggggagtgcctctgtctgagtccttttgatatcattgggagttggggacatcttgctggaaatacctggttcctcataagctgagtagggttgcagtccacagtcactcagcatcatagagccagaaaggtttttaaaggaatctcctgtcaaaaggggaggaaaaagataaacataggaaagctttaatatcagatgtcaacaggcctttaaacatgctctttaccactgagcaataaataccctggttgagtcctgaccagatcacttataaactgtccaaagtacgcattcgaatcattggattgtatgacaatttgtttcccttttggtttgtctacttccataaaatctttaaaaaatgaaatttgaattaaatgtatcttttaaagttaaatttctagagctgttagattcctgacaagtgaatgttggacaagacttacaatcaaattccaaagcaaatacttttctaaagcctaatcagtactacagctttcaatgatttctctagtcttttaaatgaagtttaggtcaaatgtaatgacaggatgaagcagatgcattttgcttcaacctgacatgccccagaaggtaagagaaatatctggtaactgacaaaagagttttctgtttgcttgacatttactttgtatgtaaataatccagtatattggcatgtcaatatattagttagtggtggcccaaaacatgatgcgaatttagatagtatttctttctgctcacaaatatacactcttgatcaacaagagaacatttattgcaatcttgccttgcagttggcagagcagaatgaatcgttttgaaatataaacttcctcagatctaaaatatatcacaggaaaacacaagacataaggggagtggattatgaaataaaaggagcatatttcgtaatctataggttataatcattaaagattgccattagtaagatgctgggccaaatgtgtaagactacatttggtaagcaggtatgaaaagctcatgatttccttgaaactgttctttggaagcaacactgcattgtggaatggtaagaagtggccccttactggctgtgtgaccttgggtaagtcactttccctctctgacttcagtttcctcatctgcaaaatggtagtagtaaaaatgatggtgatggtgataatgatcatgatgatgaggaggaggaggaggaggaacagaagtaggaataggaggaagaggatttctctatctagggttgtaaaatttagataagaaaatctagaaaactctgcatatagaagatgtacaatgtgagtcatattcctttctactttccctaagaacaaaccatgttagtacttaacatttcgcttttaccaagcttttagcggtcgtttctttgctattcaatgagaactgaagttttgctgaaatatgggaaaagtaaccaaacatctctaaaaaacaaaacaaagcaaaacaaacaaaaatacaaggagtaagaaatatgccatattttctagacacattttatttcagttttttcccctgggtgtagagttagggtgcaaaatctatcaaattcttctattaattttaaattaagaaatgtggagatttgctatgttagaaccaaagctttcctgattctctgaggataactgtgtgtgtgtttgacctctagagctgaagtcacggtgttagccccttgtgacattagtgttcagaagctctttctatgcatggataaatcttggttgtctagcacaggttgtgaaacataataggggctcattaaatatttgtttaatgaataaatgaaattattatgcaataaaattaaaaatgtaatgtttaccaaactactctcagtacatttgtttcagtgattttttcatacaatcatacatgatatcagaccacatgtaatatatataaaaaggatagctgtcagtaaaatggaaagaatccttgtctccatctcactggcttgattgatatatactcatatccaatatttcctatagacaggctaccataattaatttgattattctttcacataattttgatggatcaagatgcagacgatttataatttctaccaatccaaagtgtacagtgtatgtttattttggtctgtaatctccaaacagtcattgtcatcatcatcaagcctactttgaaccgtacaagctacatagtgtcacatctacatggttatagaccctcagtatgcttaagatgaaatttcatatcacccaataagaaatcttcattatttattaagaatgagtcaggaagagaaagcagttgtgatttcttggcttatttctctgacaacctcttcaatttgaaccaagcaatcattactcattttttaatacacaccacacacataggtggatcaagatttgaagtctcataacatttagtaaagtagaaatacgcatcttcgtagaagaaatgtggaatgtgtacttgtattcttccttttcatttcaaagatagtgctgcttacaacactgatgatctgggcatgcagatgtgactgaaagggtctgtgtaatgacaatccttctacctgagacacaggacgttctccctttgcatagggcctggtgctttgtattggtttcctggagctgctgaaacaaaacaccacaaattggtgtggcttagaacaatagaaatgttttgtttcccagttctagaggctataacttcaaaatcaaggtgttgggagggctatgcttcctccaaaggtcccaggaaagacgtgttccatgcctctttcctagcttctggtaaccgcatccgttccttggattgttgatccatcgctccaatcctccacctttacatggccatcttcttcctgtgtcttcccatcctcttgcctctatgtgtgcctatctgtctgtccaaatgtcccctttttataaggatactagtcatattggattagggctgaccctaagaccctcatcttaacttgatcaccgctgaaagatccctatttccaaattaggttacattctgatgtgctgaaggttaagacttaaacatatttttttggagggggtggaaacaattcaattcataacaaattttcatactaaagtttgttctttgcaactgcacctctggcacttgtggtatagatgaagcattagctcaaaaaacccaactgtattctttggagctgcttttctgggcaagcctgtggactacttaattgttatcaaagttctaccattaggccgcttgacttgaagccatgcttctgtggattcttaaagatgacacttctgccctcctgcctatgattactgtgcatgattagctgcagcattgctttccaaatgttccagaacttggcatttccagtaatttagcttggactggtctctactctgcaccacccgctacccccaactgcagctcatctgggttcgtaagtttgggtctgaaagatatcaagaaaatttaaactttggggcacattttcagtgggaaaacagatggaaaagctgtatgggagtgtaaagtaaaagattgtattgatcaaagagaggaattctcaaagtcttgtagctaaacttattcctgtgggaaaagctgctaacccaaatcctcctagacaaataatgccaattaaaaaaaggcactgagttcactggcttaaaagcagtcattctcaagatagtattatcattttaaagcttctaaaagctttctgggaagcctgagtcggttcattgtcctaaggacagatggacacctgataaagtatttatggcccaatctaactaaggatcagcacagggtcaaagggccagtgataataggactaatatctctagatccacctacatataggaagcactttctaaaagttatgagaaaaaagattattcagcctgaggcattagcaactattttgattaaatattggtagggagcttaaaggtcatcatcaagtaagtgaaaagacacatcacagaatgagaaaaatatttgtaaaccatagatctgataacatactagcatccagaaaagacaaaaaaaaaaaactgttacaaaataattcaattaaaaattggcaaagcatctgaatagatatttattcaaagtagatacacaaatgctaataaatacatgaaaagacactgaatatcttagtcatcagggaaatgcaaatattaataaaaaccatgagacaccacttcacacccactagaatcactatgcccaagaagatacacagcaacaagtgttggcgaggatgtcgcgaaattaacaccctttgcttgtggaaatgtattaaataaaattatgcagacactgtggaaaacaatttgggaattccgcaaaaagctaaatatcgaattttcatgtgacccaacaattacgcttctaagtatacatggaataatatttaagacatatgtccacataaaaacttgtactggagtgttcatggcaacattacttgtcacagccaaaagtgggaatgactcaaatatccatcgactgatgaatggacaaactaaatgtggtctatctatacaaagaatattactcaaccacaaaaggaaggaagtactgatgtgtgtcacaatttgcactgcaatttggatgaacattgaaaacattatgctaagtgaaagaaaaaacagacataaaaggttacatattatatgattcaacttatataaaatacacataataggcaaattcatagagtggttgtcaggggctgctgggaggggagaatgtagagtgactgctaataggtacagggtttatttttgaagtaataaaaatgttctggaattagatagtggtgtttgttgcacatctgtgaatatgaaaggactacagaattatcgactttgaaatggtaaattgtattatctatgaattatatctcaggaaagtttttagaaaaacagtttcactaactagctttaacattcactgatgattctttgaaacagcaactagatatattgtttacaacttagaccaacaatttttatttcagaaagagtattttatcattggcatttagaattgctgctgcatggtgatgataaatagcagacagacttaaaaattgttagggaaattatgttagaaaacattaatcactctagttttgtaagaattcacccagcttccagaaaaagatacacaggctggtttcagtggtggatcaaccagcaatgacagtcaaaactttgtagtttgctggcttttcagttgtaaggtcagccatggactccatgaagcctctgggaccctgatccccagcacatccactagagggggagcaagggagacagaagaaacatgcaatgagtggtcttggggtggctaaaagcctgggggaagtgctatatggagtggataggaatttgaacttctagaccaacgtatagtttccggatattgtgagtgtctgtggaatgcgataatcgatactaacctcttggtctttaaaatggtgataaagacttttttttttgtcctcaagaatcacatggaaagcaccttaaaattagaatctgtttgcattggacatcagggatcttttaaaattacattttaagaaaaaaacatgtggaggaaggttaaatttgatgtgaacaatccttgaaaaccaactgcagacatttaaggttaacgtgtcttattcccacaacataggcaactttagtgttttttgcagtcatggaaacaagtttgggttaaatgatatagagatttgaagctttactctttgaagtgaagctaaaagatagaacaaatggaatatttcttgtatttggggagaaagaaaaatcatgattccacagtaaagttagtattagcggtcatgttccgatgtgacaatccaaactagaaatgtggggcaaatttctatttctgagactccaaattaaaaatcttggagctggattttttcacccttagcatcgtgtactctgccttgataaggaggagacaaaggataagccaacaatcttttaagataataaatatagagagatagttgagatttaacccaatctatatgtctcacagcaacatcaggggttttgatgacctgaatcatccaaagaaagaataaatattgctcagtaaggatttaataacaactaaattttttttattgtctgagtcatggaaatcagtaatccttgtctatagtgtactgatggctcatgaaaacattaattctcaacaatatatagtcaattcccaccaatcctaaaagcagattatctaatatgtagattatttctggcccttctgccctagtgacaaagggaaaagtcgggcctttgtgaatggatgtgattgaatagctctataagggttggtgtcgacaaggccaaagttagtggattcttcattatgattcatggcctcttgtagtcagaaacacccagcaaactgagccataaccacagctctgggtttggttgctttgatcttagtcaatgacctggaaatctttcttaataataggagcacacagattcattctgtagcacagcaaattgtttattcttgtttgggtcaaattgtttagggaaggggttgtgactgaggatcttacttctggaggcaaggaatggtgggctgaatttatggtactctttcctgccctgcccttgtgcttcatgaagatgatggcacaacagctgtggccttagtctttacccaactgctaatatctaataatagttactaccatttactgggtactggactgtgacttttacttaccttgtcgtttaactctcaagaaaaagctaagaagtacacattattgtttccatttcagggatgatgaaactgagagtctgagaagtctgtaagtatagtatcagtaactgctttcattggaatattgtgcagattcataaatacatacatagtgctggggtgtgtgtgtgtgtgtgtgtgtgtgtgtgtgtgtgtgtgtgtgagagagagactgagcactggacactgtgcctgggacaagagaagcactaagtaaatgagagtcacatttttttttgtccgacatagcactgactattttgccaatgcctacctagcagattcaataggtaatggttgaattgaattaaaatctcactaaatatttttcaagttggctttccttctgtaattagctttcttacaatttgagtggtaattggttgatggaaagaataattaataataaaggttgtttatttgtggggtgagcatttatcactgttctcattttcactcttttccatcagcatttaattcacgaaaaggagtataagttaactatagagaaattatattactgaatattgaatggcaattacaatacataatatgttttccttttaattagcaaatagactgttcattatgttttagataattgttacatatcacttcattttatttctttatcatttgtggcaggtgattacgtttccacagggtataatttttaatcacattattttgaaatttgattgcaagattatgcagtacagaattcagtgtattcaaatcaccctgaatctctcacattctttgcttctggaaaatttgcccttctttcttcttccctgaatatgtatgataagcaagaattcaaaattaatgaagcccagtactggtgtaaatctctctaaattgctcatatttagagatctttgaacttgaactcagaaacttcaacttgtgtcccattgcaatagccatctcttttaaaatcagtctttttttgctaataaatgcaaataatgtgtaagtgcaaataataaattatataataaaatagaatagaatatataattatctgatattataatattatatatataataaatacaaataataacatttctgactcctcaaggagctaaatagcatgtggtgtgttgtttctagctttcttctctcctgtctttgagtaattgggctgatcatgcccgttgttgcctgctatgggattgacactgcaagtttagctatgacaagaattcagtagcagtgtacaggttgcttgaacacagacagacctccctgcttctgttttggtaatgtttataatgaaggaaagatcataggcagcagcacctattacaattattgttatattcaggcattggcagatatggcacccagatgctttgctgcagtttgtcttaataactggattatctgatttcctacaagttctgcaatgacaaagtggcagcctttgggggaaagtttcatagaatgagcactgttttaggcaaggcagccaacttggtttaaaatcagatcctatcagaggaatgagcagagtctacaattataggtcatacaaagattgtgaagatattaaacgtgaagcaaaactctttaatttccttatttaattttgttctgaggagtttaaataatactgcttaatgctatcaggatgatgtcagtacttcgaggaaataactttcctatttagacttggtcatgcagtctgtttaacagctatttcctttataatggcatgttgcatttcccagcattccttagggcatgcaaggagaacggcatggtcttcttgaataattaatatggttttctgagcagtagtcatggaaacccaagcagtgtcacatatttggattataagaattaggcacattttgaatataacgtttaaccgaaaaggtggctacccaccaaaaacgaaagtctttttcccaattcccctagtttagcgacatgaatgtggtttggggtgtgtgtgtgtatgtgtgtgtgtgtgtgtgtgtgtgagacagagaaaaactaatccttgcttcataatacaattatttttatatttttgtgtttgaattgcttaattggttctcttcgctctatttttgaattctctgtttaattgaaatgttttcacatgcaagcttctgttttcatactttatctagggctgctcagtcacaggttattacttttttattaaagagaaaatgtagaacttaatttacaataaaatagcatagaccactcactgtcttgagtatctctaaggtatcacatcctttctaatgctgccccaaacctctgatgttattaggttgtaagattttcaagtgtgttagacaattgctattcatgaaaaagcctagtgttactgcgaagtttctagacctgctctattagaccagttgtatatatggttcttttatttgtctcaaaaagtgtctcttcagaatcaatatcgtcattaccttggatgtgtgtgtgtgtgtgtgcgcgcacacacgtgcgcacaagtcaaccaggcaatagcaaaaagctatcatccagtcttcagtaatggtgtacgtgaaaagaataaaaataactggaagttatttatagagtataaaccctctggtttcataaaccgtgtatgctgctatttgctcagttttattccacaaacaactgcagtgtctaaggctcccaaacctctgctttcctagactgatgaaggaagtgattagtaataccattaacaaataacagaagagtaaaaagaataaagggaagcaaagatttctttttgttactacttctagttttctgcctatttaaaattgtctttcttacagaaatgtgccatctcatggaaggaagcccacacatgtttgaactattttcttttgcactttcatttgttaaatgtgcataaatagtggggatcttcctcggagctccagatttttctctcatcttacactgatcctttctctatggtgaatatgctcagcggcatcatcttttttcccccaaatgcctttacaacaaggtattactgtgtctcacttgcattagggcccacctactttgcacccctgaggctgtgcctgtgctttcattaggattccaactgcatcgctggccaggcttccatccatctgttgataagttgcagctcctctgcgattctttttggaattaccaggcaaatactggactgatgcttcagcaaatccccaaattctttctttatttttatttggtcatgtgttacacttactttcactcttggcctttaacttttctgtgaactgacttagtcagaaaattccaattggaggtgtcttttcttatatcattttgcttgtgcttttaggttttggaaatttgtagtcctgtgcttatgaagtttacctgtttgcaagggcttgttgacttaatcccgtattatctccactttatcccttaggctctctccctgacagtccctttggttgtttcttaaaggccaaactcattttgataacttcccagcatccttcttctgcctcatcatttttctagattatttctttgaggactccacttaagagtcatctcttcctctttcatggtaccagcccctcccagtctgaaccaagtgccccatgtatagaccatggcatgacactaataggtgcgttgaagggatcagcttttatgtttcccctgctgcctgaaaactttgaggttcttgaaaacaaagactgtatgttattcatttttctatcctcagacctttgtacattgttcatcacatagtaggtgcccaatacatgttcctggcaatgttggttccatgttaaaggttgttaggctgcttcattttcttactgtggattatttttgttatctatagatgcgttctgttttgggggaaaaaacatcatgggatacttggagacatatctgtcatgtaactagcactttgcagggcaaaaatatttgaatatggactgtgaaacattggttgaacgaattagttttttctttaatgtgtggagggcatccagggacataaatgttagactctagacttttaggcaaatgttttagaaaggcacccctccccagtgaaaataaagtcaccattgtcaccttaattaattacaaataaaaaggtcttactttgaggtgggttccactagaaaggatgccttttcccagaggctgagctcagttgcagattttgtttctaggctacacgttagccatgcctgttagcatggcagctaagttgttttgaagcatcagacattagggctcttgtaaacttatagaaaatgtgtctatgatcaggaatgtaagcactctttgagtgatccagcagcagacagaatcaaatagtaatttggaataaaagcatttttgttgtgataattaagcaccattgttagattccatacgctgaactgaaaacccacgtatgtctgtaattgatggctgaaatggttgaatatagcctccgtatttgttaccagattggctccaatatatttggtctgtaaataacattggagtagtgcacacatctatagggagctaagttttacctgagatgcgcatgcacaattttctctgagttcaatgcaaggccaaacacaatttagtttggtgaataacaggcttttatcagcagcatgtatatcacagctacacgttttgaaaaataaagcgattgttgtcatttgccatagtaaaagagagttgtctgttgtaatatatttaaatgatgctgttagtcatttatgccccaacataaatgctgtttcatgtttgttttattaaatatagtagtatcgaaagaatattttgttgctcaaagacctacatgaaaactggactaaataaaattaaggagctatcactgcatgcagtgtgtggaaaccaagtaaaaagtttgatgttttgttactgtgactggaaaactcgtcatgaaactgacagctgagctttattaaagcatttaatgtgcaagatggccaaatagacatgataaaatatgaggatttctttagagtaaataatttgaggtgctatgaaggacatggaggagtggcagaattcagcctggagttcttgtgtgtactaagagtgaaaaagggaggtaggtcagcgtctcttttgcagtcccattaaactaatttcctttgggtcaggcatcactattgtgcagatagtgcatgatttttagagataacatgtaactttgcaaccctctctgctgccaagttggtaagagctcagagactgcaaactgagctgaacatgctatgctgtttataaaccaaggtgcatctgtggaactagtactttaatacttgtccaagtagtgctgcatttgcctggatacacttgcccattcatatccaggggctttttgcccagtgcctcctatttgccagatggctgctactggttatgagtcagtgaagcctgtggttatcaaattgaactcagcttctaggaggctcttagggggcttatccttggaaccagcccatccaccttttgtaaaagaacccccaagtaaaatatccgtcattggatatttatttaaggggaaaataggtaaaataaaatgaaaaatattatcttcctattcttttagccaagtctcttagcacggtagctaagctgttttgaagcatcagacaacagagctcttgtaagtgtaaagaaaatgtgtctagatcaggaatgcaagcacccttagagtgatccagcagcagacataatcaaatagtaatttgaaataaaaggatttttgttgtgataatgaagcaccattttttcattcagatgaagttgtagaaaagaccaaaacaaaattttaaagaaaattatttgaagttaggcacatttttgaagaaacaagttcataacagttttatatatatatatgtgtgtgtgtgtgtgtatatatatatgtgtgtgtatttttaaaaaataagcttaggtaagtgggttgaaataaaataattgtacttcttaatgtaaataacaaatcaattttatactattattacagctcttaaaaaactttttattttgacatacagaaagttataagaatcatggaaagaattctcatatccctattacccagattcctatgttgacatttgtaccacattgcttccttcttccctctctcacaaatatatacatatatgcacctcctacacacaaacatatgtgtatatatacacacatatatacacatatgtgtatatgtatatatacacacatatatacatatgtgtatatgtatatatacacatacgtatacacacatatacgtatacgtatacacacatatacatatacgtatacacacatacatatacgtatacacacatatacatatacgtatacgtatacacacatatataatatacgtatacgtatacgtgtacacacatatacgtatacgtgtacacacatatacacgtatatacgtatacgtgtacacacatatacgtatacgtgtacacacatatatacgtatacgtatacgtgtacacacatatatacgtatacgtgtacacacatatacacgtatatacgtatacgtgtacacacatatacgtatacgtctacgtgtacacacatatatacgtatacgtctacgtgtacacacatatatacgtatacgtctacgtgtacacacatatatacgtatacgtctacgtgtacacacatatatacgtatacgtctacgtgtacacacatatatacgtatacgtatacgtgtacacacatatatacgtatacgtgtacacacatatatacgtatacgtatacgtgtacacacatatatacatatacgtatacgtgtacacacatatatacgtatacgtatatgtatacacaaatacacttttttcctgacttgtttgagaataagtcacagacatattgaacataaagttcaatgtatacttactaaaaataaagattcttttacataagcacagcatattgatcaaaatcaggaagctaacattggtactaatctatctaaatactttaatctaaaggctttattcagattttgccaatcgttccaataatgtcctttagagcaaaagaaaatccagggtcacatggtgcattgggttattatgtttcttaagtctcctttaatctgggacgttcctcgctctgtctttgttatttcatgtccttgatatttttgaaaatacagggcagttattttgcaaagtgtccttcattttgggtttgtcttattagttttgtctttgttagttttctagtgattagagtcgtattatgtactactggcaggaataccacaaaagtgacgttgtgttcttctcagtgcatcattttaggaggaacattgttgatttgtcccattactggtgatgttaactttgatcatttgcttaaggtggtaaggtgatagaaagcttgtcacgataatgccaggtttcttccctataaagttagtatttttttctttgtaaatagtaaatatcttgtagggaagtactttgagactatgtaaatgatcttgctgctcatcaaaattttacccacaaactaattaaaaaataagaaggacatatgaatatgctcatttcttcaaagagcatatacaaatgtccaataagcatatctaaagatgctcaacatcattaatcatcagggaaatgcaaaccaaaacctcaaaatcaaaaccacagtgagataccacatcacatctgctaaagtaactatgcttaagaagacacataatgacaaatgctgaaaaagtggagaaattggaatcttcattcattcctgctgagaacatacaatggtatagccactgtgggaaacagtttggtagttctttaaaatgttaaacatagagttaccatatgacccagcaattttactcctaagtatatacccaagagaatcgaaaacatttgctcacaccagaacttgtacacaaatttttatagcagaactaatcacaataaccaaaaggtaaaaacatcccaaatgtctatcaactggtgagttcacaaacaaaatgtgatatatccatataatggaatattattcagccacgaaaaaggatgaagtactgatgcatgttacaacttgtacctcaacttggacaaccttgaaaacatgctaaatgaaagaaggcagacacaaaaggccacatattgtatgattccatttatgtaaaatgtgcagaatagacgaagacacagtgacagaaggtaaattagtggttgtaactgtttagtgatggaaggatggagtgcaactgcttaatgagtacagggtttccttggggttaataaatagtgttctggaattaataatggttatggttccataaccttgtgagtacactaaaaacatctaaattatacactttaaaatagtaaattgtatggtatgtgaattgtatctcagtaaagccattacaaaaactgaagtttccctcactagatttagcattcattgacaattctgctgaatcaattattattgtggtggatgccaaatggtgatttttttaaaaataggctttatttttaagagcatttttagtttcatagcaaaattgagcagagggtacagagattttccatatgcaccctgcccccatacatgtatagccactcaccataatagtatcatgcatagtagtttctatgtcctaaaagtccctgcaaatgctaagtcctcttagcagatagagttagaaaatccatgtgtatacatatgttcatatatgcatatgtatatacacacatctattatatattttttatctttctttcatacagacttcaatatagacaaagacacacattaaaagctacaagtttgtactcatactctaatttccatctgacataacagggttcattctttctttttccttttccgtatttataactcctttttctgacactgagaaacctgagtccaattattcactatatattaactaattaactcaattctagaatacacggaaaagtactttcagaattgctaacccatgacactatggaaagaagcctactagctagtgtacaatatttgcttagagttatttttgtctttagcctaaggacatatagtttgaagattgtgtgcaaaaatcacttacattagctcttagtcgccttacgcctccacccccactgtggatatgttattcatttgaaatatacttaagtttgcttatttctgtttgaattcctttaaaagttttgttttttcacctttgtttattttttcttttctttttgtaaaaaaaacactgtgaaacattaacatgctttcaaatgtcagaactttttcatttaaaaaggtatccgggatcttactcaacatcagtttatagagatcttcctcagtttaaagcttattttaattaaataaatctctagtagaggaatgttcaataatgtattggtctctttacaagaaaaaaaaagtcattttattttctgttttgaattttattttcaaattcctgggtctgagaaactgttaaaatggtggcagagtatgtccaaggaaacattagcattcaagagagaaaactaggaaaatgactgatgtagtaattaaataatcaaggaaggtattgaaaaactgaattttattgtgtctgcttgccagctgttaaaatgaggagcccaggtcagcttgacgtagttatttgcccctggagttaaatgaaatgattttttttttttttttgagacggagtcttgctctgttgctcaggctggagtgcagtggcccgatctcagctcactgcaacctccacctcccgggttcaagcgattctcctgcctcaccctcctgagtagctgggactacgagcacattttttgtatttttagtagagacggaatttcaccatgttagacaggatggtcccgatcttctcctgacctcgtgatccgcccgcctcggcctcccattgtgctgggattacagatgtgagccaccacgcctggctgaaatgatcactttttaactcaatgcctacttagtggcaagtgctatttaggacataaaagaaacatgagatttggctgctgactttacagaacatcagatctaattggagaaaccaaccaaacatatacaaaaagaaaattaaatctttccaaattcaggaaaatagaggtgctgttccaggatactaaataattacttgactaaatggattgtccctgcttccaaggaagccctgactcctctgagagtagttcaaaggtgaagtactctgagaactggattgatcggggaatgtctgaggatgagttagggttgagataatttttgggagggcacatgggtaggtgaaaggaaccagggatctactgcagaaggtaagacagctactgggtacaaacataggtaggactgtccagcggttttgatgaaagagctagagccagactccctggatttcactatggtggtcctgccatttattagccctacaattgtgatcaagtcactcattgctctaagcataagttaccctcatctataaaatggagtgataatagtacctgccacctagagatcttgtgagaccaaaataagataatccattcaacttttagcacagtgcttggcacagagtatgctctcaatacacatttgctatttatcatgcaaaagcatgagggcaaggaagcataagatgtaatttaagaagactgagtaggccgggcgcggtggctcacacctgtattcccagcactttgggaggccgaggcgggcggatcacgaggtcaggagatcaagaccatcctggctaacatggtgaaaccccctctctactaaaaatacaaaaaaaattagccgggcgtggtggcaggcgcctgtattcccagctgctcgggaggctgaggcaggagaatggtgtgaacccggcaagtggagcttgcagtgagtggagatcacaccactgcactccaggctgggcgacagagcgagactgcgtctcaaaaaaaaaaaaaaaaagaaaaagaaaagactgagtaaaccagtctgattgcattagaatggtcaagatgggagcagtgggagttaaagcccaaaatatatgttgggaacatactacattgttgtggaaggagcagtatagtagttaatacttatatgcaacttactgtatgcttggcactcatcaatgtgtttttataaaatgtatatcagtccatttctgcctctcgccaaccctgtgagaaaggtattattattattatcctcaatttactggtaagggaaaattgaggcacagagatgctaagtaacttgtccaagatcacacagcttctaagtggagaatcctgggtgccaggtcaaggtgtattaactaggcttgaattataggtttatacatacttggaaaaacttctttacctcacttccagaagatgtgaatatggaagtggaagaattagtagcaacagtggcaacgtttatattaccagaagataatctcagctgcgccatgatggaaatacatattaggcttttagaatttgtagagattaatgttccacaagtgttcatttcaggtaacattagctttctttcctctcataagtatacattattacaagaggataatactcagattgttgaattagagtggtgataagtgttttagtaaacctatggaaacacttctcaatctgagctctgtcagtctgcaaattaagcaaatatatacccagttcatcttttcagtgtagtttaaatatttgagacaaagaattcttcaatatttagagaataggacagatattggactaataagagatgctcctctgaatacttttacatatttcattggtgaccaaagtacttttttattatctatattataattgatatcaatagacagtttaaaccataggatcacagactgatagagcaggcctttagaaattttctggcccactctcttcattcaatctaatggggtaggcttagacagcatcaattacttgcccaaggtcacacacttaatacagcctctcttccctccttccctccctcgctatctccttcctttttggcttcctcctcctcttcttttctccctccatcctccttcccccttccatattttcttccaacaaacatttgaaattggacacattctaggtgctagacccaattctgagcactggagacccaacaatttacgaggtaaaagtgttccttgctctcatcactctagcctatactcttaataactgtttctagactagagcttatacactactccattactctgctgaggattcactgattcagataatctagaaggggagatactttctgcattaaacaaaaacagttgtaacatacagccagccttttgcatattttaggggatatgtacaagaagagctattatttttacattgattctaacagtgtttccaaagccagaaggagccaaccactccaaaattgaatgaccaatgggaaattacttttaaatatattactcatgatgaaaaagcatgcattttagtatatgaatattttattaagcaaagtgcctgtgactggctccagaattttgtaatacttagtgtgaaatatgtaataaattgcataattgaaaaaagaaaggtgattacaaaaacatggcttaaggggctaataactcctagaaagagcacaccaatgcataactgcttgagcattagaatactatatcttgaaaaaggcctgtagtgaaagtttgagttgaacccttaaaaggaaacatcacgctaaagttacctttatctctttgccaaaggaaagcggttgattgttgaaaagtggctgaagttgattgcatggtcagcctggccctaaagtacccttacaaatgagacagaaaatccagagttatatgccctccaactgagaaagcatatttattgacttgaagacatattagtttttcaggcatgcttagagatctactctctgttttccttaggtattattcattctatgtatcttcaagtcccgtaatttcccagacactctgcatactgtttgcccgtagtagatgtcacatgtaggtttgctgatagcattgattttgcatgggtttcagctcccgccaaaaggcagtcctttgagctcctctttagggagcataggtgtgcttttaactgtggtggcttcattagtcttggtcccttcaatgccgttagtggatttttaacagaaggaaactagcctgctcccttactctctgcagcacgggttcttatgcagtacatgtattcacatgggtcttatacataccacagcttttcaagggaatgaaatgtcaacgttaatccagaattggtgatatttgttcatatatgtaaaatgtagacatttctaatacaattatgtgggtctgtcaaagttactccttgaagtgacgtgtgtgagtagtgccatcgctttaagggtggcactcacaaaactggcagaggccatagatgtgcagcagacagtgaaggtttcacagctgtcacctcatcaggcctctactttgttagtccctccaacaaaccagagggaaactgtttatggagggcagagacgggactgattcatgaatcctggattccaatgaagatcatattgagtttgcggagtcgttcagtgattcaacttgcagaaactatcatgtagattttatttctccaaagcaatcattcctgttcacatttttaaaaaaatcaaaatctgagtcttacctgattggtacactttccttctactgtgaaagttgtgctttaagtaaaggcagcaatatcaaaacagtatgcaatttctactagcttaccagtgtagtcatgtttgtatggtcacccccatgccactgtcttcttctttttgatcatctgctctggattgtttgagagagcttgaaccaggctaaactaaagtgactcacagcactccctggtgtttctattgtgagtcggcgtcagaacttgtagaaccgcaaaaacatactcagatttcagttctccatgttcactttagagatcacatgagacactatatgttactgagtaaaagaaactgaatccatgccatggatccatatggcatgtggacagttaagagctgaactaggttggcatttgcagcaggggagttggaaaagtggcctgatcatacctagccagcaggtctctcggtgcagtgacaagacaatcaaattggcaggctttgagaactttcctctttcagcataaggagggaggggggcagagaggcagtgagaggcatttaactgtgctgatgtgactttttaaatttgttgccactgatgccacggacgttaattcttgcagggttaattatgagaaattaaaaagctgctctgaacagactgtacctttcacactctgataaagcaggctctgacatgagaacatctcttcattaatatccatccccaaagggctactacatgcagcatttggaatatgaatcttgaacttccagggacaatgcaggacaccatggagatagggttcagagaaggatgactatgcttcttttacattttcaggaaaacactgcagtgcctgcctggaaatcacctggctggtgacatttggaaaggataatttatttatttgcttgttggtatgttatgagttttgaaatatgattttaacttcatttcatgtagacctcactgcatcagggctctcagtgtctctgtgtaattcatgcaaacaccaacaggtaggcttgcagaagccttgtaattgtttaccatttagtatgtcacccaagtggctctagggtatgcatttgtttctcaggaaaatttcaccagctccttacactaggcacttttccaccagcctaatatattatactaaatagcaatcttgttacaccaaatacattgcagaaagtaaactgtgaaaaaataccagtataaatagtgcaactctaaggcagatgctggggaaaaaataaaagccttcctatacaatatgcttaatttgtattattgtaaccggaaaggccatgttttgaaggaaactcacctagaaatggaagtaggtaaaacagtcaaatgccgtagcagtgttacctttcagcaaagataaagccctattgttcaatggattgggaactgagagcggtcacagagcagctcttcatgttagagctctgttccagaactcaagtgtagttcccccttagtaagggcatctgctaatcattaccaccaaacacgcagttggaaagacattaaaatatactacctattttatactgcagagctggcagtgtgaacacagagcaattcttggatttgctggctctctgaggagctgacagccattggctgttagaaaaaacaaaatatgaaaatccatcaatatgtaattatctcttctcttttgtctgaagatcatattgctcaaagggatataataaggcacaacactgttattctgcctctgcattctgtttcatgcattttccttcctagtgagcgggcacctacctagaccttgcttctgatcgtccactaagagctatttgcatagccatagtctctacatgcttttaggcctccctccctttcttcctttttaatttctcaagcccctgagacatcagtggttctctatgagaagcatccttgcctctttatattcttagctaggaaatgggtgacaaaccccaatgttgcctcattcagtacctcagggcatcataccacatggaagtgttcttggtagcaccctagtggctttaagaaatacccacatacccttctagaagaacccaagaatcatgaggataagatagaaaggagcccaggggttgctaatttccaagacaaggagttgcctcatttgttgtatttgttttccttaggaaatgtttcctactcccaagacccagtaaaatgaatatttttcattatgatttcatagaggggtaaacatagatggggaaagaatcatatgtgcaaaataactggatcgtaactactcttgtggtttttccattcagaaaatacttgtacacagcaactcattggaggagggaggttgtggtttattatataatcctggtctgcaattttccttagatgcacaagatggttgtttctgtttctctttgaattacccgtgttgccctctgggtattatataaacgatgaacttgtatgttcattgaaacattaacaatcttcatccaaaatgtttggcataatttttcttcctcttgaactcattgcttttgctgtgctgctgtcattggtagtatcatccaaatataatattggacctaaatgccatcagcagacatgagccacagggaatagggccataggtcatcataatcatgtgaaatttcttgggcactgtttacatggaaggaacacttgactatatgtggaagcttgtctacaagtcagtcttctggcttaactctagggtaaagagttccaaagctctggaggcaggagacctaggttccaggcccagccctgctactgatttgttctgggcctttaagttaattaaccaacaagagcctcagtttctttctctccttcaggaatggagctaataatcatttctgctctgcttttgttactaagcatcaaatgaaatgctgtacaagtgctttagataccaaaaagtgccacgcatatgctggttattcttgtagtttgtatattattatctaagtccattatttaatggattccagccacaatcaactctttcaaggcatggactggatttattccatcattagcgaagaaatttccttttctgagagggccaagattacgttttgtgtaatcttgctttccatagaagtgaccactttcaagtactaattttacatgcacttgagcacttggcaaataaagtgaaacacttttttaaaaaacatcttttcttttggacaattgttgcaaaaccctgatatatcatttctcatcagggtaaggatatacactgttttcaactgcatttcttgttttcatcgaaaatgcagcccattcacaacttgttcctgtctaaggaaaaggcttgcactgctacatttcctcattagctctgcctaagacaaactcctgtgtcatggctgatggagcctttatgagctttttagccaaatgactgatgtttgcctcgttatgtcagatctgagggcactcctggcatctctctttattccctgtctaacaccatcaatcgagcagctgccatgcacccatgatcaggctgattatgaaaatgtgctcaggagcctgatgactccagttgttttttatctgaagaggccagtagatgctggctagagcttatagttatatgaacagcagattttgtcccaggattagcaggtgagaatcactggagctgagtccatagcagctaggtgagggccatgaaaactaacattggtttattatagaagaagctcctagaaggactggttttggccattttagtcattttcccatttatcccttagaagattattttggccttttcattttggtttcatgtcctagacaagtttattattctcatgaccatgggaagaaagctttttaaacccaaggcctgctataaaaaaaaaaaaaaaagtatatttttcataagtgcactttttaattaagataaatattttttatggggcacatcaaaatccagctgtaccttcatgaagtttccctgaatatatgatgacagcttttatttgctgctgaaattaaaagtgatctgtgaccttctctgatcctgagactgttactagcctggtagagtggtctgcaaatgatggggcttgggcttcattagggcactggcctactcctgtgagctagcttgatggggttaggccctgaggcacgtggcctttggatggagctcagctaagtgcctcatcagcagggagtcagctctataacctcccagctgagcccaggcaggatgaggttgaaacagcctattgttttttctcctctaggcttttttccttacccaaaagtagccctgtggcttttctctcttttctttcttacctagtctccctttgtatcaccttttacttggaaaaccagaaacctgtattataatttagttcagaacctcaggttgttctgaagtgtttgaaatagatcgctctgctgaccctggaggggagcccaggctgaccacaccaaaggacatcctcatgtgttcaggaaaacttggtgagactgtagctggatcttgatatgctaatttctagtcatttctgagaagctgtgcattctctaaaccagcaagttcttggggtgctcaaacaagtgaatgggggtaacaatttttatatttgcttaacactttttataattagtgtatcatggttgcgtttctagctactgacaaggagtctagaacatgggtgggagataaaatacaattcaaggccacctgggagtgaaagaggaagtttggcaaagaacgtaagttttgtaacccttgcctagtgttagaatcacccagagagggttgagaacaaacccatgtccagaatccacacctgaacagttaagtcagaatcacttggatggaccctgtataggaatgttttcaaagcttcccatgtgatttgagtgtgcatgcagccagagatgagaccactggtgtggtagaagaagcatgaacttctaagtcaaagatgggagtttgagccttgtcttatctctgtgccttattggtactgtggacttgggaaaaatcatctaacgtttctgtacctcaggatcttcatctgtaaaatgagaatcagagtaatagctgctatttattgagtgctttctttgtaccagctattgtgctgagcacattacatgcattcttgtttaatcttcacaaaacctcaaataatttgagagtactgtagttatctccattttacagatttagaaactgaagctcagagagtgtgaataatttgtccaggttgtatgaacaatcagcatggaaccagaacccttaccagctcatgtttactccagagtccaagcttttaaccatgattctagaaagaatgaccactaccaaaacaatttcttcacagggatatgaactaagtgagttaatatatgtttaaatactctgtaaactgtgcatggatatatgtgtggaagttgcatattagtagtggtaggagtaaaaagaataggctgggaatttcggtttatgaaacatcagagtcagttgaaaagctgtagacatgcaagcagaagtgagtgggatgcggctaagcatttgtgggctcttgtggctcggttagaattacaagacagcactttagaactgcttagcctgagctagtcaggacttactcgggtctggaatcaattcagaaatacatctggaacaccctcctgaggacctctttgccttttgtttatgtctactaaatttcaagttctttctcagtttacagaagtaacatcaggcacataattcatgttttaaaagaagagagaaagagacgtggttgtcatatgtgaattagctgctttgacttttttcaatagtggattgatcacatgcctctaatttaactcccttttaaaaccacaccaaaactacaataagggattttttttttttaaagaaactcaaaaggactggagatatgtgagaggaaataaccaaatttcagaagctggaaagcatttgagcaaatattagctgatttagcagatctggaaatccaaatcctagcagtgggaaagcttagaatcaatacagttcacactgcagaaccttcaaaaagccaaggaattggtgatagcagatatcccttgaagcaggagtgaagagggtataaaatatagaggattgattgaaagctgtgtaagaagttagatccccaattcctctccctcactcttactgctcttcctttccccagccttgcagaaaatggaactttattttttggagaggataaaacagaggtttgttgtcctggagtacttttctggaaacatggatttttagtgaacaaatgcatacaccaccagctacacacagggactgccagtttgcttccactagaatgctggcagcaaggattcactgtgacattccagaaaaaaagaagataaagagaaaattccacaagcctccagaaagaaggaagaagggaggaaggtaggagagagggagagaataggtatcatgcaatgggacagaatagctttggatttcacagcagcacttgaaactcaaagacaatcctgaaggaaaataacttccaccttaatatttctacttagccaaattatcgataaagtgggaagataggataaagacattttcagacactcaagatctcagagaaaaattgacctctaaccaagtttttctcagtaacctacagaggatgtatttgttcaccaaagagaaggaataaataaaaggagaggaaagcatgtctataggaaacaggagccataacacaggagagaggccaaaggagtctaccagacagtggtgaagagaatcccgatgtagagggcaaccagttgaggttgaagtaggtcagaaagctctgaatgaaatttatgaagaaaatgaaatagatagctaatgtgagtaaatgtattgacaggatttatgcagctagtagagagtttaaggttggattagtgatatgtgcatagaaaaatgaccaaacattaataaaaagccagtcatgatgattgactccaaaaagttgctcaggaaaggaaaatcctagtttagtacatggcttaggtctgaataacatataccatctaaaaattgcaaaaataaaaattgatctaactaaacttttgacgtaaatatgttgggaagatggagggatgacaagtattccagtatgtagtagggaagaggaaagcaagaaggtcaactaaatgctcattttccacagaaggaagtcaatagataatacctaaaaataaaaaaatagcaatccagtgtgttttttagagaaatgaaggcaaatgctccaagaataaaataaagttataagcaattgcttgttgagaagaaggaataatctaggggtgcagtggcagggctgggaactgctttgggtctttaagaagctttgataggtagttgactcttgaaatcatcatatgtatacatcaatttgataaaaatccctaacatctactgtgctctttggcaaatacaacaatgaaaactgccttgagatagaaaatgaaatgcacaaagtagtaatagaaactcctttccttggtgtaggagataagatatatatactcctactaagcaggtgatagttacaaaagaaagaaagaagtccaacagtaaagaagcaaagcctccatcaaacttttattttgaaggaaaaacaatcaaacaccaatgaaatgggctgtagtacatctgaaggaacaagagcgccgcccgcctccaaccacttcatggccacttgtgccctggtgtgactgcctagtcaaggggccagggaagctgcacaaagaccctttcatctagccaggtctctctccttaattgcttgcaaatccagtagagctaacccaaatacaataggtacttgagatgtagcctctgaaaagagcataaagtgggacgactatgttcccatctcctctgacagtaggaatcaggatttccctggaatttcccattagcctcactttttagtatttcagctctcccaattaggccaaatagtgatatgctgaatgctggggcagatcctaaatgtcagttagcgaggtttaatgaaagcaaagagctctgtgcacaggtaagtcatattaacagatatttgtagtcatttgcataattgatgtgactaaatagtttaatcaggagaatattggaaatatttgttacacttttagcctccttttgtattgctctaggataaaaactgtggagataactgaaagtattgactaactcctcaggggatgtgatatatcttttgacaatgaaaactcccaataaattctcagcactactaaggaacaactcaatggaccatgttaacacttcctgtctgtctgtcaccagacaaccaccaggggttactatagctaggctctctacagaaagggttatgacatctgctggggggcagatgaaggggtctggcttaccctattttctatggtgaagctacagttagttaatttgaaattaataatgccttagtggagtttaccaaaaacctctgcttgtggggccttgcaacaaagaggagaatgtttaagccgaaaaatgcttaatgtcttttaaaatctcaagtcgggctgctttgtgtgttaccctatgaaaggccctatgaggtggtggaggagctgaggagggcaaagaggggagtgtggtaatctcaaaaagcccagtgagctggacagcgatttcctttctctgtgccaggtaaaatcagcacaggagcccttaatcgcttgttgttctagggtattattaagtgaatacatttttcatggcccacctgctagtgtaactaattaacagccattctcattaattacattgatcaggatcataaaataatttcaaattgctgagcatgatccgcaggactaaaatggtttcactttaatcccttaatgattttttcatgattaatcaaacaaaatatatgtagttatttgatccacttttttcatcttagaactgcaactcagggcaattatagtcgacataaagttgatacaaacagaactacgtttcatgcagtagctaattaagcaataagacacaatggggtgagggtatatgattatcatgagataatcacccccctgaggagtcacagagcaaaaggtacagttgagtacctctgctcccacagggctgtgattaccttcgcataaccacatatcccgccggcgccttattgctaatcgcaaactcttcgttttacacggaaataaactgaggaaaaatgactttcatcataggaaatggctcgctgcggtataaaggtttcatctattaacagtgacaacattaatgcgtactttggaaggtgaaataatcaattatgctgttctcacatcatcaataggagttgggggattttaaattgatgtttatactttgaagagtacgtacatctggtagtttgggtgtatgaaattaagtatacaaatgctcatacatctaataattaatgtttgatttaattggaaaggtcttgcttttaaggtactagacatttttgaatgaaattataaaataatagtaaggcaactcatttccaaagtctaaaaaagagaaacaaatacatttgctaaattttggccataattcctcaaatcactgccagcattaaaactttcacgccatcttccagccagcaacaagatgtgaccaatgggaacacgaggccatttaggtgaaggagatagttctggctctgagacatggttcgtccccttccccctccccataaatgaataaaaaaaataaaacccaaacaaacaaaaacgaagtaaaatgaccaatatccttcctgtgccatggccaggtggcagggtgagaaggccctgcttcctagagtgccaccatcccaaggcactagcgttctcctatccttgcctgcacactgcatgccatgggaaaccagaattccttccaaccaccagacttagttacttcttcatctaggaacaataacggtgttagagcaggggtcacacaaaagaaaagcaaaataaacagataaaaacctactaccctttccagcaacttccaaacaatacagagtagagatagaatctaatggttgacaaacatacctttggctaccctggctgtgtagtgtttgcgtttaatgtcttgaacgatttcgttcttgttaactataaagagatcccttgtaaactttaatgatattaatcaactaaacttcccatttatcatgaaaaataactatgtatctgatttatgcctaaaacaatcagatttatttcatttcatgtttcccttctgtcgggctaaataattatggttttctcaaaagtggtttctttaaaactgtctttctctatgttaactctagaacggtaacagagtaggtaaatagttgttggctcttgaagaggttcatccaaatttgcccaagtttgtctcaaaattagaatgcctggtttagcatctgtggacttcctgaaggaaatgcaatcatgtgcttattgtgaccctgtgaaatgaatataagttgtgtcatatgcaggatgcattactgactttatgacatgcatgcattgaaaattgagtacgtcctatatataaaagcatccttcaatttcttatattatgtttttaaagtaagtcagttaacaatatgatgaattgaaaaatatatatgtaaaacaactggacatcagattcaggaattttccttaacatgttggtaagtgaagagctgtctttgaaaacaagagtctcactttaaccttgctaaacattcaattcaagccatatggcttgatcagtccaaacatttgacttgatgtggctctgcttggcatggggttctctaccatagagaagcagtttttgtggtcagcgttatgaatgaccaagactttgctgaaaaacaaaacaggcagaagatataggcaatcagtatgatcttgaaacattggcttcatattgagtctgctggtctctcagcttatctcgggttcacagcagcactcaagcttacattatgtattacgaagaggaaatgtcagttattaacttaagtagcataggtacgaattgtaaaagggcttttaaagtgccaaatgctggaaaaaggaaattaaatgtagttatttatgatagagctttagaaatacttagatttgttcttgaaagacctggcatttagattttaaatcatgttcagtcctcgaacttgaacaattcatgcaaaaataagaataaagacatcttcccctataatcatctaagtgcatgtatgtgtatttggccatgatttctgctcccccatcccccaaagcaatcaaccatcacaactttctccttcaataaaacataacactttcttctgtctggtgagttgaaatgatgacaggtgaaaaaattgacaagtgaaggacatttgtaaacctctttcaattgagatcaatttttggtttttgtgtatgtgtgactcttccacatttggtggatatcgtctagagagatctttgcacttgtgaacattgcaggtgttttgatctttccaagctaaggagacttggtagtcttgtgtggaatttagcaacacaataggtctttagatagatagtccacatggtttcaatgaagtgccatttaggaattgctcattggcccaaacaagtaggaggacagcttggcgagacagatggaaaaggctgctttaagaagggatcagaaaaggcattgctcctctgccggcctaaatccactaatctgatgttattattagcgataaggagcagtagccagaagaaaatctcattctctacaaatgtcatttaaataggactctgatattttctggtcaagtcgacgggcgttattcaaatactgagcactttatttgtaaatgcaagaaggaaagaaaagcttcagttcagcagtacttaggacgtcagcttactagtattgattaatcgttcagtagtggcagctgcttctttattaaatgtgcagctcaccatacaaaagatatcaggtgtaggaagtgtttgttgataattcacattttctcacaatgtggcagaacctactcttacttgttcaactactgttcttaggagttcacctccttccatctccagatgcctgccgcccccaaactccctgtgcctgctcccaagtcagttagtaggctgagcctcctccaagcaggcagtgactgcaacatttaaaaaacatatttggaaatattttaaaagtgtcccaagctaagtgtagagcaaatgcaaaggctctgaggtatgaatgagcttggcaagttgaagaaagagaaaggaggccagtcttggcaagaagagagtaattaagttggagagtggcatgaaatgatataaaagaagtagggaggacagatactgtagggcctggaaggccatggaaaggagttacatttcattctgagagcgtttcttttacatttctttttctttccttgtcattgttttgctctttgggaagatcttgctacttaagtactaatttcaattatagatgtagcacatatattgctaatgagtcatattctcagaattgtgaaactacttcttacttggggaatgaggcagcttaagaagctgaaagaattctttgagaccactagaggtactgtttagcaagttatctgcttcacagaaattgtaccccagcgagggcaaatattttctgaagttttctaaaatatctcacagtcggaggtgagtttacactttaggagagcctggcatctatgtaaatcgtcaatgaatttatcccaaattcacctttaagaaacaaaagtccagtaaaaaagctttctaactctttcccatcctttaagatcagttttaagttcatcttcctttagtattctccagctctttaaattttcttggcatttaacttcagtggccctcacttggcattcagtataaattaagtgtgcatgtattacaggcatatcttttttttctccctccaacgagaaagtaggaatttcttaaggttatatctttagtacctgaaatccatatattgtgaatttttgagaacaattattataaaagattttaagttccataaatcactaaaatgtcttataaatttcaatattttaatatcccagcgacaaactctatatgcctctttctgcaaacagcataaaaatgttttgttaaatcctatgtctccattcaataatggttttattgtgctcatcaggaaacatggccaatatattgattattcattcctcattaaataaatttcttttgagtcattactgtgtgctgcatattctggatacttgaggatacaataaataaccagaccaaacaacaagtgatactgttatgaattaaaaagccttggctactagagtaaggatgcatggggtaaagtgatggagtgagggcattacctttaacagggtgctcagaagaaggcttttcagaggaggtgccatttaaaaagagagcttggagaaaattgtcccatgctaagtgtatagcaaatgcaaaggctctgaggtatgaatgagcttggcaagttggagaaagagaaaggaggccagtattggcaagaaaagagtaattaagttggagagtggcatgaaatgaaataaaagaagaaggcggggacagatattgtacagcctggcaggccatgggaaagagttagatttcattctgagagcagtgggaagttgttggagaatttaagtcagacagtggcaagattcgatttatgttttattaataaaaatgtagtcctcttccatatggagaatggattggggggtgtgggattggagggggtgatagcggaggatgagagaagagttggatgtttattatggcagttttctaggtgagagttgattctgacttgggccagggtcatagaaatatagatggagagaaagggaatacattttggaggtaggtagatgaaatttgctcttggggttgagtgaacaaaacgaacgaagaaatgacttgagagtgattgttggggccatataacgagaagaggctgaagaacaggcaatgtagagtaacagttaagagctccaattttgccatggagcagccttggttttgatccttggacatattctctaagcttcattttcctaatctgtaaaaggtgaataatagtagccacttcaaaagttttttttttttttaaatggaatctgtaaggactaatgcaggtaaaatacttagcacagtgcatcataaataataaatgcttagtagataattacaaaggagtcttaggagagaaacaactttggaaattcatgtaagttattttttttaattacataactgatgggactttcccctcttccaatctgaagtttctgatttgacacattaaaaagtcaagaatgtgtctagtgagtcaagggtaatgtcagcagcacagctggctgtcttgaaagatttacctccacaaaccataagaaataacaatataggaaaagtaaattctacactaaaccaaattcttttaggataatttgaagacagacagtgccaaatgtgaaatcactatgtgtaaagaggaaaaaaaaatgtcaccaaatctcagtgtgtgatttcatgattcttccctgactctgctctgataaaagactttgcagtcagtaaggggcgactgagaaaaacttcaaaaagggttggtatgtgcagaattccctaagttcttctatgttgaaaacttttattttctcctatattggtatctgaataacagactggctagatataaaatctagccactttctttcattaggtggttttttttttttcccccatcattgccttggttttgaaaactctgatgccagtctaattcttttgtgttctgtagcttatttttattttagggggagactttgagatgtttatcatcatctttgaaattactagttttgccaccaaatgcattgagctgatcattcaggatactttctccagatgcagtgagccgtttcagtgggttgattcagatctttttctatttcaggaacattttcttttattataattttaattattagctcagttccagcatttttgttttttttttccagggaccccaataatataaatgtaaaataattgttttttgcctttcttccatttacaatacattatttctgcttctttttgattttcttatttatgtaattatcttggttatttttctatatttcttcaatgtctcttattaaatttcatttgaatctattctccctcgtgcactttgtaatttattctttattttttagataactttgtctatttcatttatttattgagtttcattacttacttttcatttattcctgggttttttggtacatctctaattttaggtttagatttctgagtcaaggcagattttcatatcttcaaatgcttttttaagaatattctttttgagtattttaaatctttttatgtgttggattatagttttcttgtactttgcaattgtttcttggaagatgggtttactcaactgaaatgtataaaatttcacttcctgtgccatgacacattcacaaaaattgattatatattaggtttcattgaaaacatgaatcatttttgtaaagtacaaatagtataatacaaataacactctccaattgcaatgcaataaattgagaaactgctaacaaaataaaaactagatggtcactttcatctagaaattttagtttattttttatttttattttttaagagacagggtcttgctctctcacccaggctaaagtgcagtggcacgctcatagctcactgcagccttgaattcctgggcttcagcagtcctcctaccttggcctctcaaagtgctggaagtaaaggcatgtgccactgcaaaaactcctgaatgagagaggacatgcaaattgaaattacagatttaaaaaaaaggaaaataaaacactacatataaaaatctatgagatgcatttaaagcaaagattagagagagattcatttcattgaacacttttaccaataaaaatgagagtggaaatcaatgggaaaatgcccagatcaaaatattagaaaaagaataacaaagtacaccaaaagaaagcaaaaagaaggaatttataaagacaaaatagaaaataatgaggtagagagcagaacaatagagcaaatctaatcaataaatcaaagttctgtgatttttaaattatgcaaataaactattagctaatttaatgaagaaaaagaagtagaaagaaaaactatacaaaataagatatgacaagagggaactatcctttagagaaaaataagttttcaaaaatcacaagtatttacttttcagatatccacatgaagttgaaaacctagataaaatcaataatttcctagagaaatacacattaccaagactgagcttacttgattttaaaagcttaaacagatcaatatccatgaaaggcatagagaaagttatgaatgaactacttcacaaaaaacaccaggccctgatgatttcacagttccaaaactactctgtgaatattacggttgagcaaactgtgaatatatgttatttgaataacatattaatatatgtgaatatacgataatgagcttaggtttctcactgttggaaaaaggagttacaaataagcaaagggggaagtccagattgaaacttgtgttggattgtaattggaggtatcagtatgaactcatgtttgataggtggtagataaatagatataaacatgtatacattcccattatttcctagcttggtttgctgagagagcctagaagtaatgacatcctcatagcaataagcacaccttgcacccagatcttaatttctaaataccatactctgataagtgaaatcagggcctcttggtgaagtaattgagtccggcactggggccagaaaactgtaaactaaacctataatatcttgtgatgctagaaataaggaagtgttgacaaacgatcaaggtgtcaaaaggacaaagaacacaggagccagcacaaaagagcatccaatggtcaaatcatggacaatttagataactaaataagcagtgatagtaacgggttatgatccatagaatgaaataaatatccatgagttcatactgctatgaattaatgagtgagtgaatgaatgaaataccaagtcaccattagtgaaagaccactctgtaattatcgcaggcaagttcaaacaatgaatatcaaaatctatggatgaatatttgaggagaaacagggtgttagcatagtctgaaaatatctcccccaaatttagaccagttaaaaagggaaaaagagtaactttaacaactaagattattgacatcttgaactctctgatgtgatgcactgagaaaagtatgataactacaatattacttctgtgatatttgcccaaaggcataactccacatataatcatgataaaacctaggatacacacaaattgaggaaacttttacaaaataaattaccaggattcataaaaagtctcatgatcatgaaagatgaagaaagatgaggaattaattgtcacagattgtaggaaaccaaggagacacaactaaatgcaatgtagaatccaagataggattctgtacagaaagaaggacattagaggaaaatcttttgaaatcgaaaagagtattgtagtttagttcattgtgttttattaatgttgatttcctttttttgataattcaattaaggtaatataagttgctaacactaaggaaaggtagtcagagaagacacctaaattctctgtattaaagtctaaaattctttcaaaataattaaaaaaaaaaagtcaagtcagccttgtggatagatttgtaaaattttctaaacccaacctgctttttagtagcctgcatattttctatggtgtttccaagccttgtagatgctatagcatgtgaatgctatatgccagatttttcagtttctataccatacaggaattaccaattttcaaacgatcacttagaactaaaactagattgtatgtaattgaatctttgacgattcagtaggcacttcaggactttgcaatacctctggatcatgattataaacgtcaaattatggttgtacagcataggagactcacacagaagtgccaattaacagagattcctggttgagacaatgacacataaatgagtgttttcctaattcaggcctgaattagtcaaagtgaaataaggaacttgctctctttttttaaagcatttactctaaactcacttgagcttgtttctgggcattacacagctctcttgctctaaggcaattataagaaattggcttcgtgtgccatgcaacatgtttagggtcatagacgacaagatgtaaagcaagaaaattgagaccttactataggctgagtacttcaagatgaggaaacagaatctcataaaggtaaagtaactggctcccatgctcactaagctagtaaaagctcttgcccaaatcttccagattccgaaactcaggttccttgaattatccaagactgtctttagaatagagatataaaattatttgagaatttggcctgtgatgttgttttgctgtgtccccacccaaatctcatcttgaatagtagatcccataatccccatgtgtcatgggagggacccggttggaggtaatttaatcataggggtgagttttccagtgctgttttcgtgatagtgaataagtcttacaagatctcatggttttataaagggcagttcccctgcacacacactcttgcctgccaccatgtaagatgtgcctttgctcctccttcccctttcaccatgattatgaggcctccccagccatgtggaactgtgagtccattaaacctctttttctttagaaattacccagtatcgagtatttcttcatagcagtatgaaaatggactaatacagtctatctacattagagggcaacatcaaaggggcacacaaccactctatataaatcctgcaggaataccatttctctcatcatttgaagatttgtatcaattagtttatgacaaggaaacttgattttatatttaattataaggaaaaaaatctcttttaaaaatggttctacaaatctatctggtttcttttttttagagaagctatatactggtaatgtgcctggcaggccattgctatctcatcagaccaagaagagggtttggactcccaatgttgcctatttgccatgtgcagcttttcaacagaataatacaatgagtattctgagaagttgatgataccttgccatattcagaactgctgctaaaagggaatatttaatataccatgcaaagaggcaattgtgttttggaaactagaagtcagtgtagagctataatctagttttgttgcacttaccgaggtccaggatagaatatgacccttgagagtagggtgttctgtaaaaagggacaaaaaagccatggtctggtattggattatatagttttgggagatgtattccaggacttacagcactggttttgacataccccattgtgtcaacaattttttttccaaatggctttatgaagctatcataaggtcctcaaagcaaaattaatttgaattagcatacacacagtcacgtaactatacagtacttccataaagaaatgggaaagatgtcatgaaatctaagaagcacagatgtggaattgcatcttcagaatccatggaaaactctggctacctggtgacttttgtgtagttgcttggctctggaggaagctaaggcttgtattctttattggtaggggagtcagtggaatactttattttaattaattaattaatttttagggacagggtctcactctgtcaccctagctggagtgcagtggcgtgattgtaggtcactgtaacctcagacttagccatcctcccactccagcctcccaagtagttagaactacaggcatgcactactcatgcccgcatgccagctagttaaaaaaaaaaaaattgatagagacggggtctcaccatgttacctgggctaggtgaaatattttaaacacttcctcagacatctccaaagtctacattttacattcttgtcctgaaatccaatcttagtttctaatggcgtatatgtgtaaagatgcttttaacaacacgaatgtttagtgtggcatagaaagtccttgagccaaatcctgccttcaatgtgcacttaagtttccattaaaggagagtggcaactgagcttatagagctgagggtaacatttgaattcttttataagaaatcagagtactaggaactaggatattgaatttcacttttacccatgctgacattgactttcctctggagcatcaccaactagtgagatctagttcagttgcatgattttttgtttttcttcagtgaccaaaatccagagatacaaatccagggcttagggggctcgcatatagatttgccatattgctgagggtctgtgagagcttaatcactttcatattttatttataaagcaaatgttccatgacattgaaacattaaatgtattatactcagtcatgtgcaatgtataattttctaaaatctctgattaatttaatatgggtgattttcattctttgatatgtggccttggtgtaatttataacaagctataaatatttgaaatgccatggaaatgtggtttgaggaatagtattaacacctgccttctgttctagttgggttatattaagttctgaatgtacatgggtatgtttctgggatattatttgagctgtggtctgtctgtgtgtgtagtgactggctgaattaaaaggggttctcactattttcttagcttttgatctgaaaccaagtctaattttgggagttttatagcagcattccttttctgtactttgtaattccttgtagaagcagaaatgccaaagtactttgcatgctaactcctctccttcttactccacacacccttcccaactcagtatgtgcgttataaccaggaaataaataacacaatccctgttaaagcctgtaccctgagacacacacattggatatggtcctggtgacattcttcctgtcatggtatggctcagccaacctgcccagggaactacaaggattgtcttgaaatctgatcccttcctgcttccttggcaaggcagttgaaaggggcagcctctgagcaaagtggcctaagctttgcccctcccacatccatcttgttcttaggaagggaaagagtgagtgcaaagcagagcctgtgaaagcttttggctttccctgagcacttcctggtctccactactgagtaatctgaacctcatgaacctcacttcccttatctgtcaatgatgggtgataatagtgcttatctcataggatcgttttaagaattaggaattgcccatgtgaagagagagaggggggtggaagagtgagagcactcatgcacacttggtacacagtatgggtgcattgttattatcgctgtagttctttcccctactattaataattctaactgtaaatgacttggtattgagtcacaggtggtgaaactacctgtttgttgctcacttggcagttaacggccaatccagtaacagaatgtgggattcctgactcctactttggggtttattctacccgatcatgatgctctttgccctcttagtattccatatttaatgatatctatgtttttgtgcatttcctttcaaaacgataaaaaccaaagtgaagcaaaacagaaaacaaatattcttgcaaataacatttagtgagggcagaggaaattgtacttcccttttctgtttctccccctttcattctgagtgagccatagtattacacgtaaaagttgtgtagctgcatcttttttcttctacaagatgagtgatttattatttatggaattggcttgggatttatttatgcaagtgaacttctgccattccaactgcatttccagtgggtaatgtgcctggagagttgtgggggttggtgatcaggccgctgctacaatctggcatttgggaaatggcatcaggttatctccacttagtgacattgggctcaactgatcttatcagcctttccaaagactgctgtgtaatagttgagggtgagaataaaatatgttttaaaatatattttatttctctatataggcatcacaatccctttaaaaggtattcagggagcttgttaaatgggaaataaagctaaggaggaaacaacactgaatgaattatattagttgacattgaaagcagtaacttattaaaataatgctttataattattttacttagcccaatgtttttcaaatattgctctgtcttcccagtattcctagcagagacatgaaaaacaggcccatttatcaactatatgatgtgacggttaaatggaaagttgggctagattttcacttgtgtgaatttgcaccctggaagttggacattcatgatcaagtggtctggcaggtaggggaagccctgggtgaatggttgttgatttaggcagtgagatatttggaaggtaagctttctttggagaagctggctttgctgtcttgtctccaatttgttgaaattaaacactacattcagatagtatggtctaatggttacagtaatgtttgtgaagatgagaaatgtatttgtatacacataagatatattagtttcccatggctgctgtaacaaatcatcacacacttagtggcttaacacaacacaaatttattttcccacagtcctggagttcagaaatctaaaatgggttagcagggttacattccttctggaggctctaggggaaaatccatgacagcaacccctacccagtacgttcccaaactcatcttcctttgcttccttaaaattgctctttcttcagacagactgggacaatcactgtgccctgagtgggctggttggactcctatctctgagccttacatagtctccattctccatcttgggaggctccagtttcaactcctccatgaagccttgcttgcccactccagccttcaagaatttctcctttccctgaacccacccgtagtgggcccagccactcatttggcagttgttagggagtgtctaaatcagttaattgtctttatatgtcaatgggtcttatttttccaaataattataatcttgagatctggggccattccttgcacatttgcatgctttccactcagcatttagtacctagtaagccttaaatacatatttcttgataacagcatgtgtgaatagggattaactttgcagggcttttgttctgggatttattttcctgtgctattaatcaggcacttcatgccatttaaatttattgacctttaatttcttaggaaaccccctcagtctaccatagagaattatgtactgactcattttcatgactgtgaaactatatgaaagttcatgtaagttttgtggtaagctatacaccatttatagttctgacaatagcgacttttcctaagcctccgtccatgtatcagactaggcctatttaaagagagttcttatctatggagatttttcctccctgcttaagatgtctgaaacctctattaacaaagccctctcttcttgtgcattatacttgtaaggcataatctttgtaatttcctccaaggatttcctcaatatgaaagagtaaactgttttaccaaagctattgaatatacattgcttttctaatagggtattttccacctgatactgctgttgctgctgccaaactaagaaatatatgcaaccacgttagcaaatgaacatgcttctaaaaacagacactgcatatgtgggaaaaacatttctagagacttacaaggttaaaaggagacatgatcaccagaccaatcctaggtttgtggcttatgtaagacctggttggtaagctggttattgtccttgtggcagcccagtaactggaagaaacaacatgctagctaaggccagacattttgtacaagagaattttctgattagtacgaaaagataaccaatgtgcaaatatttgtgatccaattggtgaaatttcccaagtgcttttgagaccttggagaatgtggccttcatgaagtcattctttggttctctctttccccctttttgaaacttggctcttgaaaaggagggggagggaaaaaggaggtggtcaatcttttagagaagttagaaaataatcactgtagttgtgtcaaagctgccctttgagactataataatgatcacatcatagattttaaggcagtctttcactcacagtttctaaattggagaggctttttccaggagactcaatagtgaccataaggattgttgttaggcttcattatggcctgcttccattttacatcccctaatatattaggccatagaaatcagaagtgtgaattcagcctttcatttatcattgtacctccccacttatcgttaaatccttaattttgaaggctcaagtggcctattgtgctggcaattagccaattgcaggtgcaaaatcttgatggcatccacagggaggccttggtgggaattgtctgaagaaatggatccgtctttatgcacttggatgcagaatttgtgaggggatgagtgtaaagaatattaaatgcataacagatgacatcccaggaaagaattgcaagtgaaaatgaatgtgaaattgcttgtctacggattgatcttctttgattaggcaaaaaaaagacccttcactctaagccctttacaatagaaatacccaggatacagtgggaatggagacatttagatgtatactccattgccatctgcctaaagagttcaataatggggtggccttcaatgcctttctgtctccattcaataccaaggcaaaatgttcgggcttggaatgtgagccccagcacaatttaacccccagctttatctcccatcacatgccctcatgagccctgtgctatagtctcctgttgtcatctgagccatatctctctctctctctttgaaattcctttccctgctttatatactctaactgatctgtaaagatgcacatcaggtcctcatcacttctgagaaacatttccaggtcattctagccgaagataaaatctttatccaccacattcctgctgcactctgtatctctgtttttgtacttagccgtgaattagagtgatttatgtctcattgatgtgtgtactcctgtaaaacctagcttggtgctttggcaccggttcattaaattaataacaactgtatatccagtttaggaaaaacttgacataagaaaatccgagcacattcttctaaataagatatgtaagaattggcaactcattaacaacttaatggagaggctagggggaccatcagagatggagagctcaattgttaggataaactatcagttgatgcaattagaaatggagacaaaccatttttaaaactataatcaaagagaaagtgggaagtgactgatgatagcttaatttacacacaattttgtgtatctacaagctttgctttatttttattttttagctacacctttctgaaatttcttgcattgttgtaggtggaaagctgaattggccctttgaatgagagcaatgtctgctaatgccatttatgaatctaatgctagaggccagattgaagaaatgagacacagtattctattttcaaccacctggaggtgtgatccctgcttggcaaggtgaacatagatgagatgcacttttacctcatcctagccagcaggatttggaaagaccaaccatcagagtcagcagattcaaaactactatagcaggccgcctcctccatgtcttttcctccctccttccctccctctttccctccctcccttctctttcttttccttccttcctttctttctttctctctctctctttctttcttccttccttcctttccttttcttccttctttccttctttcttttctttctttctttctttctttctttctttctttctttccttcttttctttctttctttctttctttctttctttctttctttctttctttctttcttcctttctctctctctctctctcgctctcttcctcatctttcttttctgcctttcttcctccctttccttctttctttttcacccttatgtttctttacaggcaaagataaaggacaaatcagttttccttaatgaataaatgactctatgcaagagaaagggggaatgatcatttaataactttacattatttccccacacctcccttatttctttagtcccaaagtgaacgtaaatttctgttggctggtataattttttgcctggctccaaaatgttgtcatcaattcttgaaggtttgcagcaagtttatatgtcttttgtcatccagcacaattcatgcctgctttttcctcctgtgacttccatactagggaggattaaagcccattttagcctaagcaaaacaaagtgaagagggtaaaatatgcagcatgcagaatcaagaaatgcaacaatgcactgagaagccaagggcttactctcctcagctaatgcaccatttcaagtctctgtcactggccttcttgcacatagaaggtatgtgataactttgaaagagatcgaatggaattttacattgacagtgtcgttttggtggtttaaagtttagatggagttgtcaaaccattatcgtggctctgcatcataatctctaaaagaaaattactgtatgtgaaattaaaatgaatagtttctgattttcccatctcttttctattcgtgcctttagggggcctttaaggactagaaggcagaatattatgaaaggagatagatatatttattctactcatgagaaggcccaatgctcttggctttgccgcctgtgaatcatcatgtctttcctcccttgaaggataaatatggcattcattccaacccatttagcccattattcttttgtatataaaataggtccaattaagacattcttgtgttaatttctgcattctatgtatgggtagaaagaatttaaaaatatccatcacagcaaatgtctcaaaatgtttcatgcatactgagcataccactcttgcccccctccccaacccaaaggcaataattcacccaatcatggagatttgtgattttgtgttttccacttacctacattaaggctctgtgtatgcacaattcaatatttagatgaagccatatatttgtaaatatctggtgtttttactaaaagttttcatttttatccagatgtctgacatcatagaaaatcagtctaagaatctactctttatatgttaactcattcatggttattcaagcatacaaacagaaagagacatgcttaccttgttcttgtctgcatcccctgcccctcctcaatgagcgagggggtgggatcatcatgttctgaagtgtctaactgaaatttcattatgtgtcttccactggtcatggaaattcattagacaagccactctgggctttaatcttccatttactagccgtatgatcttgggaaagtcattgaacttctctttgcagctggcttctttaactcataaaaatgaaaagaacccagggaagagttgggatcttataattgccaaggcaccattgcaacccaaagttctgtgaatttctttacttctaccttgtatgaaaattaacagttgatgaatattattgtgccagtgtcccttgtgttataatttagcgtactttgaggtgatgttgacatcttgtgtgtaagttggtatacaataaccaaaaacattgttttcaaaatttaaaataaaaggacaacattttcttttttttttaaattttattattattatactttaagttttagggtacatgtgcacaacgtgaaggtttgttacatatgtgtacatgtgccatgttggtgtgctgcacccattaactcgtcatttacattacatatatctcctaatgctatccctccccccttcccccaccccacaacagtccccggtgtgtgatgttccccttcctgtgcccatgtgttctcattgttcaattcccacctatgagtgagaacatgcggtgtttggttttttgtccttgcgacagtttgctgagaatgatggtttccagcttcatccatgtccctacaaaggacatgaactcatcattttttatggctgcatagtattccatggtgtatatgtgccacattttcttaatccagtctatcgttgttggacatttaggttagttccaagtctttgctattgtgaataatgccacaataaacatacgtgtgcatgtgtctttatagcagcatgatttatagtcctttgggtatatacccagtaatgggatggctgggtcaaatggtatttctagttctagatccttgaggaatcgccacactgacctccacaatggttgaactagttgacagtcccaccaacagtgtaaaagtgttcctatttctccacatcctctccagcacctgttgtttcctgactttttaatgatcgccattctaaccggtgtgagatggtatctcattgtggttttgatttgcatttctctgatggccagtgatgatgagcattttttcatgtgttttttggctgcataaatgtcttgttttgaaagtgtctgttcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaatttagttgaattagatcccatttgtcaattttggcttttgttgccattgcttttggtgttttagacatgaagtccttgcccatgcaaagaccccttgaatgttgagtgttgcgtgttgatgcaattcacactcgccttatgtttactccttgtaaaatctttcttgtgtatacctgttcgatagaatcagcgtgtaagaagctcatacaaaatatgtatcctcaagatcgtgtaatatttggttactaaaaagattcactgccagaagagatacaacaaagttcctctgaattatgaagtaaaactttgatttaaaaaatgttgctttccattgaaaggtatctttccacaagggagaacatgatgatagatctttacacaggagtgacatccagggagagcatttagggtatatatacaatgaaccttacttattttctctttctctctctctgagtgtatctgtacatttatatttatgtgtgtatatatttatgtatgaatatctatagtttatattattagaagatgaaagttatttataacctgaattatgttatttctgtgactaactctttaaaagttctaaatatctgtttgagtcattaaaaaaaatcttattttcttacctaagggacagttgaggtttatagcctgtgttagtctgttatcatgttgctataaagaactgcccaagattgggtaattcataaaggaaagaggtttaattgtctcacagttcacagggctgaggaggcctcaggaaacatacagtcatggtggaaagggaaacaaacacatccttcttcacatggtggcaggaaggagaagtgccgaccaaagggggaaaagcttcttataaaaccatcagattttgtgagaactcactcactatcacaagaacagcatgggagtaactgcccccatgattcaattatctccacctggtcctgaccttgacacatggggattattataattgaaggtgagatttgggtgggacacagagccaagccatatcatagccttgagattgaatggatctaatttaaaaaaaataccatttcattcctttacaaatattttgctttatgatgacatcagcagaaattgatacaaggtggatttttataagagggcttcatgttagctgggacagtttatttaggcatggttatcattttcttatgaaggaaacagattgaccaaagggattctgctattcgtagaagtgagcaagtactgaacagggataaatttctagtcaaaatggatgcctactgaacaagacttttggtactgaaagagtattatgttgcaccttttgtcttgctcatgaccctagaccccactgcctgataaccaccagaaggaaagaactccctatgccactgagtgaagttatgatgcaacctgtccagaggccaaagaatattaaatgagaacacccaaggacaccagaaaaaatgagataaacattcttttcttcctgtttcttcctcagcttcttatattctattttccttcactatgacctattattcatcttcaaaatccctcaaactggcagttttgaaggattccacatgtagccttgcatacaatccctcatggctttcataaagaccgtgtcatttgtcctgcatgagtccctcctgacctctcttatcctggggctacagactttctccaagatagctcaggtgctaatgtcagcaaaacaaagctgataatgatcggtactgtgtgtgggagtgcagtctgactattgaaacagcactagaacaaggactttggaccaaatacatagctgagcccagaggttgcattataaaaatgaaatccctcaacttccttcctgcacacacttcacctcattttgctggatggctccaatgtaattgatgaacatattctttaccagagctgttaacaaatagattgagaaaaagtgggtttcatcttttattcctgttattaatcttccaaaagttggtaagatgtccagaagatgagagatagttggaagatggaatgctgcattaatttaagacctctgtgttgatagaatattccagatatgccttctgtaaacaactgtatgggaaagatttatcatagtccatgtatctgaactcccagttgcataagctacatacagaagtcaaacggatgatatgtacccaaatatataacaacagtttttctccatcttgcctccctagaggactttcccaaaccacagtcttgatgactgctatttcacactttggctatgtgattttatgagttctgtgtgatctaccagcatatttttgtttgctttagcaattttaccaagaaatacataattgagattattgtcctgacaaagcattttcatcagtgtgattagaaatacataattttgaagagtgacagtaattgccaccccaatgtgtatgcacttttgaggttagctcagagggactaagtccttagaatgtcgataacatgagcgtgcagatgtagtcagcattgtcaaactccggagttcagtctcaacagaactgtcaccaggactagagtcacaggtgtcagtttttcttagggaagagtgtcttgggccattggttgcataaagtaaggcttgtctctcattgttactcagtagtctagtaagtgatgttcttaggaagtccatactttgtggtttgtggctagcaaatgtgaagggaatgagttaggtggcaggggagctgtgtttgtaataaagattgttttcatttttccaataactcttcaccttcgtaccattgttattcatactatgtgccttagaactcccaaaatgtaaggtaaggacctttaaaaatatatcttaattcattcattttagagaaactgaaatgtacaaattagtgcattttatctctgctggttaatttctgaatccttcattatgccctgggttcaattaaaaaatatatatatatatattgttcttctagtgatttttgggttgtaatatagactgatcttactctggaaaagacattctcatcagaagacctggattccaggctctctaatactaattttgagcatgctttgtgattttgagcaagtctttttacgtatccctaccttatcttagctactcctccctactgggacttttatttttcctctaggagatttctggaacttgttgcctccaaaggaaaagcagtgcctctttaactctgatttttagcaattgtagtaaccacccatttcatgaaaaccttttatcagagctgccaactcataccataaaggatggattcacatttttcaactcttctattttctggtctgccctttgttggtgatttcaatgagtatcaaaatagaatccttgcacaagtaacataactctcagatagcaaaatgatgatagaaagcactctcaaaggagagctgtgcaaggcagtgaatgctttatgagccaaacaagcacctgagtttggaagagacgattccagggagctgtcctggtctagctgccatagcagaagtgatggcaggagctaaggacataccaatttttatgctttcctgaatcatgggatctgtgattagagcaagagcccttttattggacgagcttgggacaagttattggttggctaatcaaaaagtcatttcaagcaaggaattatttagaaattttaacatataaagcattttgttttaatgtgtataatatatatattcattttctaatttttggtggtcttttttggagtattggatgacttattgaagttccatgttgacttttttttgtataaaccacaccctttatccatttccagtttaagtttctttgaagtggaacagggcttacaggcacttgggaaatgatctcagcagttttttagtgatacattttaatcaagtttctctagatattcagctgagtttttatagaaacagtaagtctgtttttcactcatatttagtcagtttatcttatatttgtttcaattatgtaatcataataacaactacaattggcataaactctcctgtggtgagaacgcaactcaactaacaagaacattgtgtttcaggcactctattgaagagcccattagctgtggatatttagctttttttgagtaaaatgtgttaggatcatccattcatttatttattatatttagtgagctacctactatgtgccaggtactctgctaggtgctgggaacatattggtgatgcaataaaatgccactgaccaggagcttacattctagtgggtgagtcagaaagtaaacaagtaaatatagctatagaggtttgtcctatttactttagtctattatgcatgatttgcaattactaaattatgatgttaacatgtcaagagcattaggactatactgctaatttaaccttgttactttaacattgtcaattgtttacttgaaatccagcacctgagtgattgaaaagtttcatattctcaagcctgaaagagtcaaagtgaagtggggcatttttgtcatgtgatacctcctgatgcttataaagtagatgcaaacagcagttgaggcagccctttgcgaaagctctgacaatgatttctattattcagtgcacatgggttgagctgtagtagtcagggtccttcagaaaaagagaaccagtaggagacagtgtagtgtaggtaaatagagggagagagaattttactttaagggattgacacacaaaattgtgggagttggcacatctgaagtctgtagggaagccaagaggctggaaattcaggtaagagttgatgttgcagtccggaggcagaacttctttcctgggaaaccttagcccttgcttgtgacaccttcaactgattggatgagatccacccacattatggaaggttgacttgacttaaagtcaacttgttgtgaacattaatcacatctacaaaatcccttcccagcaacacctaaactggttttgaccagctgactggggaccatagcctggccaacttgatatctgcagtttaccatcacaagcacctactctataggtgcagcgctcagtgctgggagctgacaggctcagtttctatgctcaagagctctaagtcaagactgtctgccttgagtatcagaaccctacaatgtagtagggagtcaattgctattgtctcttgcgatgtagtcccaggccaacctgtgccagatttctggcataggctgtttgcctattcctgccactctccttcccatgccacgttctcattcacttactccttgaactcagcatattatttggtagccatggttgtatagtattttaactgagttgtcactaaccttttactccaactacactgtaagctcttcagggacattatgtgtttgcatcctggcaaggaggctgatgaagatgaagcaggggcttggtagaaacaattcaggtgcagtgtgttgccattgattctagtaggaattgcccagagattaagaaataaaaataaaaagtcatcagattagttctaaaggttataaagatggtatcatataatataaagaaatccacatgctgtatttttctgggcaaaccattgctctttgctgacccttagttttctcatatgtaaatgaaagggacagatgaagtgttctctttgctctaaaagccagtgattttaattgacttccatgcagaagaccatgagtgttatttagtattgaaagaatggcaaacatttgttttttctaaacctttgaaaggcttagagctggaaagaaattgttctttttaagatctgtgtgaattggtgtgccttaaaaaagtgaaatgatgtgtttgtatctcccattccactgtgcctagcttagtgcctggcaccaaggaggtgcatattaatgtttgcagaaactgactgagagaagaacttaaatattggagggtttattttagtcctaatattttatgtgaatgtattatcacttccattatatagttcatatatatgtcccactcaaacatttgaatatatatatatatatatatttaacttggtctagaatttaaaccacttcaaatcatatgaggaacaagaagagttatgttaataaatatataggtaataaaaataaaaataaacagataatctgtttgcatggaagactcgtgtaggtattatgtattaacataaaataaccacagagtttcaaactgcatcaagctagaaaagcaactccagattcatagtcccaagtgtgagcctctcctatcccagttcttttgaaaatttctgcctctttcaacgtgaggtttcataatttggccaacacatgtgcctttaaagcctacagggttggtagaaggtctgtgataagctggcagttttgttattcagatagtgattttgtcactgcaatttgacaaaaactacacatctaatttaatttttaagatgtttctaaaccagtagctctagacatagcaagctaatgtcaaataacataggcttattttgtaagggccaagtcttgaaatttctgacttagtgggcaattttgaagtgtcgaataatgcatcttctcacagttaagctgctttgaatcagcagaggttttgcagtccgcagtcccttccccatcaccacgtctaacctcgtcaccagccactttttattctgaactcctctcctttagcacctaattttgtcattctgtatacacaaaactataatgatctgggttaaaatgtgtttgattccaacataacttaaaaaaagctttctcaggatgtatcagcattgaagttgctcccatcttttaaagcaatgcagccatattaccggcattattttactttgtatacctgcttcaatatatatcttatattgcctgtgcagatatttaacttgctgatcatagcaaaatgagtttcaattgatttatgtatattttttctttatgtatagatatacttcttattgaacaatgataatcagaaggaaaataagactagattgttgaaaatcaatgtaattagtgttgatttctctttacatttctttttgtttacatatcattagtatttataaagctaaaataatattcacagttactttcaatataagagaaatcactactgcccaaaactagactatagggcacccaaaatccagatgggaagtaaaatttctgtcacatgtccaattttcccccaaatggtaacagtcctttttatacttgcacatcatctgcatcctaaacatgtattcagaaacattgatgcgtctaagaatggagttataacaattgtccgaggatgtctggaatttagtttgtacttagcccatagcaaaatgcaagtgaacataagaaaaccacttccaacattttgagtctctagttatgagctccattttctccattgttctttttttttgcatgctaattagatgagtttgtctcttgtgaatctatctctgcaggcttctgtaccatttccttgtgtctatgagggacctgtcactcttcactgacttcatcttaataatttgctttccctgggggccttgcttgtccacagggattagctactccaaagaagggatacctaacttgaggctctaagctcagcagccaggccctgtcaatagctgtgaataactgacttctgggcattcagctgcacatgagcttccagaggtgcaagattgatgtgtcccctgctggcttagcatgctggcctgtcctgagactaacgtgacttgtagaactgttaccttgtcactgacagatttgcttagtggtgctgacttttggccccttactcctcccgccaaagcaaaggtcagtgcagcaaaagacatcttcaaaggacaggagagtggtcactctttccagtcagaaagagcatgtagctcagtcagcctcattatcagtcgcatctggcctcccaccaattagaggacacttcatttagtgatctagtgctgcctgtcccttcctcctctggactggatggacatcagaaacttcagatgccagttacctttctttcatttctctagtcttattaatgtgttactttaaaaaagtcacactttctttcctccatcagaaaaatgtctttgttcctaaagatagaggatccttcagccattctaacttagaagggaaaggtaaaatgcattagttcaatttaagcaccaaagactgttatcaccaatgacctgtttaagcagggtgtatcatggggattaatgacagactcaagggagctgatgacccacagccaaaccaaaaggccattaactcccatcagttatttaattcctggggaaaacccgtttggaggtaattattgctgttataaactggacaaaaaacagaggtgcacgagttatattaatgaaccctgatcattttattttataatgttaatccaataaaaaagtaaatggttttaaaaatttgagtttcactttttaatttctaaggaaatgctcctttggaaaaattggtggtgccaagagaggcccagcagtttggtggactctccccctattctgtcttcaattcttaatctcagacatgctgaactaaagagacatggatgtcgggtggtattgtcttagagcagcatctctctaccatttactctttgtggttatttgtgttaatatttagccagacaggccttctgcttgccagcttgcacccaagtcattttactctcctggtgcgagttcaggtctcttcttcactccctcctctactcccacctttgtcaaccatatttggcaagaatgtactatgtccaaggtgctgtgttctattgggtgtaggtgacatggatgcatatttgatattaaagacaaagaggttagatgataggatttctgagatgaaagggggtgcattagtttcctaggatggctgtaacaaactgccacaaacttggtgtctttaacaatggttatatttttttcttacagttctggaggccaaaagtctaaaatcaaggtgtccagggccacactagctctgaaagttttaggaaagaattcttccttgcttcttccagcttctcatggtcccaggcattccttggcttttggctgcattactccaatctttgtctccatcttcacatggccttctctgtgtctccaatctccctctcctttctctcgtaagggcacaagtcaatggatttaggacccaccctaaattcagaatgatttcatcttgagattcttaatttaatgcggtgctaaataccccattttcaaataagttcacattcacgggttctgggtgaacatatattttggagatcactattcaaaatactataagactgggcatagtggttcatgcctgtaatctcagtgctttgggagactaaggcaggagattgcttgaggccaggagtttgagaccagcctgagcaatctagcactccatctccacaaaaataaaaaataaaaaaatagctagacatggtgtcatgcacctgtagtcctagctactccagagactgatgttggggaattacttgagcccaggaatttgaggctccagtgagctataccatgatcccgccattgcactccaacctgggtgacagagcaagattccatttctgaaaacaaaaacaaaaagccaaatgctacaggaagcaaattccaggcaggatcattagagaagacttaatagaagaagtaacctttacatgtagacatgtagaagaaacgtttttcgaggtggagagaatatcatgaggtcagagacacaagacaaaggagggattgtggcaaggatggagttgcagaaggattgaatgggggtcagcttgcccaggcacagaatgtagaggacagaggagtgaggggcaaatttaggagatgggcatgggccatattgtaaccattggcctgggaaagactgaacactgtaaaataagacaggagactttagaaatgcttataagagaaaggtaatgaaaacagggcagtagcaatatcaattgataggaaggactggattctgaaggtaaaatgaatggtctggaagcttgtagatttcatagatggatgaattagtgtgaacaaagagcagtaaagggaaggaggcaaagatgatgcccatatgtcatgtctgtgtgactgggggtttggtgaaattgattaaagaaatgagcaacacaggacaaggagcaagtttgagaaaaaaattgtatcatatgaactttgagacattggagggccaggcagaaatgatcctctactaggtgagatttcagggcttgagttcaagggggtatcacaggtgtcttttatgtagatttgggtgtcttttgtgtagagcacccttcaaagctctgagattggccaagctggccaagggaaagcttatggtgttcgagaaagagcaagcacaaggagagccttggggacttcctcaatggaaggaggagaagccaaaggtgggaaaggagattgtaaagaagaagccagggcagcagaattcagagctggtgaggcccattttcctgaagccaggcaggaaggtgtcaggaaagtggaactgctttgaagtgagagactggtgatggggggacaacactgtgaatgtacctaatgccactgaattggacacttaaaaatggttaaaatggcaaattttctactatatattttctattatatattaatatactttaatttgaataaaatattaatgtaatataccaaaaaagtggaaatgatcaacaatgtcaaatactgtggatgagtctatggagataactgggaagagaaagcaaactacttttaaaatatttgccagagagaaccaaccatgattagaaaggttatttagttatccccaatcatcctgatttagttggcactttgaaaaacatgttagcatattgggttacttcttgtgttgaacacttggcattataaaaaattattggtctgggacaggtaggtaaccaaaaaaaaaaaaaaagagagatttattgggctatgaatgcatggcctccttagagccaaagtggtcatacacattgaagcagagaaagctagctatgatatttgtttctagaagtaaaatcccaattctgatagttaatgatatgctaattgctgtaaagacatagtggcagtttcttcaagactttgacaccttctccagattgatataacagctgcactgtattggaaagctacattctgctttggcagatgaatggtggcagtctctagcaggcatctctcatggtttgctaagatatcagtttgactctaacattttttttatgtgttggttggcattgcccataggagtgagcatttgctctataagtaaatgtgacttttatcatagtactattagatatactgaaataaaatatgtatttcccaaagtgtatctcattttaaagtaattatccaaggaaaatagaaacctcataaagaatattaattggcctcaggtgaattacaactatatgacaagagtttgtgtgtgtgtgtgtgtgtgtgtgtgtgttctgaatgatcagcgaggttgaaggaatagggagaagatgataatctctctatgtctcagttttcttatctgtaaaatgaggggacaggactgattagcctctgaaagcgtactttcaactgtaaatattatgtgcttctaatattgagaatggaacagcaacagacatgcctaaaactttgagataaagctttatatgctttcaagtggcaaattgttagtttactttaatgaatccaaactttatgaagtcaaatatttgattaattgcatcattaatctgtttctattagctgattgaaacaaattgtttattaatttccagttggtaatatgtaaatttataatttaattaaaatctcattatgtattttttaagacaaaaggcacattggtacagagtttgatgagtgagacacagacaatgctatagaatcagttcagctgcaagaaagacaatttgttaccaggctctgtgcagagggagagctgggcctggggccaagctactgggcccacttagaatcacaaggaagctttttatagaatgtgagttcccttgaacactgacatgcttcctcggtgagtctgaaaattagaactttagaagtgagaaggcttctcaggattatcaggctctagtccggctccctgtcaggtatttgaacccacaactcttgagcctgttcagtgggccaagtaaagcttgcttccctgtggatggaaccaaactcaccatcatacaccttcttctctgtgaacccccaggaagtctgctttatcttccccaagctgtgcttcagagattgaaagacagagcccctatgtgccgagtcttgtctttttaaaggcaaaatatacccaggtttttttaacaactgtccacagaacagcgttgtgagcccactctgctttccttgaagctgatacattccattttacctagttccctagagagtaccagaccccacagaaatgccccctgtgtggggtcttaccagagcttctctggtcagggttaccaattaaatgtattttccgtagagacctgtgtgcacgttagtgaagcatcttgatgagggaggaggtttctcacacaaagggcctgaaggtagccatttcccagggggcattaaagtccctcactgggcttaaaaatgtgcaggggcccacatcttggtgatttggttttgattttctggataaatttggggagcagttttgagtgagataccacagataaacatttgcctttgcctttgtagtgtaattattgaccatttggggtaatatttttattccttgttttcctcaaagacttccctgatagttgcaggtgggaaacactgaaggtcacctgggtgcaggttccaatgatgtttccaaggtgggagacagcttgcctccgcccattgccctcactcccgcctaacagtagaacgtttaggacgtttcttttgggcacttccctccattggaggaacggatcttgcagacgaatgtcctctcttgccgctcctgtgtccattcctgtccccagccagcctgccctcctttctatgttttataacttttctgggcagaaagacaaggaaacctgctggtggagtccagagaatacattcatccctgctaacctttacaggttcccctctcatgactgttcatcaaatctctggttcagcctgacctgttcttcatagctgccattccacggttttcctctttctgtgagctgaggttcttacttaccccaacctgggcagatgaattcatcttctgtttctctaaggaaatcaaggtcatttggccatttggcatgagtttcataatctttcttcctctccacctgtcatagtgattctcactgcttccaagtatttgtcaatcttcagccccttcttactttcccccacagagtaagaaataacctgatgccatcccaaattggtctctcattcttcattctgccagtgcatttgagcacccatgaacaatgggatgatattttcctctttaggttagttgcagggttccagaagattatacttgtctaaagactcaataccagagaagatatagcccaaatgtaatgtaccctttatcagtctaagaaagtagtgaaattatattgataaacgatttacaattacatctatagaaaaggaaaaaagctctcaattttgcatacgattgctttaagaaagtttttagagagaggaaatatatatgactgtcatatatatataaatatatacgactgtcaagcacatacgtagaagtacaagggcaatgcgcaacctgactgattgaactgggaaagatatagcaagaaattttcaaattcagacagtttggtacctacacagactgtgaagagaagaataagccaaagaggccagctccctattattctttccccacacaacaagaaggacaacagagaaataaaaggggccagatggctgtaaagtgagttgtaggatacctcattgctgaagacttcattctagtctgcagctaagtgacatttttactcagagctccattgaaaggcagggggaggagggcatgggccagaacccgggagttgttgagaaactggctcataacagccttccagaggagttagggaggtaagtgggagatagcctcagaacagctcttttaataacggcctaacatactcttgtgttttgggagatcacaaggcattccacaaaggctcagatcagctatggttcaaacttctgtttgtgtggatatgtgcaaggttgccagggtaccatgccagagccatgccccaagaacagtaagagaccatgtaaggcacagatgaataacatgtgtcttagtgtctatttaaaagcctacctttgtgagaagagggattctattgaaatgcagccatcattttggatttcactggtctatgaacctggtagtgagagactaaaaacaaatttgtattgaacttgaatgttaacttaataatcaaataaataccttcatgtttaatgcttaaacagaatttcattaaaatttctttgacgttaagccaaattttgaagtgaattggaactggtttgcatttcttaaattggtctttctttggaaataatgaaaaagtgttagagtcttggccgaattccagtgactgtgactcaacttgttaaagttaaattttaatatttacacattacatagtataatatttatactaggcaacagattgggtgtgtagaattcaaaataggatacactttgacttggaattgcagtgtggtagtcattacacccggagaattgggggttatcaaatactgagactgaggcagcccaagcaaaggagtttgaaatataaacactgctaagtgtgcagttccagcttgtacttatgtgttggttttcatgacaatgtgtgctttgtactctcgccgatcattgattttactgttgttgagatacttaggggaaagctggcttgtacatgacaccttctactaggttggatgataatgtagtcagtgagactgccagtgacctcctctcagcctgccaggagccaggctggctcactactggaaagtaggagaagttatgtaaagatgaatgtaatcatagaatcccagaatgtaagaattgcttagcacactggaaactttccagtacaaactccctgttttacatgtgaggaagctgaggcccaatagggttaaatgatctgctcaaggtcactgagctagttagtgacagaaagatggaaacccaggtctccacttctaatccagatagattaactacccctgaatagaaactcacatgtggttacctgagattgatctattcgaagatatagaaataaataatggagaaactcctggatcaaacatccctagattttttggcaatgatgttgtaaagggcattcaagagtcatttatagtatagaatgcaactggatgatactgcagttcctttcaaaagtcagagttccaggagtaatgtgaaaaaatagcagcaaatacaagatggtgtagtattaaactctgaggtctagtgcctagagggcaagggactcaacacagtgccctttctcacccagtcacgatcatacacaaagagattaccgggccaacttgttaggtcatgggcaccctgaaactaatcttactgcttgtctgaaagaggattcgacacattggatgaaacgtgggacagtttaactgcatgactacatgcagcctcttctactctgtggtactgtaatgtaaatctgcctgcctcatccctcaattgtggatgtgcatatgcatgtgcacacacacacacgcatacacaagcctcatcagcattcaccgtacccttatattcagtcatataattggcttaatagcgtcttgttgtccctagaagataaaattgagacaaccacttacaaagaaagcattctgtcagtcacttggccatttagtctccacatccttctttatttaataactctttctaccttgtgccaaaccttgggctttctttggagggcttccaagttacctttttcctaaactaatcccacacagtctggaatatgacagccttttcacatagactggattgcttgcagacactatgtcctgttaagtttgtactgattcatgagcattttaagtgaaacttccaaaactcattttatctgttcagcctcctgtttacaaaccacatgatataagaatgctcttttcccttcctctttcacctttcctttctcccatgaaaaagtgaactaagatcaagggtcagaataacccaaagggtggtagagagaaaagagcactaaatgaagagtcaggagacttgggctctggtccaagtcatgccactgaccgggtggatgacattggacagtcaacttccttttcgtgtacctgatcttccctaaaatggaaaatgatgcctttgatctcaataccctctaataaccctttgattgaaggttgttttcacgctcaattttctcctgttttcatgttcccgatttgaactacaataaagtgtttcgcaggtgtgtggtgtcttttagggtaattttccttctattggaagatgtatcatcatctctatggttgcaatatcactgaaactccttattatcaataaaatggatgggttaatatgttagattttataaatgagtaaccacagatttcatatgactgtaatatgtaaacatgacaaatctgtctttgattgttgtgcccaagtaaaacgtaagagggcaactggggccccacttatctagggaaatcgagcatctagttatttgaggtaattaaagcgtcttgtgtcagactcttaagctacttgcatatgaatagaaaacatttccatggtcacttttggatggttacttttgctgagttttacagaataataataccttacatctctatgtaagtgggacctgttccctcttctctccctctctcaaacatctagtgtctcttctcatagaaataacaagcatagagataaatgatgtgtataaagcaatttgtcttcaacaggcattttcacataccttatcttatttgagggtcacagcaatccccggagatacttaactgttgagaagagtcagccttgcagagctgaagtggctcaactcagctctcatgggcattaaatggcagagcaggtgtggatgacacaggccttcaggctcttcccttcctcacccagtggacactcttcatgtgtgaggtggttctgagaagagacatttgaaagttttcataaaccattctcatgcattaatttgcctcaggaagaattttgaagccctactgtatgtcatgtaatggtttgaggcactaggatgaccacagtgaacaaaccattatacctgtgttaggcaaaataatgccccgcctcccccaaaatgtccatgtccatatatatataatgtgaatacactacaacacaaaagggactttgcagatgtgattaagttaagaatctctggctggggagattatcctggattatcgtggtgggcctaaagtaatcataagggctctaataaaaggaaggcagaagggtcagagtgagagaaggagatgtgatgaaacaagtaggggtgagagaaagagagatctgaagatgctgtgctgctggccttgaagatagaggaacggtcgccagccaggcagtgaaggtggtctctacaagctggaagaggcaaggatatggattctcccctggagccttcagaaggaacgcagctctgccaataccttgattttagctcagtgagacctatttcagacttcctacttccagaactgaaagagaataatttttttgttgtttgaagccattgcgtttgtagtaatttgttactatgaaactgatgtaatacctgtccctagtaactcattatgtatttgggagaatggcaaataaacagccccatcagagaggaataagtgacgttgaagagaagctgcacagtgttggggactggaaactctgaatgcagcctggatgaaaggtgcaaggcttcctcaaggaggcaacaaggaagatgaatcacagatgtttgggcatttcagaaattagtgactggggcacagttttttatgtgtcactgtgcccagggtagggccactccagagggaaatgaataatagcctgaggattctatttacattgaggagcggggggcagagaagtaggggggcccaccactcataggattctgtatcctggcccagcattagtagagttatcctatctgattccatggaataagcaagcccacagcctgggcatcaattatagatctgtgtaaaagctacatatatgcaatatatgtatgagtgtgtggatatatatatatatatttttttcatttagtactcccagcatatatatcagcataatattcgatatccattaacttagggacacactgtggaatttgaaacagctgaagcttgaagtagatcatatcctttctttccagtctgtgttggatcatacattacgatgaatagaggcaattataggcagattcaatgacagtgctgccatttattggagtataattcctctagccaatcagtgctctaagtaacaataaattatgttaaacttccaatattacttgagcgtgtcgagggctatggatcaatgagtgtctgatacttgaaaagcttcagcattcagttcttgttgaatctgtaattaacaaatgaaactaaactaatcatagtaaattgttcatttggctacatttttgttgttgagcacactgagtgctgaggaacaagactgtgaagtgttgcagagcatgggcctgcacccttctatttcaaggtgcccaacagcaaatgaatgcatctatcaaagcatacgaatggtgagttgctgtgatagaatgattcatccttgcaggatgctgatttatctggcttgaacagtatgtgttaataagagattgttttatattaaaaggcagagtttaattttgatagattggctagcaattttccaagaaaatatcagtaaactgagggagttctaaaagttgtgtgtgaaatgtgtgtgaaacaggtagaaaaaactcctggtggcttatgtgaatcaaaattttttccacctattgtaagtaccttgggaaaaaaaaaaccagacataaaagacttcaaaactgcacagtttagatttaaagacacagttattggtagattgtcccactcaattatttagtctttttagcttttgtgcctgaaaaatgacttcatcttgtaaaaggcaatttacattaatcccggaatagtgcttaggatctttaaatatttcagagaagggcacgcactggttcccacataccagcacactgtttgtgatgttcattaaaaatattagggaccacaatgttcagaaactacttagcatagttttgttgtactagttaactatgcaccagtgatgctcaattgggtcttagcattaatacactcataatatacagtgcactgcttccatatggtgcattgggtagaagcatattaaacatattacacaaacagagctcaacacctcacatattattcatcaacaatgcaccaattagacaatacaatggtcatgaaaatcaacattggcatatgtgccccaggtccagattaaagtagatggatggggagaaatgaaaatagaaaaggggagataattaaacaggatggcataaggccgcataggttagactgttacaacaaacccaaaggcacagttttttattgtcctgaggcacagcactgaaaccaatattgtttaagctctaagtgacttattaagtagacctagaaaatttctacttttaggctagtgctgaccaatagaaatataatgtgggccacagatacaagccacatatgtgagtttgaattgcagccatattaaaaaggagtataaagaaacagatgaaattaatacattttatttttactcaatgtatgcaaaatatttcataatggtgtctgtataaaattattaatgctatatttaatattttttacatactaagcctttgaaatctgttatatattttacacttacagtacatcttaatacagactaaccacatttccagtgctcagattggctagtggctcagattgatcagtggagttttggattatttcattacaattgtatcttatcctgcagtttattttatgctcctttggataactggggttttttttcttagaaggctgggagggtggggttgaatgtgtaaactgcagagacagagccacagaatagtccaggaacttgccccaggtcacacaatctctaaatggcagaatcactctcggaggtctttccaccacatgacctcctccttctaaaagtccattctttgtatgtcctgccatatccttgttttccataaaagcacaattatgatctattagctagtcaattaataatgataacccattgtattagtctattattgtattgctgtaaagaaatagctgagactgggtatttcagtccattttcacactgctataaagacattacctgagactgggtaatttataaaggaaagaggtttaattgactcacagtttcgcatgacaggggaggcccctgaaagttacaatcatggtggaaggagaaggggaagcaaggcatgtcttacatggtggcccggaggggagagagcaggggaactgccacacttgaaaaccatcagatcttgtgagaactccctcacaatcatgagagcagcatgggggaagccacccgcatgatccaatcaccccccaaccaggtccttcccttgacacttggggattacaattcaagatgagatttgagtggggacacagagccaaagcatatcacttggcgatttataaagaaaagaggtttaattggctcactgttctgcaggcggttcacacatggcttggcttctgggggaggcctcagggagcttttactcatggcagaaggcaaagcaagagcaggcacctcacgtggcaaaagaaggagcaagggagagaggggaggtgccacacacttaaacaaccagatctcatgagaactcattcactatggcaagtacagcaccaagccatgagggatctgcccccgtgacctaagtacctcgtgagatttggtgctttttgtcaaatatccaaactatatcacccaaagaaagctactctctaaaaaccttaaaataatgtccctttgctctaacacttaggacctctttctacattctagatgaacagaatttgaaagcattttacaatgagagcagggggtggtatagaagaaaaattaactgcacctggactcagacaatctgcattcatattctggttttgccctgcattacctgagtgacagtgaatgctaagcagtcagcccttctgggtctcagtgccttcatctgtgaaatgggaagtcagagtgcctgtctggcctatttctgaagattgctgcaagttttgtgtaagatcatatttgtgtaaggaattgctcagtgaaaagtaccaggcaaatggaagagtctgttgcttttcaaaagagaaacatttaaaaatcccggtatgccccatatttattcatttgtttatttggtaatgacatcaataatctgtgaatttactcaccttcaaaaaaaattcagccatgacagataaggctaatatcatctcaatatacccccagctccgcctgtcacttgcttaactacctactgctagtttgcttgatacaagcatttagtcaaagaaagaacatttgtattaaggcccagtgctagataggagacaagcaattggtgcacacatagttttgaatggaaggctgagctggtgaccccaggtaagcagaggcctctcacctccacaacagaaaacatttgtgccaatggaattgctcctgtgctgccacatataacgtgtttattgtgtgtgtaagggtgtatgcatgtgtgtgtgcagtgccgaggctcaagaatgaattatgcactggtgggtaaatccagtggatccacacaagatgcaaaggataaacatggctcaaattgagtccaaaagaaagaagaaaagcaagcattttctgtttcatattaattggtaggatgtgggctgtaaaatcctctgtggcagtatttggtgtgccgagaatgttttctttattcaatgaggatagtagaggagaagaaaaatctgccactaaacactatcataccaccttaagtagtactaaagataatgattctaatgcagatagagaaaggagctgctatgtcatcaatgatagtaagttttgtttatgaaatattaaaatattaaactgcaaggcattgtccatttttattcactgttcttcagagagcaaatgcaaagttacagaagaattttattaaaaatagcttgcctagaagaagcattgttaaccaaattactatcactgatatcatttacatgtgtcatgtttcaaaagaagactgtgttgttttaatttgcttttttaacaccacaacaaggtctccaaacatttaaataaaacagaaacagttcattagaacagaagaaaactatctgaatatactggtcacaacttgcttaaagcatttctgacagcagccctctgttgaagagaaaattgcacaaattgccagttattatcatttttaataaataagccttctaccttctccctccctccctccctctggcttctgtgtgattgtgttcaacaagcatattttcagtggcaccatttctattaccaagtgattgagctctgatttacacatcaattacccaccttcatggagattttcatgctcccctagctgacatcaatgaaacataactgcgtaaacgctttatttcataccagttttggataactgagactgataactaatcatatcgagagacaacgtgctataatacacaaaacaataaatatttccctttaaaaatctcatctattctttatgagttaaccattcacatgcttatctcagttgtccatttcttcaaggatcttcctgtcactgcgtatctcaaatgaagttagggttttaccctagaatacaagcattcgcaaaggccaaattatcagtttccagcttccccaaggcgtagaaattcttattgttttccttccagtgttgtagatctcttgttcactcttccatgtttgtcgcatgggttcatctttaataccacttcattcatgtgtacttgaattagctgaagtgttcaagtcccagctggaacacagctggctgattttgtttcctaccccaagccaacctgagagtgttcctatggcactttcctcataaagttataacatgtgttactctgcactgcaattgttttggaatggatttgcctctcctgggctgtgaatttcccaaaagcttttattatgtcttttttttttctttttttctgagcactaaacatggtacctggcatgacatagatatccagtaagtgtttgttgattaaatagacaaattaatgtattaattaatattttgtcaacatttgtcagtgaacttaggtagaaaaatatgttagcctgtcatttgttcattcattcagttgagaaatatttattttgagctgaacactgagcttggcatgtttccagatacatgggaagcagaaatgcattattcctctctagtgacagtttcatttaacacccacaagttctttcagacatagcaggaaaggggagaaagaagaatgagttggaaagccaaaggagagttgtgctaggtagagtagaagggacaggattagaatgaatcgagtgcaatatagagtaaaaaagacaaggtctagatgatctgcacacactgtgaggaggcctggagatttcattgtgaaccggctcagaaatgcagtctgtaggtgcatgcatttggtagtttgaagtaaaggtgttggcagggttggttccttgtgacgagtattaggaagaatctgctaattcttcctaatacccctgaagtttgaatgaagtatgaagtttctggtagtttgttgacaatatttggcattctttggcttgtagaagtatcactgtgatctctgcctttaccttcacatagagttctctctgggtttctgttttcacatcttctcctcttataaggatgccagtcttataggattaggggcccgccctagtccagtatgattttattttaactaattacatctgaaatgaccctgtttccaaataatgtcatattctgaggtactgtgcatgagaatctcaacataggaattgtgggttgatgcaatttaactcacaacagggttaccctgattctagtcaggcaccttgttagggcaagagggagaagtgtaacctagggaagagtcacacctataggtccacatgagaaagcaagcctacggtcataacagtttgctgctgccctactttcatactcaggccggggctctgcaggagtgcatggtagaaggaggcagggccaaaaggttaagcctatagggggtagaatttgcctgggcaaaaattagtgagtgcaagtggatcaaagggtttgttgagatgtgaaaacagagtcagcttaaaattgtcaattataaactgctccttaagggcattaatttccttagtttaaaagtaattaagaatactatttctgagaaaatattgttttaaattaagtagttattgaaattgccttgcttatagctaaatgaaaataaaacaccttttaaaagtgtcacttatgagaagccagaaggttatattaagactttgacttggaaaagaattcctgatatttaatgggcctagagaggaaatacttcaggtagctttttcctaatttgaaagacagagctgatctgtgtaagttggctgcagaagcaactggtatggaacttgggacgtggcgcatgggatgaagccaggacacattgggacaggacaagggctcatcaagagcagagggccaagctaagccttgggccactgagcagggtactatgcctgcctcactagggcaggcaggcctgaggaaagaggaaaaggaggaggtgaaggaagaggaaaaggaagacctcatcgatgacatcaactgtgtactcctgagcagcaccacagattccataaactgaaccttgcctcaagccagaattcaaataaaccatgaagtactttagagccatcacaagtattctaagcttgtcactgcctctctgcttcctttctcgtaaatccacgggaccatttctagttgtggaaaggatcctcctgaagtaaatcaagaattagatctagtaactctttaaagctcagcattagtatcaactttgattaatttagatagggaattataaatgagattggttcaagttgacagtaaagagtgaatgaagaaatattggaagaaacatgaagaaacaggaaatatataagaaattgttacctctgattggcaatggggaacagggtggatgctgacaagagtggaagtggtaatgttttatatcaatttgatatttatgtacagtagtttaaatttttgatcatattctaaagtcataaaatataaatgaatacatttgctatattcactatccgattacatatttgcttggtttttgacatccattcaaggcccctactagtcttcaggaagtatttttataagcttccaagtcattcagttgtttgcagctctcttggtttggccatgttgagtgtggggcacttgtaaggcactggtttctgttacaaacgggtcaatgagccatatgaagtgatagtgaagcctcgtttttaattaataggtcagaactaaagttattttaaaatgattttctataaaaatggaaatcagacatgtaatctaagagcatgttattagagcagaaaagaaactcagggatccttagatatctattgtgcaatagagctgtggtagggtatgtgcatatggaagaggacaaggaagtgcttgacatgagattcaaggagataaaatcagacattccatagttgtaaagggataactgacacattctgagctgcttgggggagaagcgaagtaacatttgttgaggagataggcacccctctcaagcagtcagggatattggaccatatctcttagccaacagttatagtgtatgaggacaaaagaatttaatttcactggagaggttgcttttagaggacatttaattggcatacaaagtggttgatatgctgaatactgctgcaggcagatgggaaactttggcttgctagagtcatggtcattctatataaaagtggcatttccattaaaatggaatcccctgaaaatggagttttagtgcactcttacaatatttttgacaatcaatatccatttgagtgtctacctatgcttgcttttctgagaagaatgtaaaccatgctccaatagcccctgagaagccgagatattctgaagatagttaagattttagacataccttctggatcaattgcactgtgcacgttgtgtgagcagagcttaaatatgtggatgtgcctctctgtgaatagagtgcccttctcttctgtgagtaagactagaatcttctttatgaccaagagggtggcctctggattctgacagccccagcggttactgtgtttttgtaccactgactaattgtgtggtgttgagcatgttaacctccctgtgtctcatgtatctcagtttcctcatccgcaaaatgaggatggtataccacttcagagtttttgtgaggattaaataagatagtactcataaaagtcctggaacagtggctggcataaacaaggaatcaacagataggaactattagtgttattgttgttcttctgcacaagtctattcttgtaataactgctttcaccttcaaggcacttttcccaacatataccagcaatgtatgtttctacataatagaataaatacattagttccctaaaggtgtttggtccttgattttccttcatgaaatgaaaagacaaatgatctcttcaggttaagtttgtcagattttgatatgcccaaatgggtcaaataaagaaatttatctattaatataaagaccaggagttattttccatgtgatgcctgggactcacactgtgagatccagatgcagttggtccaatgtatgccctgagcctggagatttataaaatcttctctggatgattctgataggcagccaaaattgtgaaccaagtgataggagaaatatttagaaacatttccaatttaaagttattattttaaatttcagatcattattaatttgtgaattacatttttaaattgaccaacttagtgtctctgtctcaaaggtcatatctgagtctatagaagaaaatttgtaaaggatatctaatgaaattaacttaatctgttactagaaagactttagacttcagcaaccatgaaattttgctatgtttttacagagtaaagaggacccaaaagctataaagagatttacatatcgctttatcagggtgtcagtcatcttatctgttaaatgtgagcagtcattagtagtttacagaagccttttttgataactatcatatgtaacctttacactaaccatgcagagaagacataaagttaattttcatgttcaaagaaggaaactgaggctttaaatgtaaagcaatttattaatgaacaagaaacttgtaagtgaaagtgacagagcctgtcccagatcatctgaatctggatgccatcttttttggacacactgtaaaattccttaaagctttctacctgggaacaaaagaatctgtttctttgactggcatcaggttaggtttctagtaggtttttaccactcctaagtgtattaaattatctttgcagcttgagtatttggtatttgttagagagatgacaacgtcttcttgagtgtttggtaggccagtcaaaataattttgtccaaagcctaagccacacactttttttcaaaaaagcaaatatgttttccttatgacatttgcattgtccattgcttatttatgtacagaaaggttatttgtgttcagttggaggatgcagtgacttaaaaacctctgaccttaaggagggaaaagtctaatgggagacttagagaatcctggttaaatcattagaagaaaacaaaattgagccctcttaatgagcacagtatatcataggaccaggaatatccatacagtggaatattatttaactataaaaagaaacgaagtactgacccatgctacagtgtggatgtacattgaaaatagtatgctcagtgaaagaggccatgcacaaaaaaccacatgttgcataattccatgtatatgaagtatctagaagtggcaaattcattcagagagaaagtagattagtagttgcttagggctgggctggatggtaggattgcaggacaggatgatacctaaaagtgtacagagcctctttttgagttgatgaaaatattctaacattaatatcatggtgatgctttcaagactctgtgaatatgctaaaaaccactgaattgtacactttaaatgggtgaaattgtagctatattagttatatctcaatcaagctgttattaatgaaaagagaggactagaaaagaagcaaagcaggggatacagaaacaagttaggagggatggctcttgggaggtctgcctgacttaattggaggaggcttagacaggctttgcagatgggctgaatctttgcttccattttcagaaatggaggggatgaggtagtcccaagatgctcctacattgaaatattaagcctgtttctgccaggacctctggactattgatgtctacataattttacaaaccacagatttaaaggaaaatcaaaaacaaattggaatgatcagatgggcagctgtctagagctaaaaacttgtgtgtttctcaccttttcattctcttcttgattatttttcatgagagacagtgtttgcagggagatagttcatttgctgaagagagtggtggtatgctgagttcctcatgagtcctgacattaaatatggctgaggaggttctactggttttagaaattcctttccaaggccacttaccttctattcttttgcacacctccagatccaaggttcttgtgtttttactctatatgtgtaaaataatgatggcctgttttgagctgcttttatagttttgaatttagcactttacataatgtgggttaagtttgaaggtattggatagcagagattttcttttcttaacaaaaagaagttatgtagagattagatcagtgtcaaattcaaaataggactcggtatagaaaaagtatcacctgacactctggaacatataacatggataaatatctacacatgttatagaaggcagggattcattcagaagaaccacaggaagtgagtgatagcttatgtttgtcctttgagtggattaaatatgtatttttatgcttttgcaaagatattagccaaataaaggtgtttactgtagttggactggaaaacaagtgaggctgaattatttaccttcatgtacaccattactacagtaaatcatatattagcagtattttaaaacaaatttatcattttaaaatatcaattttttattccccaagtggctttgtaaaataaccaaattaggtaaacaatgagtattagcttcatgaaatatatgaaccaaatggactgaaactggtttttactctccctcgcccagcctcttccccacagatgcagttaatttttataatccctttagggtctgtacattttgatataaggaaactagtggtttatctatactcgaatctaaattaaatccctaaagtttttccctactgccaatttctaataaaatgcagtcctaaggaaaggtgaccaatggagtgcatgtgaaactcatcttcattctgaagtgtgatggaaacacaggaggcagaagggacaaaccatgttgcttgggaatgtgaaagcctgagttccagcctcctagttctctgacaaacccgctgtgaggcccattaccttaccttagttctatttcctcatctgtaaaatgagggcactgcaactagatgattgctaaactctcttcctgttataaacagtctctgttgtaaaagactagcctgcattgtcagcctgtgtgggctaccactgtgcgctaatgaagacggcataattgaactttctagatctcacggaatctacatgtgccctgcattttattgtcccaccaatgaacctgaggcttttaatgagcaaaatgagagttatctacatacaagataaggttcaagtgtctgagagaaggagaaggctaggagaagatactacatgtacttgaagatggaagaaacagattcagatcttcctttgccactagcttgatgacggcttgagacagctccctctgttcatttttggagggccttagtttcctcttttgtaaatgagggcagttcctctgtttgtggtggctagggaagcacacaggtgggtgaaatcacagctaatataaaaatcctgggctgggtgcagtggctcatgcctgtaatcccagcactttgggaggccgagacgggtggatcacctgaggtcaggagttggagaccagcctggtcaacatggcaaaaccctacctctactaaaaatacaaaaaattagccaggcgtggtggctggtgcctgtaatcccagctacttgggaggctgaggcaggagaatcgcttgaacctgggaggtggatgttgcagtgagctgagattgcgccattgcactccagcctggtcgacaagagggaaaactccgtcaaaaaaaaaaaaaaaaaaaaaaaagaaaagaaaaaaaatcctatgatagagagaagcttctcaccatcatgccttacaccaaggtgattaacaaagtagttaaatggaacttgttcttctttctgaccttttccagtcagctagcgtggatatcaatgaaatagcgattccaaaaaggtaacctggagagagagaaacctaaggcctttggttaattcatagtaaatttggttttgagtggtcagtttttatattatcataatgtgaccaattttattatatccaggagaaaaaagttggaaaaatatcctaacttgctaagagtgatgaatccttgagttgagatttttggcttaacttctcagtatgaacatgggttttcatgctgattgataggatcaattcatcctgtcttcatcacagaataaacttgaattgttcataccgatgatatgatgattaattcaggtttttggcttgagcatttctttgtgggctatggagctctttttcctttggaaagcaggcctgggtgtgtaaagatgtatcaaattatcaggggacagacatatactttcctgcagcctctgcagggctcacaggttcaaacacaacctgcctgaatcataagaaatttaattgagtagataaagaggtcctcataattataaactgcagtaggtataacaagaggctaaatacatagctgtggttttaattagctggtgcttcaaattagtaatgttggtttcagtcagaaatcagtgacgttatagactgaaagcctcatcaccatgtagttcattactcattagacctcactgtgtgaagccttcaatacaacgccatgctgagcaagaaaggaaaaagttggagatatttggttgccttccaagagcagtggagctctgtggagattaaattcattctcgccagagatatgagaattaactgttctttgtcggatgtgttaaaaaatgcagcaggcagttttgcttgcaacagataacacccgcatgcacactcaatctgctattcaaatttgtgtctggaatttggtagctaatgaactgatgcaaaatgcagccaagagcctcctaacaaatcaaagccagggctaaagcaccgaaagtgcccttactgctgatcgtttgaaaggttgtcatgcaagctgaagcacgtttccttttcttctccttctcctttctttttccttcagggttttaattatatctttccctcggagaaggaaggtagtttgcaaagccaagagaccaaagcacttcagttctcttcatgggagaattaaatgtgatctatgggcctgtcattcttagctgtcaggtgcacaaaatgaacagatagctagaaaactgacatcctgctcgcattactcagaaggaaaagactttggttcttgtttgtgtgtagatactaatctgctatggaaagcaaagaaattaagtgtccttctcctttgcaacaaccctgccctcactaaatattgctttaacttgttactctacccccacccccataacacccaatctttcttacatttggataaattgatgggattggattacacacagccaatttatggtgttgaggtacggtcacaagcgccacacttaacggactgaagatgttactgtgcctgattgtttccatgtcagtctcaaacatggagacattgagacacacaacaattgtttggggttctgagttcaacttgtgaatggaaatgaaagatgatgctagaaaatctaatacctatggagggcatctgagactacaaataatagcctggcttccagtatctggacttgatatcttccttgaccaggcaaggcctagatatggggccctggctttgggtaggactctgaaggttttctttgctttactcagacagtgataacatttgctgaatatactcatgaatggtccagtgagctttaatgtatctgacgtttgtattatgaaagtgtaatgtgcatttaaacatcctataaatgttgttgctgttttttaatggagaaatgagtgttctttatccaggagataaagttatcaaagtcactttgaatttgaccattcaaggattcctgtgaagaaaagtggatgattaagtgtagtggcattgtacactccatgtttatcaacatctagttaagctgcacagatagtttatgttctaggttctttgagcaaactagcctaccaatgacaggtattaaggtttcggatatagtcaaagcctgtcaactgtagttttatatcagtagatctcttataattcctttagctattatgttcatttgcatgtcaattatctaattaagtcttaacatgggactattaacatggggaaggaaaccaacatttatccaacacctgctaggcattttatgtacatttatgtaatttaaatttgctcagtgtatatatactcactttgggtaaggttaacatcaaaagcatgaaaaaagcccagtgaataaaataagatacaccactacgagacttagattatggcttaatttgcagtcttgcatgatgaagaaaataattgttttcttaataaggaagcattccattccataaaaccagaaggcctggaatatatcttaaatattgtttagaagcttttgatcctccaatgggaaagcctgaaatgtgatgagagtcacagttagtctttataaaacatttgttcgttgaggtcattaaaggcttttgacacctcctttttttcatccacagttagtcatttgttattcaagtcagacccctttttttgtgaagagtttctcaaaaaggcttccattcacttttgaagaaaactgtgagaagaccaacaccacaacaaccaaacacaaagaagtgtaggtgatttggtgatttatttttttgtggacttctgaaaatgcccttaaattctcctgtgagttcatcaaaacaagctcactttggctatgggctcaggacagaaatccaatttatcttcagctccgtactttgataattcctttcccttaggactttgtgacatctgtggattctgagccctaggtagttggcaacacaatgtaactttaattcagtacctttctgcactgtgggctgacttttggggagtatgtaattgcttataataatcaaaaaaggacaagggaagagattttgctttacttgcttgtcatgaatatcatttcaaataagcaagtttttgttttcttctttattctgaagagctggtcaggatcttaaactcaataggtgtaatgaaaaggattatctgttctctatgcagtgtcaacttgggcagcaagttgacttgaatttttttcttattattgacagcaaggaaaatttaaatgacttgcatgattaattaatctttttctctttttgtcttttccttttcatatcagtcactatgaacaagaccgtagtgcacttaaaaaaagggaatgggagcggaggaatcaagaagtccagcaagaagacgatctcttttcttcaggctttgatctttttggggagccatacaaggtagctgaatatgtatgtaatttttctttctggaaaatggttgcttgttacatttttgaactcactaatcaacatttaatttatgtttaaagcacccaactcatttccaggggaatatattttacaagtgaaatttgtacatacactgtatttgaggcaactgcaagtttctgacgaagtcttcagaaacaaatttcatcttcttttgggagcacagtatgattgaagagagacttgtgagacttcctgtctccaatgagcccctctctgcccaacacttcctacagcaaggaatgcccccttgacactttctactgctgtgattgtcagtaggcagctcctgaagacttcatcagaatgtcaatggagatgtctgtttcttttcccaatcagtgtcatccattgcaaggccactgtttttcttttccattttaggttgttagcagctcttcagtggtttgagtgctctttgaaaatcattgttctagaataaaggaaaaaagccaatcatttttcctggtggttaataatcatgggttagaagattgtctcaaccagaggggggtagtatagctaggttgaatttctagtggtattctgactagtgtgtagctccaataatcatcaaactgctgtgtctacaagtattgattttacaatgactgcttctgaactttctatttggggtagagatgagaggcgactgggaagagattatgatggaagaatcttattgaattgctggcagctggttggtttttattgaaatgcagtagcagtgtaattttctgtaataaaaatgatgtaagaagtacaacaatagagaaaattttcaagagctgtgattttagaagagtaccctttaagggacagtgacttctggaaaaggaaagttcttaaggaagacagcataggcccaaatactactttggggtagagagtaagctatttggattggtgactggtgagaccaggttcttgttaccttgttcaaagcaagtaagcaactcttgattgagacactgcaggaactttcaagtttggtaagcctgatgaagaaacttaggtcacctaagctactggttttcaatctgtcagtaatagtatgatccctaaaaaagcagtgttcccatatcaacaggttaatttgtatactactttgaaggtatatatttagatatataattggtttaacaaacatttatgaaggtctactatgtgctagtcactgccttacaccagtgtacaaagaggaatagcatagtctctgttttcaaggagttcctagtcgagtggcagagatcatttgacacagtgatggcatgcctgcatggtaacagagagatagcaagggacagatcagcgaagactttgtattcaaactcattataaagagcttgcacataattttttacatgatgaaaaaaatcattacaaatatttaagtcatagtatggccaggaaaaatgaacagtttagaatgatgatgttgggcagtgtggacagtgggtcagagggaggggaaactaaggaaagataaagaagctattgtaattgatgaggggagcttatgtcaggaatgatttaaggtagagtaaggaagttgaaattatggaattgggtatctaattgcatgtggggagtatggaataagaattaatggttcccaagttttttatttgagagggtggtggtatcatgaacaagttttgttcaggaggagaacatggttgctgcttgtagagaaaaaacaattaatttagttttgagtgcgttggctttgagatgctagagagatatcaggagagagctatccagaaggcttggatatatgggtctgaaactcatgggagtggtcaagggagaagtttagctgttattgtcttataggtatcagtggaagctgtgagaatgcctaccatcactgaagagattatggagtaaaaaagaggacaaacaattcttgggagtagcaccatttaaggggtaaaagaggtggtgaaagcagaggccaggaaaggaaactccaaaggaatgatcagagtgataggaagagaactaggaaagaaaatttaatagaaacctagggaacaaaggaaggatttgctgtgcctcagagaggtcaggaaaggtaagaactttaaagtggctgtttggatttggcagttaaggagtaattggtgaccttatggagagttgttttatttgttgatgacaatggtcattgtgggatgccaaactgccaggggttggagaataaatgggaagtggttaagtaaagaaagcgagacagtcaatgtagatatgatcttgaagaaatgttttgcatggaggaaaaaagaaagaaagataagttagaaagtaaagggaggaattatataaagggaagctttttagaaaaatgagataaacgtgaacatgtttagagattgatgggaagcaaataacttcaatggtgaatgagaaggtggaagatacaggagagaaaggtgaggctaagttgagcaaggtcccggaggagattaaaaataatacaagatggagagcagttgaggaatcatgagctatagggtagaaggtgggaacagaacattagaatgagaacaaagcaggcgaggggaaggaagattggggaagtgcaagaaatcagggcctccattttctgcagaaaatggaggagaggtcaaagcacggtaagtgtcttatcctttctcaagctgaagaaggaataaggagataagttttacatgttatctttggatgggttagaaaaatgagctttactcaaaaggtttattcttaaaatccaatgtccacactatcctcaacattataatgaggtggagaactcttgatttattctcccttcataattttaagtcacgatgaattgatggtcttgtacctttaaggtaaatgccatcttttcacaaggcctgttatatagatccattttttaaatgttagcagtgtctttttgagtaggcagttgaaaaaaatctgttatcaacattttcagaagttttgaaagccatctgtcttgatattacaagggtacatcaagtagagacatagatgggaacatttagtatagtgtggggcagggcctattgtgtgattagtagcttgttacctttgtgcttcctgatggggaaaaaccttgtcctttttttttttttttctgagatggagtctcgctctatcgcccagtctagagtgcagtgcgacttactgcagcctctgcctcccatgttcaagtgattctcctgcctcagcctcccaagtatctggaattacaggtgtgcaccaccatgtccgactaatttttgtattcttagtagagatggggtttcaccatgttggcaaggctggtctcaaactcctggcctcaggtgattgcccaccttgacctcccaaagtgctgggattacaggcgtgagccactgcgcctggccaaaacctttgttcttaagtcaaaactgtgaaggaaaagaataatgctagtgattggtgacctaataattatttttctttcacccttgctttgatgattggttgttatcttgagctgcatccacattcagggttccctgggagaacactgaggagtaacagagtactagaactgatgttgcacctccataaggctccccagaccaagactgggcttgatatccttggagtatctggacatgccagtggtcatgggagtcctagagctggcccatggtccactggtagaaacgaggacataccacagctcttccctaagatagcagtgggagtgcttatcaaatttagaataaacattcctgatggtgggtcaagactttcaggaaagttcttgctaccctgaagcctaaaacaaggtccagtcacctgtccaatagcgccagtggttcataaattagccaacatgaacactgatctctaggacctattatcctttcttggcagaaagataaatggtgatctctcatgttcctggctaatttctttcccttcttttctttgcctctaccactgccagaatggagagaatgttgaccacccctagatttggttggtaatagggaacttctctcttgggctgcttttgtagcatatgattttcaaattggagtttgtgttatgcttttgagaaggatgtcttcaaatgtgcctgaaaaatatgaagccatttgacttgtctaggttagtgcactaagtttggtaaggaactggcatgtaacaagtgcatgccagcttactgtctgctaggcactgtgctagagttttatgtgtatgctcatttagtccttataacaatgtgtgtgttcatttagtccttataacaactggggtatgcaactttcccatgttttccatgaggaattttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggccgaggaattttaactcagagaagcgagatggcttctttgcattttcatatccttatacatggcgaatttagaccttgcatccagttctgtatgattccgtatctgtaacaggaagttatttatcctctgacaggatgtcagaatacttgataagcttacctgctgggtgatggtggagaagaaactccctttctctgatccataggttttctttttcctttctggattgaatcatagtaattaataagaatagtaatattttatggctcttcatagcccaatgagaatgaggaaactgaggtgcacagaggattattaaatggcttacccaaggtcatttgtgttgggacacatagaggtagaggccagatggaggccagagctactctgctgactcacatggttgttttaaggatcacatgaaataacctgggaaaccttgctttgaaatctgtaaggtgctacacaaattcaggtattatctttattataattagagtaaagaaggaaatagaaacttagagcttagagagattaactgcaaaaatactagaattagaaaaagacaaattactaaatcacatgttagccacaataaaataaaagaaaaaaatgcgcttcaaaacttgaattattttgctacttgtattaaaaagaaatactatggtacaatagcctcctagcacattagtcttgcatgcaatgaaattatactactgatttgtagatagcattagaaacaaactgagggaagtttgcatttcctgaagtaatgagaggcaaaaaaacttaaatgagggaatgctgttagtcatgagccacaaaccagacatgtaatttatgcctgaaaatacttggaaaatgcatttcctgatgatagagaaattgtgattgcttagaaaataatggctgcagaggttacctttaaagaatcaaccaattatctagaccaggaagtaaataattagccaaattgaaagaagcatataattgattgaaatggctgaatttcatttttgtcatgtttataatgttcaatcaagattaccaagaatattttgttccttaataggattactaagactctggagggtgaaaaagaacatttagtatgaatcagaagttgctatggtgtataatgagagtacattgtgtaggtgtgtataaatgtatttcaggccccattgggttttctatccagtggttctcatatctccatcttgagaaatttaaaagctgattgacagttacccacctccagtggtgggaaggtagagtgcttactctggcgacctggactggactactaattatgtgctgattgttgaatggtgaacttcttgaggctctgtgtccatgtgtcctctgtgcgtaaccctgcctcaggagggtctcaaatttaccagtgtctgtcttaagaactactacaataattcctacttgtagccacagaacatctgttatgcaaaccatatggatcttccttcaatcagcaactcagaaagcatcaccagtgaactcaaccttgaactgtgtgctatacatttcctgtcacacgtccttccttctgagacaattgctctatgaggaaactagtctaagggagatgacatccctctatttctccaggttatcacagcttcactcctgtgtcattactgtgcaagaaagctgcacgcctggattgtattagcctagacctctaagtccacatgcaggcaggctttcactgagttagtcatcataagaaaaagccacatgaagacatatttgcatcattttggaaaatgaggccccaaaaagtgttacattgctcaagtgttcttgtaaaaatatcagtgagaggaattccttttcacattttattatcagacaacatttgtctcatttaatgaattaggatatgcttctttcgatgaaagataattctataacctacgagcttttcctttttgccttagctaccaggaaactcaaagttcaatttaatgttcaatcatagtaacgaagttagcctgatttttgccttctattatgtacctttgacttcagccattgcaaattctttattttgatatagacagggtatgaattttaatttatcctgttcaattctgtaaaaatgtattgagtatttgattagcacaagacatggtgctacatcttgggtatataaaaataagtgaaatgtagtctctgacctttaagaactcatggttttattcaaggaaagatatcataagtgtagtatacactgtgtagtagaaggttgattttccagacttattgagagaaatttcaattttcctctaattttgttcacatagacacagtgttagacattggccagtttagaaattcttttaatttcaagtatatttttaaaacctagatatggaaaactatatctaagcttgcttcagaaacccagatcattataagtaaatgtcaatgaagagacattacaaagtaggcaaggttctccctactgaggacaagatgaacctcttttatttactcctgaaacaagaacaggaatttgactagcttgcttgtaagcaaatgagctttcacattcttgagtcctgattgtgtttccctaaggagactacaatgacttttcagggcatggaggtattacagtggtctctatgacacctagggagaaggttctgattttgcagagctctgtttctgtgaaagccagataatgaaatgaaggcattccaatgggaagtgaaatggtgttgttttcccttgttgagtcagatcattgaatatggccagatatcactgttcatgaggcaaacatctgacccaagaggtaatctgtttgacaggccaaaacaacctacaaatgtttaaagcttgcatcagattcttgttggaccctcagcacaatgaaatttctttgttttaaatttagagattgaacagggagcctggttttggctactgtccatgtggttcattgtgcaactcagttgaaggagaccactatatacaaagagtttattcttgtctgggctaaaaagtaattcctgccattaaaaatgacaaacctagagacttttaggaaataaaagtgacttctacccatctataacttttaaatatatctttcagatgtacttttgaaaacagagtgattattcagctgaggattatacagaatgttaattgtttaatcactacttcagtactaaggttgcgtatgatacaatatatgattggaggataagcaaactaaaattgacatatagttatttgacttctaaaaatatctgtccctgacagagctcccttagcatatgtttagcatacttttccttaatctttgaaatttatatttctcctattgccctcatttctttggaagtgtctcatatggtttcacacacacatagtatgagttaaatactttttacggtatatggagatggtgctgataatgaggccaagattactggtttgattctctctctgttccttcttggtatcgtttgctggttcctcatcttctctcagtctcttaaaggttgatgcttgccagggttctctgccaatccgtatcttctcattctatgttttctttccccagacgacttcacccatttctagcacttcgccctctagccatctgcatatcctcccatcttcacatacaaaggaaaacacacagccttagactgagatgctagcgctggataggtatactccctgtgtacactaggagactgggctgtgttaagggcatgtgaaaaatcttagatgttaaacaactatcttcagcagagagtgtaccaatggttagatggtcactccctcctgtgcactgaaaatgtgcccatggcttctgggacttgaaggccacatagggtggtatttttcccatccagtggcccagttgccagatggctccttgaatactggtagccttctatcattgcaacatcttgggccaggatagtgcagcctaggtacaaaaaggtcctttggctttctgaattcagcagcttgttttgataaactctttggcatataaagagaataaagaaagtcacttttgggggtgatcaactgagctttcatcaaagtcatttccaagtatacagctacccaccattttttagtcatgataactttgctttctgtattacaaaaacccatgcaggagcataattattttaaaaacaatcacagccattttaatagaaccaatacatcctacagggggtggtgtagctggtatactgattgtccataaaatgagttggttgcctctctaactgctatacattaggctaacatcactttgaaaagataactttgttttggtttccttaaacaacagtttaaatacttgaataaattttccttaatcattgaaaagacacagaagggcttgagtcactgttgatgaacaattgcatcatttcaaagtaaatgagtatgaatcatcaatatgtaaacacagtcattccagaatatacaggcaaacactagtaattcatacagttctttgattagaaggaatcagattcattttaatcatgagttagctcaattagatgctgtttaattccattcctgtcctaaacttattatagtcatggtagcacaatttaactgattttcttatccaatagcctaagcctttttcatggtataatgtggtgcaaaggctgatatgtcaaaaatttatataggtagaaaattccattataactccaatgattggtaagcagaagttgttaatcacaatgtagaatgtagcaattcagctcatctgtcacagaataagttatttttctaataaaattaataaatgatgtaatttaaaagtttttctcaatgaacatgtttaaggactggctagggagtataaaaatgttaatcatacccgctcattccagaagctttttcaatagtgttcttgattttttttcttacatagcacatgaaaagcatgaaattatatggcagcaagacatatttaaagaatcccgtatgatagtctacttagggcatctgtttgaaacattaacattaggaaacacaaacctattcattctctctcctcccacccccatctttttgttattttagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagtaatttttaaagttttgtttggtttcacttttttttagttctctgctctaacctctataatccagtattcacaagcagctctcatttaccttaatgagctgtataggatactcttcaagttcagggtctgaattttgatcttctgtcacttgtgacataactgattaacacgctgcaaatagagttaaatctcaataatttggaatgacagaagacaaggtcggtctgactgaaagaatgacaagttggagttataaaatagtttcataaaatacagttgtggtaatactatgtataaattaataacatttgagattataattggtcataagtagtatgaggttcatgagaagattgcgagtcactatatgccttcactactcagtagcatattctaaacctaaaatacagaagttccttaaagtagaagaatgtagaactgtggtttgctggaacctgaagtagaaggcgttctttaagaattttagtttcttgagtgattacagagctattccttggcaagatcttaatgttttctcccgtatccatcaatcttcccttctgcatctccttcctccacaggtatctacatagcccttttattctactttcatcctttctgtcaaagcaaaaagcattacgagcaaccaaaagcccactggtttagaatgagtaaatatcctacccatctcaggaatcattgccttgtaaaagagaagtccagaggcaccaaagcctcttctaaggaatgaatcgctaatgattggattccaggccttgtggcccctgggtgggggtcatgcatggtgctgcctctcagacactaccatgtaagcggctgtctactgcacctcaagcgtttgattggaagaagccactgcctttagattggattcctgtcactggtgactaaaggcttgaaataacacagaggaagaaagtagggttaaattcttactcaataggagtgacaggcagtctgtctgaatggttgtagattccaagttagtggtatctgagttagagaagtgtgaccctataagcaccctggctctccttcctttatttatcctcagcagatgcggtgatttcagaggacgatgggaacataaagggagggaggcctggggctgttgactatattttctgaatgtatgtttttaatattgtttcatttctgaggcagttttgctttttgtatcatcattcatcaagtcttgtcaagcttcctcttaagtatctctccagtctgtcatctctacccccactgcctttgaaccacctgtgagccttcagtggactgctgtgagagcccctcttgactggtctccttccctctagtctcacctctcttccataccatccatgcaggctcatctaacaggcagatctgaccatgtcactccctgcttttgattattcagtaccttctcatcacttccagggaaaagtccaaatttcttagtcacacatacaaggctcttcaccctttagtttcatactccttttttggccacatatttcactacttcttcatgtgcagttgaaatcccagccatatgggactacctgtggttccctgtcatgtcatgctttatcacgcttccttgctttttggcttgctgtcccctcagcctagaatgtctttccccaccctcccttgtcttcctggtaaagtcctgtttctccttcaggtctggtcagttgtcaccttctctgtgaaagcttccctgatcccctcagcttaattaaaaacccctttgtcttggctcctctagcaccttctatatgccctgattggcaccgactccattgtattgtagtgatttagttatgtttctatctcctctactagactgtgagctcactaagagcaaggaatacctcattctctctgtatcccaagcgcctaggaaatacttagcacatagtagatactcaataaatgtttgttgaatgaatgaatttcaaaaatggttacttgattacattttctaagccacaatgttaatcaaataacatgcacaaatgtgaacaattgctaggaaatccatcatgagttatatctttttcagttgtattctgtctgcctgtttcttactctgctctgctcctgttctgtcattgagaaatcctagccataatttctactgaatgacttaatacaggctttaatacttaaaaatcaaaaaagagatctgctttgaaaaagtacaagtataatgggaggtggggatatcattcttgtttcttcttttgccctggtatctgctgctgttccctccttacacagccagaactgatctggaaatagcactgccccataaagcagtctgtcagcctgtttccatacctcattagtagagtgacaaatcacagacccagcgaaatccaccctgttgtaattctctctcttatacattcacaaaatggctgacccagattcagaaatgacttcatgctttcactcagtgctctggcacaccaacgagaggtacattttcaaagacagtctgagctgtcatcagctctggagacgattatcccaggagcagcctatgtgcttgcagcctttggtgatggtacaaacagaccttgctagagctctgtatgaaaaatgggccaggtgcaataaagtcatgataggagatcagtgaagaaagtacttattttaaaatatgggtttcaaggaaggatttgacagaagagtagagagaagcttaaagccctaaagtcaggggcatatacagaacccaagggtaatgtgaaaaccaaaaataggaggaaaggaaaagagaggttacacggcccaacaagagagcttagaagggtgcagattaaaatgcgggcataaatatagacagggaggagcattatggagctttgaacctaatggaatttatgtggctaaaactctgaccaagtctgaaaattcaccctattaaatcttgatgcacttttcaaaagcacttagcattagaattcagccccagttcctggcgccaaggagtttcaggcactaggttccgggtctctagtcagtgtagccatctttgatgagtggtagcattactctgagttattaccaaaaaggcttatccgtggagcaatcacagtatttctttgagtattctcaactttttccctggctttagtgacaggaggttgatgagtgttagtgaagtgcatttgtggggagggtgaagcaggatgggttgaatggccagaaaacagacaacattctaagctatacaaataagcagataacattatatttatgaattgagagatcacaaactattattgaaatgtgatgtgcaagtgtgtgtgcccatgtttgtttatgtgtccacatgttgagtatatagtggggaaatttttattttttatccttgaatcatttccatgcttcttagaatttctgtatcaacaataaggatattagaagtataaccaactttattgcaaaaggtcagcttttcaattgaggcatgtcattttaacaaataatttgtttaaaaactttctgttggccgggtgcagtggctcacgcctgtaatcccagcactttgggaggttgagatgggcggatcatgaagtcaagagatctagaccatcctggccaacatggtgaaaccccatctctaccaaaaatacaaaaaatagctggccatggtggcacacacctgtagtcccagctactcgggaggctgaggcaggagaatagcttgaacccgggaggcagaggttgcagtgagccgaggttgcaccactgcactccagcccggtgacaaagctagactctgtctcaaaaataaataaataaataaataaataaataaataaataaataaataacaaaacttcatgtcatagagtttattaacattcctggcaacaacaacaacaaaatgctgatgtgttctgcagttgggtttagaagaattttctcggaactgcatctgaaaacagtaaaaggcctatttatatcaagtggaaactgagggttgcttgcagatggtgctttattaggaaatgaatttgttaataaacgtagctttatacatttctttacagaaatttttgttcatttttaccttaggataaaaatctgctggtgtagacagctctgcattttggtgcaatttgttattagtatagcttgccaagtaaataatcacatgcacatgaaaggattgatatcacatattaaatgtctccatcctaagtcagtaagcttttgaaagtacaaaactaacgtgtagagtgtcatatccctaaagggtcatttgctttacatgctgctcttggctgtgatctaaggctatctgaggctccaattgccacaaaactagtggccttagaaaactttaatagaaatggtgtgggatttgtctgtagcttattttagtggttagctttgtcaaccagctgaaaaattattgctcacatttgtgactgtgcctgttttgtttcacaccctatgcagtgaacactgtgagtataattacctttatttattgtgagttagatagtaaactcaggtcccttgtgtgagaactgcagagaatgctaggatattaccattgatgttctagatatgtccatgcagctacacagaaaagagacagctgcttcaatgaatggaaggccatccagttgctgtttacaactcatgctaagaatttttcacttgatgtattagtctgttttcatgctgctgataaagacgtacctgagtctgggcatttacaaaagaaagatatttaatggacttacagttccacgtggctggggaggcctcacaatcatggtggaaggtgagaggcatatctcacattatggcagacaagagaggagagcttgtgcagggaaactcccccttataataaccatcagaccttgtgatacttagtaactgtcatgagaacatcacagcaaagaccttctcccatgattcaattacttcctattgggttcctcccacagagcatgggaattatgggagttacaattcaagataagatttgggtggggacacagccaaaccatattaatccacccccagcccctcccaaatctcatgtcctcacatttcaaatccaatcatgccttcccaacagtaccccaaagtcttaactcatttcagcattaactcaaaagtccacagtctaaagtctaatctgaatcaatgcaagtcccttccgcttatgagtccataaattcaaaagcaagttagttactttctggatacaatggaggtacaagcattgggtaaatacagctattccaaatgggagaaattggccaaaacaaaggggctacaggccccatgcaagtccaaaatccagcagggccgtcaaaccttaaagctccaaaatgatctcctttgactccatgtctcacatccaggtcatgctgatgcaagaggtgggttcccatggtcttggacagctctgcccctgtggctttgcagggcgtagcccccctcctggctgctttcatgggctggcattgagtgtctgtggcttttccaggtgcatggtgcaagctgttgatggatctaccattctggggtctggaggttggtggccttcttctcacagctccactaggtggtgccccaacagggactctgtggcagctctgaccccacatttccctttcacattgtcctagcagaggttctccatgggggccccgcctctgcagtgaacttctgcctgggtatccaggcatttccatacatcctctgaaatctaggtggaggttcccaaacgtcagttcttgacttctctgcacctgcaggctcaacagcatgtggaagctgccaagatgttgggttccattctctgaaatgacagcccaagcttagccccttttagccatggctggagcaactagaatgcagggtaccaagtccctaggctgcacagagcagagggccctggacctggcctatgaaaccatcatttcctcctaggcctcctggcctgtgatgggaggggctgctgtgaagacctctgacatgccctggagacattttccctattgtcttgagggttaacattcggctccttgttacttatgcaaatttctgcagccagcttgaatttctcctcagaaaatgtgattttcttttctattgcattgtcaagctgcaaattttccaaacttttatgctgtgtttcccttttgaaatggaatgcctttaacaacacccaagccccctcttgaatgctttgctgcatagaaatttcttctgccaggtaccctaaatcatctctcttaagttcaaagttccacaagtctctagggctggggcaaaatgccaccagtctctttgctaaaacgtaacaagagtcacctttgctccagtccccaacaagtaactcatctccatctgagaccacctcaccctggatttcattgtccatatcattatcagcattttggtcaaagacagtcaacaagtctctaggaagttccaaactttcctgcatttttctgtcttattctgagccctccaaactgtcccaatctctgcctgttacccagttccaaagttgcttccacattttcatgtatcttttcagcagcaccccactcctggtaccaatttcctgtattagtccattttcatgctgccgataaagacatatctgagactgggcagtttacaaaagaaagatttaacggacttacagttccatgtggctggggaggcctcacaattgtagcagtaagttaaagacacgtttctcatggcaacagacaagagaagagagcttgtgcagggaaactcccccttataataaccatcagatctcgtgagacttactgactatcacgagaacagcacaggaaagacctgcccccatgattcaattacatcccaccagattcctcccatgaagcatgggaattgtgggagttacaattcaagatgagatttgggtggggacacagccaaaccatatcacttgaggtatatcaccagtttatttttttgtgcattcttatgaaaatacaatagtactgagtccaaggctatatctgggctatttccaaacccatcaaaatgaagggataactttatacttttagggtgccagaaaagactcttgaacttagtatttgtcttatagctgtgtggaatctagaaagctttgtaccttcttctctgctagtccatcccctggtagttgcattttgtttatgcttttttactaactcttccaactcactggtctcattggtattcaaattcattttcttatcatattcctcctaactttctcttcatatttcccctaactttagtgtctccctaagctaaatgaagttgtctccaactgaacatgtgtagttgatagtaatacaaatagaatacctggctttgcattctttgtgatgggaaggttggagatgctaaaagagaagtgattaggaagggtgtcctgaggaggggagactgagaccattctcacaatagcaggactgatttgtcagtcggggacacatagaggtaaccagggagggtttcacagagaatgaatgggaagtttgttttgaacttggcctttaatattgggtggtattagagtagttcaagaggaatctggagagcagttcatatgtgtgcatattagtcatattagtgatggatagagataatagcatatacagaaaggggaagtgagtaaaatgtgaagtatattctaaggataagccagtttatctgcagctgcgggtatgtgggaccaaagtgagagagctcaaaagccagactgtcacttatcttgaatttgtaggcaatgtggcaaccagagtgtaatgctgaacttggcacgttactttccctgtcatcctaggagacctaggaattctctcaagaccattgccatcatcaattcaagcagtaatttctgagctttcccaggtttgttctctacttccctacaagaaaggacatctcaattcttctcttgtaaccatccattctttttcagtgtgcttccccaaggatttttctaaagtaatgccgaactggctattttataccatacttttcttcccttggagtccttgtcctccgctcaccccctttctcctccatttttttcattggcattagtcaaacccagagatagctctcaaggatggcttcttaaagagtatgcaaatacttgggattttttttctttctttttcctcaagtcctcttctttctcctatgtatttttttttcttttctaaggctgtatgcaagtggttctagccatcagcatcctaaaacaatgtcagtgatttcaacatgccattgtgtaggtagatcagagtatttggtttcagtgcatctttcttggtgcactttgcttttaaagcctttgtcattgtttaacactttttttggttggaaagaaaccaaaagattgatttattcttactctgttttaacaaaatttaattcttatgttatacacatttctgtcatcattattaataatgatgcaatttaaaacagcactatttgataattttagtgattcttcatgaggcagttgaaaataaatctctactttggaaagtgtgaaatattgcaaagcatagttttaatgaggtatactgagatgtgggtttctcttctggcctgaactttgtttgtaaaattaagagagttattttgcctttctagggcttttgtcacatgaggagattagactaactcattggtggggttgcttacagctctaaatcttctctttgtagttaagcccaaacctatcttgtttgtatagtaatttcagccattatctcccccacccataaccctctaggagtatccacagtagaacaacatgaagggatctgagccctgccggcacacattcagaacagtttctgactttgtaagactaggtaaatatgggaagactcaaattggatctttttagggattgactaccaattcagctggggtattcttatatttcacctttttttttttttaaggtaacagctatatgctgaattttaccagaaagtaccaaactgtagactcagcacatagcctcctaatccttttgtcaccacccactaaaataatgaaagatagagaactcctattttcacattacttctaggaaaatattttgacagattcagtatgcagtaaaatggtaagcttttgttacgtgtgttccaaatcatcttgttatcactggatatatcgattagttcagtactttctgagccagtcataaaaaaagacttctctcgttctgcatgaaagaataagagaaattgaaaggtagataaccatattgattcaacccaaatagtaaatgcaaggggctttagacataagtcataaatctctttatgggagttgtaagtctgtttggtattttctatttgacatgaaagaaaataatctctaattaaccatcattttaaagtgaactatgctttgatttgagtttataatacaggtgccaataacataaacctgttacctttatactttgtagtttacaaatgccttcatatgtcttatcttgatccagttctaatggggtctggaattatcataattttcttttctgcagaaacttagtctcggagaggctaagcgtcacttgcctaaaggcacacagccagcaaatggctatggcaggaccaggacccaggcttttagtgatacttccacgtggcatttggtgtatggtgtgctactgtatatgtatgggttaattttctaaaagtagctcctctactggcacgtaaagggcaagagaataatgagctgaatccagcttaagttaaaattcccttcttaggttcatatttcgaaagtctggaccaaacacaccaaaaagagcaatttttcttgtggtattacaggttatagtcatgtgtttttcatttacaaatatggtgagaagtagtgtttttgcaatattcctaaatgagtaacatatgacacaacttgttagaggactttttcttggttcataaagtttctgagtttttgtgtctttagtgggatgactttatcagaaatcctcagacaacacagctaaaatctaaatttctgtggttgaaacacagccaccctcaagagaaaccttagatgtaaatgagaggtcagtaaaaagtgggtatgaaactaattgctatagagggagtaagacttctctcaattgtttgagcccctgaaaaatagattaatttaaaaaaactgtctaggatcatcaaattgcaaaagtagttagcaaggaacagacagaatttgtgacatttattcatagacactaaatgggtgagtgtcgctctacctcagcaaaagaacgcagatggtccatagatagtctacttcagaaaataactgtgaaaataaatgaactaagtagctgtgaaagttctctgaaaaatgtgcaagactctgcaaatgggaggcatattagtttcctgtagctgcaacagaatatcacaactgagtggcttaaaacaagagatttatttgctcacacttctggagaccaggagtccaaaaagatgccacactcattcccaatactctagagagaatatttctttgcttttaagtagcttctggtggccccaggcatttcttggcttgtggcagcatcatgacaatctctgcctgcatcttcacatggtcttcttctaggtgtgtctctctgtgtcctcttcttctaaggacatcagttattggatttagggcccaccttatatcccagatgattcatgtctagatccttaactacctccatctgaaaatactatacatgtatccaaaaaggtcacattctgaggtactgagtggacatgaatttttagggactagtattcaaccctgtataagagaggtcattcttcccatttttcagactaagaatagagggagtctatgctgtgctcaatgtgaaaagcctaagccagtcttttggagggaggtgggcttctccacctcagaactgacttcaggtttagtccacaatgcttctgagccaaatctttaagctgttcaacttgactgcgactatgagaaagacaatggctctggataaactggtaaaatataattgtgcaaaaatgagatttaaaaatcttttagggaagtataaagtttcttttcacttagataatagataaaaaataatttattagtacaaattgacttttttgtgagctagagctaggtgggcaaaccttttctgaaaaataattattttctactatacgggctatatggtctgtctgtcacaaatacttatctctgctattgtagcatgaaaacaaccaaagacagtacataaatgaatggatatgggtgtgtgccaataaaatttgatatatggatactgaagcttgaatatcacatatgtccatgtgtcatgaaatattcttttcctcttttacaaacatcttaacagtgtaaaaaatactcttaacttgggagccaaaccacatcaggcagtgggctggatttggctggcaaaacttagtttgctgacccctgggctagatctagacaaagtttcacacagcagaacacattttgcttcttgtgcctgttatcaacaggaagatggtttttagaaagtggggaaagtcagttttgttcttgtacagagcaaaatcctagagtcaggagaggtatctatagtcaaggaagaactggccaagggagtagaggctctcccaggtctaggcctacagacaggtggatgtaaatgttgtgtacccaggatttgaaatactctttaacaccacaaatctcaccctctattcaagagaatctttttttcttagtgacttatagggtgaaggtcattttaccttttgcttccttagaattagagtgtctggactcccagcgcaggaaaccatttgcatacccagtcttggactcagaatcacaagatgtaaaagaggtgaccacagagataactgctaaaaggaagccagccctattattttatctaaggagaaggtggcctaggccaaacccaattgacattctggaatcccctatagatcagaaggacaaaagcatgtatttgacttgggtgtggggaggtagagatttctaagattcttagaaaaacaagtcctcttgtatagcctacgactttgagtcaaattaggtgaaagggttgatggtctgtggcatcccctacaggctttgcatagctgatgtgtaggggtgttttagtatgtgcatgcacgtatgcatgtgttaggtgtccatgtgtctctttggggagggggtgctgagaaagccagtggacttctggaggaggctagaaattatggcattcttggtactttctgaaatttttgcccagcaggcagggagatatctaggttcctaagtgatgtagaatgaaggagaaataacagacaggatctgtttagttaaggctttaaagatgaggtgaggttcagcaagggctttgggaaacacatgggttgatggagaaaaaaaaaaaggaggctgtatcttagatgtaatgaactgcataaagccttgaaagttagcggggctgtaaggtccatgcttcctatgaatgggatcatgtcactcacatcttaaagtaggtatcatagaagaatgctccaatgatgttgcagtttcatgaagaagtttggtgttgggagaagtagctgctatgctgtatagtttcaaagtcactgttctcatagaaaacagggtgaattatgacttccagagtcagttaaggagatggccccagttctagattgaacctatgctttggccttcctctgcttgtcaggttctcttattcatctagaccttgaagtgaacttactggggaagctgatttcctctgggacatccagaaatgccttccttgtgcatctgctggatatggagaccaggatgttcatcctgagtggggtctgactaaatgttctctcctgtgtgttgagacccccaaaactgcctttctgcagttctactctatttaacttgaataaatgtggccttcagattcttgggaagataagaagctctaacttcccttcccagtcaagattgatggataaaaagggcctacaccagagatgtaagcctgaacccacaatccacatatattataataaatctagaaggagtggtcttattcaatactggaggaaagcatttagctcaaggacaaacatttttaaaaacctagtgtaacattttgagtgagtagttcacactgagtttgatactatgaattgtgattttttttttttttttttttgagacggagtctcattctgtcacccaggctggagtgcagtggcaccgtcttggctcactgcaagctccgcctcccaggttcacgccattctccggcctcagcctcccaagtagctgggactacaggcacccaccaccacgcccggcttattttcgtatttttagtagagacggggtttcaccatggtctcgatctcctgacctcgtgatccacccgcctcggcctcccaaagtgctgggattacaggcatgagccaccacgcccggcccgtgatttttttaaactctgaaaatattatcttacagactgtttgaaagattcactcgatacctgtaaaatccagtattttcttttattcattcatttaccgaatttgcattgagtgcccattgtgtgccaggtaccatgccagaagctggaaaactgagatgatgacatgttgccttatcttaggtagcttaagtccagagatatagacacaaaaacagaaaagccacagtgaagtataatagaacagtgtttggtattctctttaagcagacaaagaatagctatctgaggtgtttagaaaagctttttcaaggaggtagtaacttgaggctagctcttggagtatgattggaagttttcttggtgaagaagtggaaatataagctttcctgcaatgtaaacccacatcaagttgtaaattggcttgatggcttctgggattcatgagacacaagagtcagctgtgtttggagagaaaaagaaagattggttgggaagactcggggcttggtatcacctctacatgatggggagtcttttaaatcattaaaaggtaaagggcataaggtataatcatggtaaataatgtttcagaaagtccatcttgacaggatgattggcaggggagttgggggaagggagtaacatgttagggctggtgagattcgaggcagaaagattgaaaaggctgttgaaatattccaggccagaaatgctagcaatttgaattagggtcatttctgagacagatttttaagtctgattcaatggaaatcagtgattaattagatgggccattgaaaggaagcccacatagaggaatttaaaatgatgctgagatttctagcttgggcaagcagtggatggtgataccattacccaagattcctttctttgacactgagagcttcagaaagcaggtaagtttttccctttatctcttttattgtcatgctgtcatgatataggctttgaatgtcatgatatttgattaatgtttgcacagtgcttcttgttgtaaagctatgtacaaaaaatgatcatttccttatgcttcattgaaagatttatttcttacaaatggcctttttggttcaccacttaaaaattaatgtcttacctcagagaggtttgatagtactttagagagcatgggaaaatatgctgaatattttcttagaaatcatagaagtgataagtttctattagtaatgcagtatattaaatattaaattatgttttgtcttttgtagtttttgaagtcaaatgaacacattaccagttgaatttatcttgtactgatagctgtggacttttctatgatacttcctgactttgtttcttttagactgaagctggctacacagggaacatgtttacaatggagagtgggaatgactttgcactcagtgctattctctccctcagtccctatgataaaatattgatggagaaatcgcatcctttgattttggtggagttggtgtagggttgttctgactatctgtatataaattgttacctcaaaaactgtttgactcagctcccctgcctttatttggtgaccatggacattgccttttagttaagatcagtgaatttctggtggtagaagcaggaggaaagagtggaattgaatgtacaatatttttgcactccatagttcctaggattgcaattatgtttttttcaaatatagagaaattaatcataatgtatttacttgactttacttatgcagtcagtctcagttctcaactatttgaaatactctgtaactcccatatacttttgtattttgaaattgctgtaaacacagagattttgagatctgaaagcttcacttcttgcagtgaagaatatagaagcctggcaagagaaggcctcaccaaatgcctcaccttggctaattacagaactgagccttgaactctctacccacaaatctgggcattaagtgaaaagaaaaaaaatcagcattttgaagaacagcttatattctgttaattcacatgaattgaaagagcagtactctgagaaaacggaatcattattttctttgagtgggggacaaggagtggcagtaagactgtagaggtgatagtggtactatttataaaattacagattcttgattctgagagggctctgcaaagccagccagtccaattggcttaatagaaacacattagtctgcttttaggctgcatattcctcactcaggaatgagaaagtcctgaaaagtcacaggtgaaaccttcatctgagagagcttgcatcaaaaataatcaagtgcagtgtggaacttggccattttccataacccaaagatacatataaaagttccttagttggtaggctccagcaaacatattagccatatgaaaaagcaacatctaacttctatattttgacttatgaaggaaaaggcctccctgtcccataaatatgtacatttcacctcctgtggggaaaagaaaggaaattgtagctacagtgtgttattgaatcttcctgaaattagcctttagagttttagagtttggtaagattgaacgattgactgccaatgccttccacacacaaaaaacaaaaaagtattatatgtttgcatcaacactcgttcaatgctgaaatacagctagtcaaaacccatgttaaagtttttcatatattacataacaccgctgtataatacattaaaatacatactggattggagataaattactgaagaaataccagatttcgtttgtaggttttaactgcaacataattcattgtgtgatttacataggtagacataagtacatttctttccaaactatatagcaatatacgtataaaagctataaagtaaaaaaagcaaaaccatactagatgactgctaagaaaagatgaatgttaattttttaaatagcaatctgatagtaattttaaatagcaatctgatagtaaacatgatacaagaggaaaggttttactaatagacatttaaaaattatgtcttcataaatcaagaggatatattacttagagctagaaataacagtgccgtgcttcctgttttgaataagccattatgcatttttgtctttgcatccctatttaatttgtacagtgttatttattccaataattagtgttaactttcttggcagtaggcgttataattacctttaaaatttaaatgggataaaaatgccttgagaacatggtttaggaaaactcttaatatttattttcacttgtctctttaattattcatttatgtagtatttgaaagaaaatcttgagaaatggaaggccactgacagaattacttcccagatgagcagacttggtttttcagttggttgggtgacattctggactgttgaggcattagtgatgccaaatggaagctctactacccattcaacattgccaatctaaatacatttcacttagaacagcacaggccactttttcttattctctttcttctgaaagtaagtcattatttaaaataagccattattctgaaaataagccattcacatgacttctgatttcaaatatacatatgcaggtgattattttcctaaatatataaattaatttgaaactagtttataatcttgataaatgctgtaactctgaataagcatactagtctccaagaaaatcaatgtttcaaaaggtggaagggataaatctagcctgtcctcagccattaaaaagtacacaagcaatgtcaaggtaaggttgacagtattcattcatttattatgtattgagcacatctacatgcataatatagttttaatctttacagggggatccaaaaactttagaagaagagatgactggatttttgccaattccagtcataatacctgacacagaataggtgctcattaaatacatgctgaataagtgaatacatcccctggagagctgaagagttcatagcatatctgaagcaattagacaataataataagaaaatgtgtatgcagttgtgtgataacaagttataaaatcagggtattgcatgtgcaggcctttcttgaagatgacagcccagagattgaccagaaacaagtctgacatttgaggaagttagccttctaggtgagaggaattagataatcaaagatcaagagtaggagtaagcgtggtttcggtaggtaacaaccagtcactaaattaaaaaaaaaatcaacttcgtttgacctttatcaagcacttatcatatgcagagtatggtgctagggctttgagagacacaaaattggaaaagattgtgttctgccttcaagaaacttacatctagcaggacaattttgatatattcacaataacagcaaagcaacaaaatgaagtaaaaaatcagggttgcaggagagttcagagtaccctgggagcccagagcagacagaggtgcatgctggcaggtggatttaggatggctctagggaagtatggtattggcatctgcactaagccctacaagacactaggatgaaatcatgggcattcataaacttttggggacttcatcctttctgagaagctggtaaaatctctacccccatgtctcagaaaaatgtgacttggaaatactcaaaccatttttcatgcaattgcttaggcttcctgaagtcaaactgtggacctccaagggaatccatatacccagagttgagacctttgcggtagtgagagaaaacttgctttggaaagggatagagccatatttaaattgcaactgctacctttagctttgtgatttggacaagtttctcaagccttcagagtctcaatttcctcatctgtaaaacaaggataataatacttacttgagattattttagcatagaacaagttaacagaaatcaccggatcacaccaggcaccaaacacattctacttttcacaataccttggggctgcttatgttttattgagagcaggggagttggctgcatagctgggttattatcaagtgctgtcttttttctatcctttcttaccaattaacagattatttgtattttagaataatcctcaacatgcaaaactttatgagtacacagggcgaaattaactgagaaatatcccacactggattcttaggataagaacaccagaaaatgagcctaaatgttcagttgtaatgttgatgatcacagtgtgctaaaagatgtgtgtgtgtgtgtgtgtgtgtgtgtcagtgtgtgtgtgtgtgtgtgagagagagagaatgaagaaaggaaagaagaaagaaagaaagaaagaaagagaagagaaaaagaaagagaaagaaagaaagagaaagaaagaaaggaaagaaagaaaaagagaaagaaagaaagaaaacaaagaaagaaggaaagaaagaaagaagaaagaaagaggaacggaatgttaaaatgggactttagtagtgtctctgtttttattttccccaccagagggctttgggctttcttaggcctcaggtatttccatcttcatgtatttccccatggtttgttttgatttactgatggatgactcaagattttggtagaaacatgcatactcacaaagaaacacacaaacacacacatacacatgcacaaaagcatgcataataacagaataaaagcagcaggtgacaaatacatactttagctgttgtacaaacttataatgtagctttacaaacatgatttttagtgaagaaataaaagaagggtagtgatgggtggttaggtttagaatcaaaagttactcagctggttgttgtacaggtggctcagtttggctttgtatactgtgaacgttttgattgcagggcttaaaaatatgtaatcctaattttaagaaaactaatggaataaacactcattatgcacacaaaagcccttccattcagcttttcattgctttgcagttattttctccaaaataaaatgagtaattatttggaagtactttcagcacatgcaccatgtgggctaagcttgttcccgacatctacaatcctttgaatggaagtgccaaaggcctcctgccaccatgggccacagccaagtgtcatgtgaacctgagtctcacaggttacatgggaaataaaggacagccagaccagcccgcttctgggaaagatgcaaaatgcaggaactagagaacagcgatgaggtgtttttggagactaggcaccaagtacgtatatcttatgtttaaggatgggtggacaggtggatggatggatggatggatggatggatggatggatggatggatggacatttcaagcaagcctaaggacatagtaagtttaggatctacataatggctcaccagggcatgctaatttacttacataaaaaagaaatctttttcaaaacattatacttgtgatttggtttaccaatagttaacattctatattttttagcaaaaacatattaaaaatgttcctaacttgtattatttggatgtgttttttttcttgtactgagaaattccaaaaactttacttggatagataaatacctaaacctcatgtctttggtagagtatatcagggaattgtggtgctcaggaaatggcagatactattctcattattattattgttagaaggacaaatagttctagagtatcaggaaatgagagtggatatagcgtggtaacactcttgtctgaggtgacctgagtagagagatcaacagaggactttgccatcatctagctgatgagttgtgtggtcttggattttcttgtgttggttacacatacactgagcaggttgcgtctaccctctgagctgactttctcagctgtatcagagggagaagtaatctttgctttttactttctttaaaaggctgtgtgactatgtcctgaggttgtggattgtgagtgctgtgtaaactgtgaagtgtttcgtgcttgcaagatgagggcttcatacatcttcagtagagctccccagatgcttttatctgtgcaattaaaattacatatgtgttcttttcaatttctatggttgcaaaaatgaatgtatcagtctacgtagtactcaatgacagaatggatttacttttaaaataccatgttttgagctctagctttgcatatttatgaacttctggagttgtccatgtggatgtttcctatgctaccctgctttcttgcgaatgaagaggtctgaaatgcttctggagtacttctatgtcagttttgcttatatgcatttaacatgttggtcttacaggggagacatgtcttttttaagtataaagtacatatttctggcctttttcttccttctctattgataagttgtaactgcagtttttgtttgtaggctttccaagcctggtgatttttcatctgattcaacctttctcttgacaaaacaccagcctcaaatgctttgcccattcctggtcaaggcttagacttgcacccttccctagtggcaagagactttcagttggcttgttgcctctcggaagactactttcattgcatcgctgacttttttttggctttggaggcttggggaactatttagagcatttatttatatgaggcaacattgcccaacagaaagttactttctgtggactttccatcattaagatgaatttgtgcctggtatacattaatttcacccatacttaatatctcagaagttaccctgtgagacaccctgtgcaaacattttaaatgaattagatcatctatgtacaatctaggtctgaaaggcattaaaagtttttaaagtgtcgtcattagagaagaagctatggaggctacttttaataagagttatgacaaaagacatgtctctgacataagaccaacatgttaaatgcacagaagcaaaattaagaatagattattattgtcataaactaattaatgcatattattggcccttactaatcagaggctttcaaattagaaatagttagctctgagatttctgacatttttgaatttagcaatgtccagcagtgataattttgaaggaagctattggttggcctttaagtttgtaccttcagcttcaaattcagcaagttcatgcaatattatatgggagcctcggtagattttactgaaaatgtgatacatttcttcaaaaaagttttaaaaggcagtatttcaagtttgattgataaaggaagtatccataagttaatgaggcagtcccaatttctaacctgggccctttcttataagcacaagtttctgtaactgctcaaaatagcacttaggcacttagaacaaatatatacctggcccacctacacacctatttgattttctaaatgttggagctaagctcctaagattgcaaatgaacctcaataagcaagtatcaatgtgaagaataagcaccccagtagctaaattgagaagtgcaattgtaattatttggtgaaatagaaatcaggtcattgcagctgcacattgtcgtagaataagctcaaaaggaaaatgtcttcattttgactaacattgccatattttaactttgggattgttataacttgttttttcacaggtattatctgtattatgtatgtttaggaatcaaagcagttcttacatttcaacagctaggtaaaaataaatgtgtgtaattgttgaaaagtatttttagtgtttaaggagaaagcaatgctttttgatctaagtagcataactcaggctggattccgcagtagacatccctgactatagacatttctgtaggcaattaagtgcaaattaagcatgctaagacccaaattagagtcaaatctgatgtgagccaatttactctgaactacagtcctggagtgagaagtgatctgctaggttgctgcttagctcagatcttggtgctacctccactgggacaggaggaaaaggggagatggaaggaagaacaatgaccagtggcttaaagtaatttaataattaactttccacattggttaatttgtgcattatttacacaaaaccagaaacatttttaacccagtgaattatccctgcccatagcaggaattattggagaatgccacaggaatatacagggctattgaaagcatctgcttagagcctttaaagcttgaaccatgatagcagaaatggtgactttatttttataaaaacttgaatttttgttttttaaaatattctattaagcattcagtattatcattaactaaatgacattcccaaattctagaatgggagagtaatttctcagtggagaaatagctattcttatacataataaacaacaatgattctggtgaaatactattgtagataggaaccatttaggagccaatgttcatgtatatgtaatagtttcagaatctaatgttcagaatttccaaatatctcccgttttctgcatagctacctcccagacccgtatcaaaatatcacttaatcttcattttttttaaaattaccggtctatttatctcttttgtaaattttcagggctttgacatagaatgtgtccaggtgaaaatatattacattgtctctctctttctctctgtctcaatctctttctttctttctctctctctctctatctctctctcacacacacagacacacacacacacatacatacatatacacacactcctatctgtaaccatttttcttctttcttttcttctcaggagattttaagcaaaaacagctatgaatttttctatttaacaaataccaacatggaattcagtagtatattaacagtggaaattttgaagtctgtattttttttagcaaagcctaagtgaatctgtgagaactaataaacatgataacaaaatgttgcatctcattaattgtttttattctgacaaattcctgatgatttcatatatatttgagacaatccagaaatcgagcaatggggtgaaaccattgatcttattttacatatgctgaatgaaaggcccaggaagagagagatgccgtaattgacaacagttcttctgactctcacataaatgtatgcagcagcagtgcccttgtcttttgttcttccttcatttagactgagtcaatccatcagcacacattgattgagcacctactctgtgctagatagtgatagggtgactgtatgagttattgttctgagcaggacagttttgaaagtgaaaaggggcataaactagtgaaacagatgcccgactccagctgagggacctttgacaagtgacttcgcctctttcagtcaatttcctcaactgggaatgatgataatatatgtatcaagtggcatgtgtatagtgcctaccagtacctgctacacacagtaggccctccagaaggttttgatttcttcctctttcctggaagcattcctacttctggaatcctgggtgtttttgtccaatacttaatggcatttactgaatgctgcctcctattggggtcctttgggtgcatgcctgtattctgttagtgctgtttagaccagaatttcttggagagctgggtctatgtctttttatctttgcatttactttgatgctgctagttaattaattaattcactagctatttattgaatactctcatttagcaaataatatatatatttaagatgagtacagaaagataggcaagtaaaacaaacctgtgtcaaatgaaaaaataagaacctgtggagcttaaaggattgatatagtctctatagatactttaacgcttaagcagtggcttgtgactctaggggaattttcctgactacattcagatgtgcaaagcatcagttttgttgtcatatatgttggcattttcattggaacaagaagataataaatacaaataaccatctctatatcatagggtttccttttttaaaaacaacaaattatcaggtttcattttcaactattaaaacaatcttgccaagaacttatttttaaacctgtaattttgtcaattttgagatttatttcaatttttttagatgtccaaaaaataatttatgcagattacaaaatctagttttcacatgaaggtatccttgtttctttatttttaattcaaatcaattaggtacatatcaatgtgttgatttggtagcagaaaatataatatgtaatacctttcatactagaaaaaatgttgaagggcatattttcaaatgtcatttagctgatgagatttagagttttctacatatttacttcttaagatgatattggtacttaagtaagagctcattattttaaagcctttgatttcccttctgcttgatccttctgtgaaaccagaagcttgtgtctttagcttcctagtctctttttatgcaatgtggatttttttttggtatgtgtagtacaaccaaggatgtcaggaggtgtgtcgctttgtttaatacacattgatgtttaaacatttaaatattgctaaagaaaaccagctggcaaataatttagacgtatgtatggtaagtcattcctttttcctctttctccgcttatccccatctctttcccttctttctgtatttgatagctactatgcactagacatcagatatgtatatgcagctgccttgtacacatctctatttggatgttcccattgggacctcatattcataataattaacactgaacagctgatggcgctactatctatgccagaagcctggaatcacctacaatctctccccctccctcatgttctatagcctatcaatcaccgaatcctaccttcctcatttactttgaaactgtagttccaacactttggccatcaccttacaacaggtaagcatcatgactcagctgatttctgctgctggttttcttacctctggccccacactgctgaacccctgccttttccacgttgcagccagactgatctcttagtgccacccattgcctaaagaaagaagtcaaacctctggagatccccttgtgacctggcccttgctgcccttgccagcttcttctaacttactgccttccagctatatgaagtgtgccatcatacttttaccagctaatctcagtttactcttgatatcctttgggaagacttctcaaagcaggtattcctcttttctgttcctgcagtttttgtagtccttacgccactgaaactcgtctcacattctattttgattgcctgtttacatatgttactctcccaatagcctggaaactccttgagggcaaggagtatagtgaaattaatttatcattgtatcccttgtacctagcacagaacgtagcacttaagtaggggcctaataaatatagtcatgaatcacttaacaacagggatgcgttctgagaagtgcatcattagacaatttatcattttgtgaaatatgatggagtgcacttacacaaacctagatggcatagcataccacacacctaggttgtatggcatcctattgctcctagtctacaaacctgtatggcaagcgactatactaaatactataggcaactgtaacacaatggtaagtatttgtgtatctaaacatatctaaacattgaaaaggtacagtaaaaatacattattataatcttatgaggccaccatgacatatgtggttggttgttgactgaaatgactgtacttgctatagtgttccttgttgtattagtttgttaggttggctataacaaagtatgtactacagcctgtgtggtttaagcaaaagaaacacattttctcccagctctggaagctagaacactgagacaaaggtgtggacagtgttggtttcttctgagccccctctccttggcttgtaggttgccatcttctttctgtgtcttcacatgatcttcctgtgcaagtctgtgtcctaatctcttcttgtaaggacatcatttagattgtgttagggcccactctgattaccttgttttgcctttatcacctttcttaaggccttatgtcccaaaacagtgacattctgaggcagtgggggttaggatttcaacatacaaatttggaaggaggcgacaaaactcagcccattgcacttgcccttcagatattttcagactagtgcttgattgtcctgaaggcctgtcttacgagatatgaatagaaatgtttggagtgggattttcacaatggcctcctggagtgtctgtggttgggaaggtcccaggttttaagtgtgtgtggtccccaggaccactcctgggcaatgagtttctctttttctagttcatggattcaactggtttgattgcttaaggagcaatgatgataggctgtgttcaggaaatcagagttgaacagatgtcttttggtaatattggctatactgccagatctgagggcttttcctttactttcagtgcccagtgaatgatattataactgtttagaatgtgactattatcagaatgcaaacatgtttgaaaaactttacccttagcttctctgaattgacttactactgttaaggcaaacttggatactcagaaagtatttggctggctttgttgcattttcaccttcttgatgaatggaatctattagttatttgcttattcagaaacatgtgaatcatctatagccgattctctctgtgtgtttgactgactgacattgtctgccatctctcaagtattctttctgtatataaaatcctagactcctgtgcagtttaaatataaaattaaaatgttaccaaaagactcaggtattttcagcctggcctgacagcccatcttatggaaggcctgtttgaactgatgggcccttgatgtcagcagacccagacttttcaggtcagaggaaagaaagtgtctagaatcatagatcttacagagaaaagaggctacttgccttcactgcagtttgtagtgagggactgttgtgatcaaataatcaggaaagagcatgcctcaagttgtcagaatgtgtaatcattttatgccaagtcaaggataactcagtaactgagcaaaaagctttttgttttccagttaactagttagttacaacccgctctctggcagtgtggaccatagaatcatagaaccacagagaatgtagcagtaaggacccatagataccatctagtctaaacctcatttagacatttagggaaattgaggcccaaagaagagaatgaacttactcaggactatgtgttgggccagagactgagctggcacctgcatttaggtctcctgaccctcagtccagtctcctttcttcattatatcagagtgtttaggcctctgccagccatctcaccatttagaggcactatggcttaccatctcagttgagaggcaagagtgtttagcagttaagagcatgtgctcaggggctaaactgcccagatttgtatcccctactggctctatgacattcagcaaggcacttcctgtctgtatgagtttgttagcattaccagaacaaagtaccacagacttggtggcttaaacaacagaaatttacttccccacaattttggaggctagtagtctaaaataaaggtgtcagcagggttggtatcctctgaaggtctctctccttggcttgtagatggccacattctccccatgtcttcatgtggtcttcccctgtgtgtatcttaatctcttgttcttagaagggcattagtcattttggattagggcccacccatattccctcatttaattttaattacctatttaaagaccctatctccaaacatagtcacaatctgaggtagtggatgttaggacattcatatatgaattggaagggggcacaattcagcccataaccgtgtgtctacgcctcagttatcttatcaacaaaacagggatgataatagattctaccccaaaagggtgtgaagattaaatgaattggtccaacatagaatgcctagaacagtggtagtgtgggttgttaattcataaactgacaacaacagaatctaggattttcatttcattcgcaagtatgaaatctaagtgtttaaaatgtcaaaacatttttcctactttcatttacttattcaacagttgtttattttatatttgtgtatcttatattgtggtagttgccattctggtctgaagaaactcatagtctagagcggagacacatgattacaatgtgtacaaagtgcaatgaaatacgagcagggagtcactaagaagaactaatttgacctaggagaatctaaaaggcttcctggaggatgtgagtgaggagccaaatcatgaagtgtgagtaggaattggtcagcaagccaaatgtaggaaaaaatttagacctagggcacagcatgaataaagtctagggaatgtggtggtgagtggacccaatgtagtttggtacagctggagtatcagctgtgttggggaaagtggtatgtgatgagactggacattttgccatgctcagtaggttagactcatattctgtacgttgaagctggctaatagtgatggctgacattactaattgattacatcactcattctcactaatcctgattgagaccttaaaatccatctcaacacagctgtttaggcaaccatcaccattcaactggagttggcctgtatcccagctgtagacagtgacaattattaacgaataaaattaagtcagaaatattcattttacctaaaactactagacttgagattattagtttaaaactgcatagttccttaggttgcaaaaatgttcttttttttttttgcctgatttgtagatgtgataggaacattcgttggaagaactgtaagtagataacatgtagtaaattgggtttacaatgattttctaaaaaaaggaaaaaagataaaactgtctcacattttgatctgaatttatcaggctcttgaagttcaatgaaatgttcaaatacatcatcatatcatgaccattggaatcttggcctaaaactcagcatcggaaagtttcaaggaataatacgtcttagcgtttttgcttctactaagggatacatgattttcctcaagaatgcaaacaaagcaaaatctttaggattgccctctatcgtaataaggcaagcatttaggactggatgtattggtcagcattactgatttgtgtcacaagacccacagtattccagaaaacttgacctgcttttctgtgtgccatcttaatacttatgtttttgttcagaaaagaaaaggttcctgttagggagataaactagattaaaatgattattctcagttttggtgagttgtatacaatttttataaatcatgtactattcatttctggcaagataaagtcatttattttgtgtcatacatataattatatataagcatataaaacttacatgtagttgcatgttctatttgctttcttaggttttctcttatatgtgtgcagagacaaaggatggtatcaatgaagccatctcaggtcagtttcttgaggaaattgattctgagatgaagatttttgcatgtgggaaggttcttggggagtgcatttatggtcaacacttgtgaaggagtaaagaaaatgaaatgactctttagagttgtcctgaattgaggcaaggtgccagggtttttgtttttgtttttgtttttgtgacagagtctcgctctgtcgcccaggctggagtgcagtggcgcgatctcggctcactacaagctccacctcctgggtttacgccattctcctgcctcagccttccgagtagctgggactacaggcgcctgccaccaggctggctaattttttgtatttttagtagagacggggtttcaccgtattagccaggatggtctcgaactcctgacctcgtgatccacccgcctcgacctcccaaagtgctgggattacaggcatgagccactgtgcccggccaaggtgccaggtttttaagcccctgcatcaactagtaattggatgtgggctgccccaggaagtaggcacaactttgagtcaggagctttcttagggtaagggaaattcttggaaaggtgactcagtggagggcagccagcagcccgctctcccagaagatgaaagaattagtgtttctgctcagaaagaggcagggatctgggacacttggaacacaccatggacgtgttcatctggacaaatatgaatatcctttgcatcttatggaaacctgtttttacattgatggtggtacatttaatagatgtttagcttatgatttcccatgtctaattttagttcttctaccacttctctccagagtggtctgatatatgcttcttttgcttatattgtcttcagttgactcaacttgatgtctgtttctggctctggcctcctggactaagccacataagaaaaggccatcatttgctgtatattgatataattctcccttctgtacacatcagatcttgtccgcccaaggaaaggaagttagattgcccagaaacaatcagtcgtttcaatggaatgcatgttcctggcctcacctggcaacaagttattatgtggcatgaatttacaatgaattcaacttcctttcctcttgccatacttcaaagtgaaagtaaaaagctgagtcccatttaagaaccaacccaaatgtccaacaatgatagactggattaagaaaatgtggcacatatacaccatggaatactatgcagccgtaaaaaatgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtcggggggggggagggatagcattgggagatatacctaatgctagagacgagttagtgggtgcagcgcaccagcatgtcacatatatacacatgtaactaaccagcacattttgcacatgtaccctaaaacttaaagtataataataaaaaaaaagaatgaaacaccagcagacaggaagctgtccaattggctaggaccaacttattgatgatgccttatgaagaaggctttattagatggagaggactctcaactcaagggtgtgggactattgcatacaatttaatgtccatcaactttgctagataggggatggaggagggtcaagtggagttcataaagttcaatagctacaataagtaaattttttagtgttttcagtcttaaaagaaaacattggctttgttgtgcccaaatcatctgtggtttgtttgcatgttttgctgctttaactccaagagataaatgtacataagcactatgtgttcatcctgctaatgtcatttaatttaatgagtttagaaaaattacttgattaaccttttatagtaagggttttgagaatttatgtttacattttaaatttgaaaataaaataatctatcttcaaccatgaacaaggtatcacaaagcactttttttttttttttttttttttgagatggagtctcgctctgtcgcccaggctggagtgcagtggcgcgatctctgctcactgcaacctccgtctcccgggttcaagcaattctcctgcctcagcctcctgagtagtggggattacaggcgcccgccaccatgctcggctaatttttttgtctttagtagagacagggtttcactattttggcaaggctggtctcgaactcctgacctcaggtgatccacctgcctctgcctcccaaagtcctgggattacagatgtgagccaccacgcctggccttcataaagcacatttttaactaccatccagccattccagttaccatttgtgtgggctaggttttacttttagcttcatttcaacttcaccaataatcttttgagagcctattaagtacaaattgtattcgtatggtcaggccccatctggtgacagagagactatgcatttggatgttgctgacacctggtcatgatggaatctgtgccattggaaacagaggcccaagtatgtctgagataatgacactctagtgtaatgcatgtatatagaatccgaagacaggcctgatgaataacaataccatctgacagcaaataatcaacgcaggaaatttaggccacaacagcttgcttgctctttacactgtcatggttgattggttattctcatcaccctttgtttaaaatcatttcagaattaattggcattcattaacgaaagtctttgcagtggaattgcagaaacagtcattaatgtagctaataaacataaaaaagaaaaaaggtcctattactgggtccctacaggctgttaactaacattttgaataagaatacataaacataaattaaacattttttaaactgctaagaatgtgggaatttcacatggtggtctgtaataatgctttgaactaatttgttccttttttaacatgtagtttagagaaagtgattctgtttagaaattattattgtgggtgatctctcagagaagccagggcaaagccaaaggtaagccatcttatcagccaatagattttaactaaaactagagcactcaaatgtaagtatgacaataacaaagtctaacatcatggagttatttgatcacttagtaggtaggtttctaaggtataaaccttaatgagatttagaaaagcactcattccacaagacaaagaaacaaatctttcctttcaagaagtaatgctttattgatcaggtgcctcagttttggtttatcagtgttgcataatgttgtataatgttgccattagaacaaactccagagaacatccacattattttggaatgatgaaatggtgctgacttctgtttcagttcaagggcctagggcttataaatattttcaaattagttctcactcataggtgggaattgaacaatgagaacacttggacacaggaaggggagcatcacacaccggggactgttgtggggtggggggagaggggagggatagcattaggagatatacctaacgtaaatgaggagttaatgggtgcagcacaccaacatggcacatgtacacatatgtaacaaacctgcatgttgtgcacatgtaccctaaaacttaaagtataataataaataaataaataaataatattttcaaattagtttctgactcatatctttatcttcatatacatagctctggttaactccaaaatgtgcaccattctagcagagcctggatagaaaatccatcaaattttcttattcttctgtaacatgactaggcatttccagttatccaaagggaaatggaaaaaatggcataaagttttaaaactttactttcctatttaaaggatatttgtgtcacatgtcagtgttgtgtttttaagaacaagacaaggtatggagagagtctgtgctctaacaccaaatacagtagaaactcccttaactcatcacccaattcaaaatttgcaagattaaccaacactctctgaaccctgtgggaagtatgctgactgctgcccatgatatatacattgttggccagaggcaatttttgggtagactgccacttctgctcccaaaagttgaattggatggctagtgggggctagttgtgtttgctcccaaccctgttaatgccagtcatacatattattgtagttatgtaattaaatttagtattgcataaaccaaagaaaaatgagtggaaaagaagaaagttgtttcccctataaaatgaatgttttggaaaagtttagtggtatcagtttcctattccttctcaaatggctttaagttcctactccactttcaggaatctcaaatgagcaaccttagagcatgtattgtagatgtgtatgttgtggaaatccagtcagtgagtctgtactcaaaggccttggccttgagttaaaagatttacaattttatggatgaagttataatataatttttaatataccaaatgttgtgataccccatttaaatacaatcctttgatttgatggccaactgagggttataatcaattccagttgaaagagcttctcctctaactggagagtatcaccattgtaggctgagatttactgtctcaaatgaataatcagtattgagcgttatagatcttgcctttatgtcctgctactacatctacagcagatgggtcaggccatttaccaatccgatctcctcaggcacatttctttccctaggccattgttcataccatttttccttatatacaatgttccttctgtcgccacttttttcaatctttccccttcctcttcaacaggagacatttatctaattcctagttcccattagaaaaaaaaaaagaaccaatttaggtaaatttataattctgaactttggttatttgaggttatttgatgtatcatcttcatacttgagtagctgaggtcatgggtctgcaagcacctggtggggttgttgtatacaggatgcaacagagtccagcccagggctctgagccttttctacatggaaaatgattttactgcatttataaatgatatgactatagctggtttgaaatatatgtcatagctttaggctagaaaaatgttttgttaatgtatttgaatgtaaaataccaggacaggtaatttataatgggatattgatacacttttaacaaattccagatctcctcagaagtgcaaatgctgaatgtattgcaaccatgtataattgtattatggcaataaacatatacgtgtgtgtctagagtacacatgtcattgcaggcgtcatagtacagtggatttgtattgaactttgactaaagtcagtcctgatttcatttaaaaaattgtgttaacctttggtaattagaatataaaaccaggaagactcaaaattgttagtctaacttttgtttattgactagaacatctaaatggctttaggcatcacaaaagtataaaaaaagtggcttcctattgggtctttgatccatcttaatttatttttgatgctgtatgcagtttctgaatatcttttgtggcttgtaataaaatagccacagtgcaattttgcatgtatgtcaagcgacgcgtgacctgctatgcaaatttaataccaaggtgccaaagctgaattcataatgtttctcagctacagagctgtttaaggcagtttagaaatcaatgaatatgtaatatgaaggtgataagacctaaataaaaaccctatttatctactatgaaaaagtatttatacacagaatacttagcacatgcaaaaaatggacagagtttccaattatatggtttgcataaacaaatgttaaactgcgtgctctgaatagataataatgtgaccagtccctctgcattgtgctttaaactttgaaaatgtttacagatgtgtttcccctcttaagatataaataaaacaaaatgtgcagctgaagcagtgggatctaatctgagttctagtgttttttttttttttttttttctgtattttatgttagcctagattctatacttgatatagggctgaacttctttaataccagggtaagcagacatgtgttttatgaagtcttgtgctttattttgcaataagaaagatcaactgacagtgattgattaaagtgagaaaattctaataacccaggttactgtagaatgtgtaatattatttggatctgaacttctgatatgccactatttaaatctatatgatgctattgtttctgttggagtggttatgccataattctggtaaacatttgaggagtttgtacagtagctgactacagtgtgagaagagattaacagggaagacaggacttgattgatgggagtcagtcctggctttttatcatgggaaaaatatatttgtgcttctacccagagagaaggataaagcaagtgagtgtgtttttgtatgtgcaatgtgtgtgcttacatgcatatggaagtgcgcataggtatacctgcacatgcatgcattcacacatacactcagtctgtactgtttatgacgcccctgccagtcagattccagacacatttatatcctctggtttagagtaagctgctacgataatgacaaatagtgtttagagcagtcaaggaaaatgtaggggtgatatttgaaaatagcatctataatgccatctgggtggtgctgatactttggagagcatggaatacacctatctagagggcaagtgctctcaaaacaaagtcagaagaaggtctatatggtagggaaagtcatgactcttggtagataatgatgaactttcactcagggtctgtatttaggtctttgaaggaggaaaatcaatttctagaaatttagctcagttaaagccacagttggtccttagataagctgccagaatagacaccacagctagaaaactgatgggtccctgtctttgaatttttacttgccatatgtttcctttggatagcagcatactcaataagaatgcttaaaaaccagacagtaattctaaggaaggccaaaataaagagcaagtataagtatatccgatcaaatgtcaatgttttaatgttaaattttatttagattgttttgggccattgtattttcttttaaaaagcttaaacacacagtaatttatgcatttcacctgaaggttacatatcgttttacaaatgggatgtgatttcaggcactgttcatcctgtttaagaaatggagaaactgtcagggtatgtgatgtgattctcaaaatatcagtgacatatttgggttgtggagactggtgaaatggagatgtggcaattaccagggtcatttcaacaacagagacagccaaacttgataattcagacaaaaaattatctaccttggccactttcattgagcagatgaactaaaaagttgccaaatctcaacttcctgatgctctgttcaaaccagccttccctgcaacaggaccaggcaagcaggctgactcccagggcaggctctcgttctacttagcttaattaaatgtgccaggcacccgaagtggtggagttacccaagggagtatttgagccccatattgatccaaaggaagggagtactgttgaagtgtgtgtgtgtgtgtgtgtgtgtgtgtgtgtgtgtgtgtgtggtgattgcggggggattctattctgaagtgcccaccatgtttctaaaagagcctcggtcctggcactgaggcactccatcctccacaagctccactcccctgatatgttctttccaataagctcttctgtccttggctttttgcagatgctgccgtgaagaggaagttaataacaggtgttttggaatataactacagaaaagcattaaaaattgttgttgttgttgttgtttagaaagaacatctgtagactcaattatttttcaagattctaatttactgctgtgcaaactacagggcaaattatattatatgtatttagccctactctgttgctatactcctgagaatttaattggcaagcaaatgtcctgtcaaaatgccttctgtggctggaaatctttctagctcttagagattataaggctcaaaattaactagaattcccctaataaaatttcagttcataatttggggcctttgccctttgtattctgtgagaactttttggtaggtatgatgggagagagagagagagagagagagagaatgtgtgtgtgtgtgtgtgtgtgtgtgtgtgtgtgtgtgtgttttgtgcccatgtgcacatgtgcccacaccattatggtaaattgccttggtggattccactcagctgtgtaaaaatctgtaattctggcaggaacaattatatcatgtccataatattgaaatagacctcctaggtttagagaaaagtggtttttcgcagacaaaattgtgttctaagggatgtgctagtaagcattttgatgagcacaagcttatgtgtggaaaatgttcgacccatctctcaacgcctggtggaacactcactagttttaacatttaaagtgctttttaaaaatggcactttaaagaatcatatagggtcctccatctgttctgatatccattccttcatagataagaaaaatatgttcattgttctagaattcattgccatgataaatgacaaaatttccagggaatttatataatgtccaaatgaggaaagccaatccaggaagaatctgcattgaaaatataaccattatttccaaccattatccatgatttcagatgttcaaaaatagaaacaaaattttgaaattattttaatactctacagaatagcactattttcctgaagaaacatttttctagaatcgttgctttagaatgtagttttcagtgcatctttattgggaacacattgtggtacactcacacactcagttttaaccctgaagtgtaatttacttggcacttaaattgattttatttgtggttgtatgtctgtgaattagtctgtaacttactgtgaaatttgccatctctgccgtgatcaacccatgaaatttatcatctgtctctctgatttacacaaaactccatttataatcatcaaacccaatttacaagtgaacagtattaaactaaaattctgaacattgaagcattttgacattgtatttgctgtgcattgaaaaagtaaattacaagtgtgaaccatgtatagatattttgacatttatatttttaggtttcatttgatcttaagtgtgccattattgtgaattcatttgctattactggaaaagtacttaatataatggattcattaggtatccacgtggatgtcacattttttttatatattctactatagttttacttcaattccactctagaattggttgatggattctctcataactatagttcatttctaaacatctaaaactcctaactaaattttctcatacttaaaattgtttaattatatggcttggaaataggaaattttacttggtccttgtcagaaatattgagtaatggcagttccattagaatggcgttcattgttgataactgggaacaatgtggtgcaaatggtgttaaagagacattggtgaggaggaaaagaaaagaaatgccatttccaggtaagtttttctgcatcttttttggtaaatgccaccataccgagccctcatttgttcttgtcttttcttaatgctttatctgttccttcagtgccgcaatcaggcacaggtggttcccttcaccaagtgaatgaatatttagtgctgtcaggagtgtcccatgaaaaagcccttccagatatctccaaactaggctgatttgtcatttctgaacaggggattcctgtgagtcacttctacacttaagcgaaatctaaccagcagaattacctaacactgcagttcaagcccatatgattagtgatgaatcttcctagggcattttaaacaaaagtggcttcatatccaattgtactggaaagggcagacagtctgcatcaaagctttggattgttgagaaacaatagcatacggttatgattttagcttgtttgtacagctacagtgaactgtttgctcgagatacgatttcgggtaaacaagcccctctagactcacttggaaaagcgaacaagttcattgaaactctttgcctattaggctcaggaagaaaattgaggctgaaatctgccagtatttataatagagtatttgattcagttgttttatcttatagtaaaaccagtgagaagagacaaagaatttgagggaccagaacagacaaaagtacatataaaagtatgtttaataaaggcatagtgtcaaggcatttagacctctctatcctaccttcagcatttcctgttacctttaacaatgtggtgattctccactctaatatcaactgcaatcttctaatttcaggaataaattgcatacaaaagttattttcatattacagggcccggaagacaaaggaatgccaagcctggaccaagatattcagattataatttgttttctttttctaaatcctcactaaccatgaaccatttctcccattcatgaactggtaacaggtgtcatgccaaatgattcttttaaaaataatatctgtttcccacgtttcaggtgtgtgcatatcccaggaaaaataattgtctgatttatatggatcccccaaggtacattaaacttggatattaaaacagtaggtttattctaggtgaggcatggatttagaagtttagtttttgtttcagagtttttgagagtaaatctcttgctttagaattactgatgcagtggaacagacagcgtatcaatggttgattctaaggtaatagaatttaatacagctcactgtatggttcacagccttttcctctaccctcttcttgctacctatgctaatccttcccaaatcctatctcctgtccacacttagatttctaactttattttatatttccacctggataccccacacatagtaaaaaacccactaattttattcttaagagtttcacttattagttataattattaatgcaaccttaaataggccagaaaaatagaactccatcttcttttttattgagacaggatcttgctctgttgcccaggctggagtgcaatggcacaatcatggctcagtgcagccttgacgtggacttcctgggctcaaatgatccttgcacctcagcctcccaagtagctgggactacaggtgcatgccaccacaccctgctaatatatatattataaatatatgcctataattatatatatattatatatatatatatttatatatgcctatgattagggtgactgcaagtggttttggaacataatttattttcagaaatttttatgttgggtgaaataggaagtattggaaatcctatatatatatgtgtgtatatatatatttatatatatatgtgtgtatatatatatttatatatatatgtgtgtatatatatatttatatatatgtgtgtatatatatatttatatatatgtgtgtatatatatatttatatatatatgtgtgtatatatatatttatatatatgtgtagatatatatttatatatatgtgtagatatatatttatatatgtgtatatatatatttatatatgtgtatatatttatatatatgtgtatatatatatttatatatatgtgtatatatatatttttatatatatatataaaaattttttttgagacatagtcttgctctgacgtgcaggctggagtgcagtggcacgatctcagctcactgcaacctccacttcccaggttgaaacaattctcctgcttcagcctcccgagtagctgggactacaggtgtgagccaccacacccggctaatttttgtacttttagtagagatggggtttcaccatgttagccaggctggtcttgaactcctgacctcaggcaatccacccgcctcggcctcccaaagtgctaggattacaggtgtgagccaccacacccggcctattatttttattattatttgtagagatgaggatctcactatgttgcccaaggtggactccaactcctgacctcaagcaatcctcccacctcggcctcccaaagtattgagattagaagcaagagctaccgtgcccggcccccatcttcctttataacataatttgtttcacacaggcacccaagttcaaaaccctaccttcaacagccaatccagtactgcctgacaatttaccaatttatgatgcattcctctttggatattttaaatattttaattgtaacatatatcccacttcaattcttattctgatacttctaccttttcttgtataatgtgtattccttgaatagatcatttattatattcatcatggtatccccactccccaacacagtatcatttacacagtgagtatgtcataaatgtttgtgaatcaagtcaactggaatcaaatggaatccaagtatataattgcacaaagtcaaggtgccacagtcaagacctcatagcagaagcagtacacttcttagtggttaacatgggatgtagtgatcaaagagcaaacagaatcttagccaggagaaagtgtattattttccaaaagggcagtgatcacgttgcagttgactctatactgttaagactgtgccacaggagtttcactgaggactgtgtgccacagttaaaggcaccataaactggaatgagttgagaagaatgtgagcagaggacttagctttttcatgtgaagccaagtcagataacttagggaacaacggagttttcatcatatatctgacagtctgttgaatggaagggaagagtaatatggcttgttctatgtgggtataaggaatgaagtccccatcaactgatgaaaacttcatcaaggccagtattggctgagtggtcaataatgtgtgcctcatcttgagttagaggaagtatgagttttctgtcacagaaagtgtgtaaagagaggctagagaagctcttgagaggggatgattcatagaggagtcaagtataagatgaggatcctcatcaactagaggtctacaattaagagatccttctgactgtgcaatcctggggctctatacattcacagaattaggagatccttctaactatgcaatcctggggctctatacatttgggaggagccctccttatcatctcataaaatatttgtgaacttcagttttagttgtacattttgatcctctgtaaatcaactgcacttcttaaacccttaacttatttattctagcttctgatatcactcccttcacttcagtgcaagaatcatttgtgctctccagtaattaactccaaaatcttgtttctcagagccttgcattaaaattgcattttcagaggtgagtgcttctggtagccattctagctacagttcttcctgggaaactatatggacatgatgtctgccatttcggaacctgtccattcggcaagaaaacaagtcattcacctttgcatatggagcaatagaattgtaggccagaggaactgttgatagcttctgtcaagggttctcccaccattgaatccaccagcatcactattgccaaaaagctatctgccgtggtaaactcagctatttaaaactttgagaaagctcacatgtcatacgacattcatggcacacgcttccactactgtaataccttcactttattggagttgtcccagatacatttaagtacctgtgtgattccttttccagatcaagaatgttcaaattaggatcaagagggtgtgttgatgtgatagcccgcaccagaatataaggatgctctttctttgaggcttggaataaaatgaaagagagatcacttgaaatgcttatggcttcctatgcccttatttcagctttactgaccatttgcaaggatgttccatagttcatgaatgcaactcacatttgagtgtagtggggaaaaatcattggccaatttaaaaagtcattgtctgcaaatgttttgactgagttgtgcctaaacagaagattctctttttaggatagatatcattctttcatcctgtctggtgttagagccaagctgcttctttcagtagtctatcgtttcttttgaggacagagattatgtcttgtctttcactatgtagacatagcttatcagagtctcttgtactcatagtaatggctttggacccatttactagattgaatggtttgaatttgttttggaaagttgtgatctgttctagtttttatttcagttttagtttcataacaatagctctgatttgcaaattggaagaatctagactgttagaagactgtcaaaatagaatgtgaatatacagagacaccatctaattctcatttctagggatagtaacatggtaagttctaatgttgccctaaatacatatttttgaggagttgaaatcgttctgcttgctgtatttgtacagagatatcttttattcagttttatctattcgttgtagagactaaaatctgtgtattgtaggcattaacatattaatctttttaagttctccagaatagaatctttttggcactttcatgtttggaaattataactcgtaattaggcatattatcactttatagaaaaataatatatcactatagaactgaaaataatatatatattttttttcctttttttttgtcatttgggggaaggaaggtggtttacattgagtatctcttatttgccaaaaagtgtgggaagtttttttgtatacatcatttcatttaatttttgtgattctttgaagcaggtgttatcatcatcccaattttattaatgttcaaactgagtctccaagggattaaagtatctggcttgaggtcatagaataaaggatttaaactaaaaatctgtccagtttccaaaccaatgtttctttaaactacaataaatccatgcaattgggcttgttgtctgtggcatcgtgctttgtattagtgttttacttttgatccaatgtcatcattagaattttgcaatgcctctcatttattctaagaatagctcatatttaaagaaatgcagaaagaatggccactcaaattttaatggtggtaatgttagaggacagaactgcaaatgattcatcacaaatataaaataagcacatgaaataaaaagaacaaagcatactgttggaattaccctgcagccccctaaatcttttaaatcctactaacttgcaaccacaattgttggcttattcttgttagtactccagtgtttcaattgttgttttttaatgcttgctcactcattgttgcaaaatgttctggtaattggatctttaaaaaatcttcagaatattatagatgagcttgtttgcaaatgtgcacatattagagtctgaactgtgcactttaaccattctagagatattgaaaacatgctagaaagttatgtcatggaataaaaaggagctaaatcaaagatttaagctgcctcctgtcactccattagagacaactactcacatgtaccattgtggtctaagtgaaaggtaaatcttacaagtaatggctttattctcatattctttgatcagctgaactcagttggagctatataagcaacaaaaaaatccccagcaggttaaatctttgcctttcttctaatctaaatgaaaatattacagtcactagaaatatggtaatatggtgcaaaatggatcacttcaggtcaagatttcatgggtcaacttgtttgtttaaatgtagtcccagatactcgagcgactgaggcaggagaatcacttgaacctgggaggcggaggttgcagtgagccaagatcgcgccaccgcactccagcctgggtgatagagtgagactccgtctcaaaaacaaaacaaaacaaaacaaaattagacaaatgctacattaatgtttgggtggtaagattctattttgaagtctgaagtttgcagatatgcctatagatttttggagtttaccactttcttagtctgtatcactaatgaaatattttaaattactatatattttaccgtttttctgtatttagtaagaaatttgcatttttgatttgatgtaacaaaggttttaatgtaatttatgttagattttgcatttttttcgttaccattgtactttaacctgacggaatgactgatctctttgtattagtattgtgaataatcatgtgaaatgttttgagacagagtattatatttgtgaatataattttatggctttttcacttagtaagaacctttctattattgtggaaaactaagaaaattgctttctgctgtacaatctggcattcattgtagattaaagcttatttttctgtgaataaaacttattcaataaaatactaaaaaaatttttttaggctaatcaaattttggattgactgccttgccaaatgtgccattaattaaatgcctccctgaccacttttaacttgaatgggaaaagataggattagaatgactatttttaaggatgtctcttacacatccttggcacctggaacagtcgttggcacacaataaatgtcaatgtattgaatgtataaattagtgtgtttaatgtgagtgctcaccaagggaaaaacacaatatgttatttgtcacctctgcaaaattataatcgtacctatctcatagagttacagtataaggataaaattatataatcatgttaaatcctttgagtagtgtatgatacattgtaatcactcagtaaatattacggtgtaaagtacatagtagaggatttgctttttacaatgactttgctgtttgaattgtgagatacacacatacacacactcgcaggcaagtgcacacacatagtgtggcacggtagaaagggtagcatactagtggtcaggagaactggattgaatgcttattccaaagtttgcatgttctctgaagtcaggaaggcattattacttatctcgcttcaattgtctgtcctgtaaaatgggaattgtaatacttgaactgctggaaggcagggttttaagataaactctctttagagggcttttcaaaggtacttaatggccctgagtcaatgataaacctagtataaattgagaaagcctaaaataagaataggttcatgacctataaatacttaatctaaaaatcatcacttaatgatgatgatcacagaacctagaatagtcatgggctatttaaactggaaaaatcccttactcaacagattcggaaatggagaccctgttaaataaagtaaattgcccaaagccagacacaatttctaagaggaagattccaattagaaattacgcattcaactagtgatgaaattgatcaggttgttctcattgcataactgacttggattaaaaaatggcacaacagaactgaagacaaataaggctcttaaaatatatgcagtgataaaatggatctctttcaaaatggatgattctctgcacccttcctctctgcctccctacatagcagtttccatccatcacataggcaatatagacttgagagcaatacttataatttttctaggcttctgctccatctttctgcttagacaaatggaaacatttaaattcttatgattttataaataacatagcattacatatttattcttgtggcaaaacatatatgacatcaaatttaccattttaaccatttttagtgtacaattcagtggcattaagtatgtttgcaatattgtgtaactgtcatcattatctatttccaaaattttacttttttgtcacctgaaacaaaaagtctaatataaaacacattgagaaataaaatatatgttgatttttggaaaatttgttagagtagtgcattaacctcatgtagataatttgcacaatgggtttatgtttctttttctgttaaattcagtttaaaccatgatttatttgccctaggtatatgtcatagcccttggaggcaaatttcacatatttttgagcctgtgaaatagtaccagtttcataggttgggccaaggtcagttgactggatgaactgtaagaattatctatcttaaaaataacggctggactgggctcattttaatactcttactgatcaccattttcatatattgtttaattatttagaaacctttttctgtaatgaattatacctgattaaattatttgcattaccatgtgtttaaatgtgccaaccatagtcaaatattatcattaaaatgcttaatttgccaagtatagagtcaagagcaactcagtaaataaaggatgaagaaattttctctatgtagaatagtttttcctttgcttgaatatatcatagttaaaaatttttctaatggagaacaaaggctagaatccaattcagctctggaaaaaaaatcattttgtaaaatggataaactgccatttttcttacccagtgattcatcatgtatttctaaattctgataagaattgttacaagtcttttctctagcattattagaaaatctacattattatgtatgacagaccatgtcaaaataattgtgtgtgggactagtctaggttaaggggaatcgtatttgatgttactaattttcacattatttcacctataaaaattcttctagcagcaaaagttttattgcactgtatttcagagtctctaatttattcatgggataaatgtttcatataatgaattttcaagtaaatgtattctgaaattcatgcataaccatgcctgctctaaaactataaaaatttggttaaaattgaggcatctcctcattccccttggaaagtatattggggaacctggaagattttatgctaatgaaggcaatatggttcagcttttctttttatccaatatatttcttttattgagttcaaaccattgtcctaattaataactttaaatggaagcacttcatcaattgtattgaggcactaatactgcttaaaaggtagtatgtgctaggcccatcctgtgtcattcaacacatgccttgtgatagagaaatatgttctacattttcttctgaatattttgtgtggtttaagagccctctgccatatgatcttgtatctgcctttcttccctcactcactccctgcttcatctcctcctttggatttttgtagtggtggtggtggttgctcatctcgatgctgtgctacagtctgtgggcattggtaaggagcatctctctggtgtgatccacacacaataaacagacatgaatacaagtaatggtttaaagcatgcagtcacatctgcctccatcttcacatggaagggtggtctgaggttattctggcaggattttattctactatttgttcaatttgccaatgtaagagataaacataggatttggaagtatagaatctatgtttatcctcaataccaagaattcttgtgccttgggaatgttgccgtatgccaaacccaaggtattatatttaaagattaagttcctgaaaaaccctcattttcaaagaataacattatattgcatttgtaaagttgtaaagtagaatttcatatataaaaaaatctgtattcactcccctcaagacagcgaagaaggtcacttttcctagggaaaagaacaacacaaattttaaaagatcacacagtgtgtgtttctttgcctagacagcctctttggtttggaatccttccctgaaagatgggcagtgatcagactgggcaacccctccctcaattaaaaataaagaaaaaacagtctattatgtgtagtttttaatgagtataaaactcaatatgcaatgaattcaatatacaatgaaatgtcagaaatacaatatataatgaaatgtttcatttgaagagagaggctgttgtgcatttatactcattcattcattcacgcattcagcgacatttattgtgtacctactatggactggtcacttttctaggttctagggacataataatgaataaaacaagtcaggactctgccgtcttcaaacttgcatccttggagcggtggcagatggatatcagagaataatgaaaataagtgtgtaaaatataaaatatgtaggatgatgacaagtgctattaaaaacatgaaatcagggagggtgttagagaatggctcaggggctcaatttctaagagtggttaggagaggcctaacggatgtgacatttgaacaaagacttgaaggaggtgaggaagcaagccatggactatgtgtgggaagagccttccaaacaaggggaacagcaagtgcaaaggatgtctgaaaaatataaagaggccatagaggctggagcagagtactcaaaggggagaatggcagcagatgagacagggaggggaaggttgtttccattttgggtaggtagagaacaggtcttggagcagcatcttgcagaccatttataagggccatggattttactctaagtgagatgagagccgttgaagggttttgagcagcacgagtgaggcacctttgcatggcactttggtggttatagaaatgcatcaaattttgtcatttctcttgatgtgatatagtaaacttcgataatgggattttataaaactcatgtctcttagggctagcaccttcagtgttgggggaggttggtcttgcagtgaagaatgcacaatgtgccctgattaaataattagcaataaattttacagaaaataccttcagcataggatttccagtacttcctatttcacccaacatacaaaatttctgaaaaataaattatgttccaaaaccacttgcagtcagcctaattataggcatctctatctcttctatccattggcaggaataaacttgaaaaggctgcccacttattgagtcttgagtccaaaaatcaatgtgaggtagtcagttctcaaataaaagagattgggaagaaagcaggaagaggattgaaaaattggcctcctcagaaatgcacgaaggggacatttgcagtcttaaggggcatatttcctagtagcatgtcttgtaggggccctactgaggtaaatgagttaatcttagtctgtttaagaagttccattataatggttctttcagggtatgaaaatgcaaagaagtgaatctttcaatgaccagatgcatagaagcatgttttaaatgactgcaatgtaattgatatatgctgccatcagttgtgacccaggtaatagtgcagctaaaataatttcaagtgggtcaagatatccctggagtacttcctgcagtgttataaaaaatctcccagcaatgtatcttaagttctgtaaatcatgttaaacttaatgaaaccttctgcaagagcattccatttctatgatgcatttaactgcagttgttgacatgttgtatcttaattgaagaaatatgtaaacttttgattaattgcttgtggtaccaggaatataaaatatactgaccacttttttaaagtaagatttagggtatgtgtctttatgtataattgattactccctaattaattaaaatatgctcctttagactttgttttccatctcagactaatatttgcattcctatgttgtggatttagtttatgatgcttatttttttaagatagaaaactctgaaactcaaggctgacctgcagtatgttcatcatgtttattcttactgctttggcacagttgagtttgataataataatgctagcttagttcagtcagattcagtgcccttggagtacctactctgtgcagtactgtgttttgtggaagtcgtgcagtgtcttcaattgaacaagtatataccatggctacaacacaaaaaatttactgagaaccaaaattttatgccaatggcctgtcgatagtctccttcctcctaagatgtcgcctccagaatgtcaggagcttcctctgtctcattcacttctgtatccctagccagattgacacatcaaattaaccatcatagtgctggacacagagtaaatgcttactgcatatttgttgaaagagtgaataaatgtgagaacaaacatttgctatatacctactgtgtgcaggggtctaggccaagtaggtcacagtccctcctattgagtagtttagtcttgatgatgtgggaaatgaggctgaagacagaaatcagagaaacaaaaataaaataaagggaagaggagagtgaaagttcaaaaatgagttgatggtgtctgccaggaaaaaccaggaatgccgtcactgcagaggtggggttcaaggaagcatcccaggaccttgaacagcagaccttgaacaccaggatgaagcgtagtctggctgggagaatgacgttgatagaagcgctaacaagggaaaggacacattatgtttgcagagcagcaagtgatctgagtttcttatcaagcaatttataaaaatgtaggcatgttccttatcaagcaattagtaagcatgttcttctagcacctttaatgtcactagatttagtttctggttaggtgtacaagcaaaggggaagaagttcagcaagtaatacatcaagaaagccccagatcagcacatatatgtacaccattccactcccactagtgtgtgctcgctggcacacacagacatacacacacacatgcgtgcatgctccggatgattccaagcatagctctctcctgttgctgccagacttgacctcttctaatgatggggagcagaccacagagaagtctcttgcacatatcccaatatgaggatgataggggccatttgaacacatatgtccaaagagaaaccatgaggttttaattgtggtcaaaagcattctacttatagacttgaatccagatggatgaattcactgctcaacagcataggtatgaatttgtttaatcaacttcgtaagaaccaagtcaagttcagatacacttactttgcagtctaattttctaggggtcccaaagttttaatacaatcatcttctctgatttcccacaggaaatgatgatcccatacatttaaaatgttttaattactcaaggaatacaggaatacatgattaaacacaaacactacagataagcctcaagtgcccttttgcttctgtctgaaattcttgtcccttctcctgcttttgtaggtaaaaactgctatgaatttgatgccttcaaagcatcatttctctctctctctctgtgtgtgtgtgtattcacaaccacattatatatattattttgcataggtgcattttacataaatggttatatatacatatatatgtgtatgtgtctgtgtgtacatatatagtaagtgttgctgttttcagctaactatatgtcatagtaatctactggctttaactcaatcctttgaccagctgtcccaaattctaggctattaaatatgataatgcactgtttattgtgccatccccttgttggaggacactggagttgtttccagttttttggctgttggaaacagtgctacacttaacacatttctatactatactcctagtgcccccagggaagaatcaaaagagagaacgttggaccctacaacttaattttaaacaaatgtcttctgatagaagaatctatgccagtgtaagatgagcttccttatttccttaacttcttatttcaggtgatatgaatgaccttggttgggggagtgtttctagattagtcattattggtcctacatatattttcccatgacatacagggtggcaggccattttctctctgagtttactatggatggctctgctacagtgtcttgttttaattactcaaggaattacaactcaaggtgttgaaactgcatatcagaggggatttctaaatgcagggagcccctctctcagttgccttatctatatatactcttacataggaatagtgacttactacttgctctccccactcaccacagatgccttttgtggcctctgtcttccttctttttctcacaaatagttcttggacacctttatgtgccacacactattgtagacactggggatccatcaaggaatacagcaaactaaattcttgcccatgtggaggttatattttagagggaggagacagataataaatgataagcacaataaggaaagtatagtatgttcaagcatgctaagtgctagaggaaaaaaaggaaaacagtctggcaattctgcaaaaagttaaagataaagatatcatataactcaacagttgcacttctaggtatacatttaagagaactgaaaccatacgtccacacagaaaaatggcacgcagatgttcataatagcattattcataatagccccaaagtggaaacatctcaaatctccatcaatggacaaacgaatacacaaaatatggtctatccatacagtggaatattattcagccatgtaaatgaatgaagtacgaatacataccacaacatagatgaaccataacaacattaggctaactgaaagaggtttgaaacaaaacgtcacatatattatttcattaatatgaaacattcagaaataggcaagtccctagagacagaaagcagcttatcagttaccagaggatggggaacacagagtaactgcttaatatgtagagtctctccttttcgggtgatgaaaatgtttaagaatcagacagtggtgatgttcacttaacattgtgagtgtacttaatgccactgaattacacacttaaaaatggttggtgtttaattttatgtcttgtagttttacctacatttaaaaaaatggagcaggtcaaggaggacctggattgcagaattggagtgcaattttgaagggtatcactgaacaggtgccatctgagctgcaaacataccaggtagcgggggcagccattcaaagggtcataagaaggggcattgcctggtgtgttcagagaacaggaaggaggcaatgtgcctggatgtgagtaaaggaagggcaataggaacagaggcagccttggtcttcctcattcacctgctgttttagacaccactggctgcaattgcccacagttagttacctgcccaaagttgcagtgatgatggtactggcagtggtgaggaaaagaagggaaaaggcagaaaaatcactccagatacttcccaaggcccagaatttgatcatacattatttcttttgactatgagtttcctttacatgatatttccccttagttttttttttttttaacatagaatgcatctttcagtaacactttatctcatataaaggagtgtggacttaccttttgtaacatcagtgaagaaaggttaaggttcccaacaatttaaagggatattatttcagtgaatctctatgtgagaataaattaaataaaacagacatgcaaaagaaaaagtgaattcatttagagagagatcatgtccctctgttctcagatgcttttgaagaaaacataatcatggataatcatccactgttgcattctcaggtctcctctgaccccacaaaatgagcatagggtcatcatttccttttcagaaacacttataaataattgagcgaggcaatgatgtgaactgggaagggcaatggacctaggactagaagcgtggatttggggcccaacacttgtatttataatttgtacaaccttgggcaagacacctaacctcagagctgcaggttctttatcttcaagttcgaaatgatatcatccctacctatctaactgggtcgccgtgaagttcatatgaatcaaaggtatataactgctttgaaaagtacaatttcataaatagaaagtactactattagtcttcaaacataaaagcggttatcaagaaaacctaaaacctctctccttctatgtgtgtttgcatatttataatttttttttattttatgatagtacacatgtggagtctctgagccccttgagaaaagggaaacctgttttattcatctctgtatccctggcactgagcagtgttctatacacacagtaggagcatagttagttaggctaggttgagtgaatggataaataaaccaactgtattttgaattattctcatgaggtaatggtttacagtgtcccacgatttaccatgcacactgtttgatagtttgagtattcaggtgtctaagaatggatggaggaagctaacaaaacagagtttaaattgagatgatgtcataattagcttatttattgtgacctagaataaagaacatggtgattccacaacagttttggggcagtctgggatattaaggtgagttttggttgtggcaacccagaggaaggttgcagtggcccatctatctatcccagatgtaagatatgcttcacccctctttcttgatccatgaagttcaaaaggaggcaccaagcatttccgtccttcttcaagatgaaggtaggcaatatgagttggctgtagaaggtctacaatcagccaaaggcttaacaagtagcttttctctctctttacaaatgagtcctgatcacagtgaggtatttcctttggcttaaagctatccaaagcactgatttaaatacagttccttagaggtaaaattgtatggatttccttctcactaagtaaggaaactgagacaaacaccagttaaaggcctcagggtagtcagaatgcttcactgactgtcccttttggaactaaggacaaccagagcataatggattggatctgagattctcacatcagaaagtgaacagaagaaaactgaatgtcattctgagacttcagtaaaggataatgtccattttctcatccaccaaatagggataattatctctaacttactaagtggtcgtggggatcaaaacaaacaacgataacaaaacagcctatttgtctgctatttaagtgctcacatgttccagaatggatggtgcaggccaacaacatggggctgagtttgaagtcagaattagcttctttattatcagctagatttgttgctttctaaccagcaacaatgacaacaaaacttagcatatggaggggcccagcagagctcctggcatgtagtaggtgctcactgaatgttaagaaatacagacctataatgagggatgcttggcaatgggtatgtagaatgctaaagataaccactcactttgcccatttacatcagttagaccattgccaccatttgcactcccagcctcttccattcccccaactctactctatttccctctgtgttctcttgtgtctttctctaatttttttcaactctcactttttttcctcccctactttttgcttggttcctcagtgagatctatgagcataatatactccaactacagtaattcaccttgctgaagtggctgctgagttctgctttgaaggaaatttacttatttaattttggtggggggaagttgtggctggaccacttatagaaatgtaggtctagttttctgggaatgtttaaagaaaccatgcgcaaatgtacattgtcttcctccctctctccttccttcccttcctttcttcctttcttctttcctcattcccatcctccccctttcttccttccttccttcaatcaatcatatatccatattcatatatagatatatatatttaatcttttacctataactcttgtcaattctatcttcatttttcccctttgggcttatgagtatttatagttggtgctccataaatgtttattatgagtaacaatgataatagtgatagaaagagcaacacatgtgctattcctcagtgctttttatctcatgtacaaaattaaacactaatgttgccatcagttactcccaaaaagatggtggaagcatatttgttagtaatattttgataataactatataaacagatatttgtcatgctattctgactcctacatcttcattcacagaagaacattttatttacattgtcaagtaagagggtggcaatttaagtgacacttgcaatttatcacttgctttgctttccaaggcaagtcctaggagttgcatttttgaaatgggtctagaatcattcttttctaagtgttttcaaatatactcagaaggataaaacagatctctatatccatatctcatatttctatggagggttcatagagatatttgtcctccatagagatatgagatatagatattacctgaacttgcaccctggaatattttccttgtctcaggtagtttagttgattgaaagcctccagggtttataacatgtctgtctaactgcctcttgacattataggcttaaagtctatgtgtaaagaatccacttggtggagggcaactttcttttgggtgtgtattttacaatcaaagtgagatattccaaaatgcaaaggaaaatatatgcacagaaagaaacatgacactgaacaaaattggacaggcctgacaaaaaataggtgtggataaatgaaaacttgaacctggcagtgaagagcacatgatttggagtgggccaacactggctctaccatttatttgctttggaacactggggaaagtccttctctggtcctcagtttcctcacatgtgaaatggggataataatcgtctctacctcatagtgtcattgtgagtcacaaatgaaacaaatgcattgaaaatcattgtgcggataacatgaaataatatttatctagtgcttagcagatagaacattggataaataggggcagttatcactattatcctatcagacaggttgtctgtgtcagcccttcgttaggatggcatcatctgcctaggaccaacagtggagggcagtgtagaggcatgattttatttgactatttcaattagtaagtgtatcaggttgctagtgctgctgtaacattgtactacaaaccaggtggcttaaataacaaacatttattgtctcatagttctggagactagaagactgcggtgatggcagggccatggtccatttgaagcccctaggggaagatacttccttacattttccagattttggtagccccgggcgttgccgtagcacttcagtgtctgtcaccattgtcacatgatattcttctctgcatgggtgtgtgtcgatgcccaaatttccctcttctcataaggacatcagtcatattggatttagagtgcaccctactctagtaactgttcatcttaacctcacaaattaatctgcagtggccctgttcaaaaataaggtcatatacacaggtaccagaggttaggatttcaacacatcttttgagggtgggaacgcagttcaactcataacagcaagtgtctgttaaggtcttatagtatactaggtgctgatcttgatatggaaggactggtcagaagggcagaggaaagagggctttaaatgagggaaattgtgtgagttctggttcaggaacaacaacaacaacaacaaaaacccacaagattttgttcagcaagtaacactgtgttgtcagagtatggatttcccagtgagcatggtgggtagagttgctgagaagacaggctaagtgacacgtatccacgccttctgatatttggggttgcactggctctttttttgtcttattccccctcttaaagaatggcccttccctccactcaggctcgcaagaactcgaccagcgagaccttgtaatttcctacctcttctcatcttcatgtgagatgtcctctttcatcaatcactgtaggctgtcaagctggcctgtgcctgcatcattactgcttggaacatggcaatgacttctttctaacttgtttttctgtttccagtcccttctccctagttcgtcctccatactattgcatatctgaacatgtcaacactctgctaaaaactccatcaatgattgtccaacactaacatgatgaaattcaaactccttagtttagcataaatgcctaatatgcctactccctcaattcttagccatcctgcagtgccattacaatgaactaccactgtagcatctcaactgccccaatgtgtgtcatgcctcactacctttgtataccccagtcctctgggcaatgttctcttcctttctctccctttaccatcttgctagctctttctcaagtcttcaccactcaagtattaccttctccaggaagccctccttgatctagtgtctagtctgagataggttctcatttttctcatgcttcatgagtatagggctgtggtcagtcctctaccttgtcatatagcacagtgtaccacagtccctaattaccgtggttttccactccaccacacaatgagaagtgtggcttgcaaaggcctatggctcatgtctctctgtagcccccatgctgagtgctgggcctagcccagggcagaaggccaatttaaatgttcatgggctggacagtagaaaggtagcaggctagccaacctcatggcctgggagttacctctgagatgattgattccctaacgtcctctggcaaaaatgtagatcaaaatatctcttctaccacatacaaacactttgataagggagaaatttaatgcaactgagagatacggagacaaactttctaattatacagctcacgggcctggcatttggcagggatcatgtgaagcattcacttttctccattttaagtcaccatttcccaaagttgaattattgagagcacattaggcagaagatgaggagtgagaataaaaaaaaaaataacttcagtagacaatcaccttgtaaacatcttgagatgaggctggctattaaacaggaacgttcggtaccaactgaagctcaggtgagtttagccaagcaaatcaatgcaagttaatcttccagtgtcagctggctgagttttggactagtgatgaatgccttgactggaaagatgaaatgctggaatgccagccagtgttctgacagctacagatggtgccaattactgccagtggagcctgtcctgctgtgagcccaagatgtctgatttgtggccacaggaaaatgaaaaagaggccttccagctgggcctgtcacctgtccttctgtcctttattgttctgtaaccaaaattgtattcaggtttgaaaacctttttttttctttttttcttttttctttttttttttttttggtgatgatggtgggggcattggacatggggcggaaacaggaacaatgttactcatgttaatcatacagccatgctcattgccaagcgtatgcctgaggaggtgaagcaagtcactaccaaggttggccacttcttcccatcccgttcctagcaaacaaaagactgtcaattaacctgaaacatggagaaaagcaaatgaaaatagccccaaggctcatgatggccatgggattttgtacacataagcatgatctattgtatcttttgaggaggatgtttctgctaggaagattgctgtgcctctctcctatggcagacctcagaactgggttctccttgtgtttaggccatggtaacaaatgaactcaggtacatgtttggagtctaacacccaatggccctctactgtgctcatcctttgagagagtaggctgcactcaaactttagaggtatccaacaatgataccttggcataaattgcataaattgcatcctcattataagagtaacaatataaaaaataataaaatcaacaacaatatctgcagtcacattcatttattgagaacttatgatgaataaaatattagaccaggtcttttacctactttgcccttaatcattttaacaaaattgcctgagagatattactatcccattttacaaatgaaggcactgagtaacagagaggttgaatggcttgcccaaggccacagaattactgagtaatgccacctagatttgaacacaattctccaaatcttacaagggagtacaaccaagaagtgaaaagaatactattactttcatgtcatatagttagagtaaggtgttcaatttatgttgcaatgagcataaaggagctaacgctaagcgctttagtagtagtggaatagcaatagggaggacagaagcaacagcggagttagtaattaatacatcatttagacttttactattattactgttagccaagttttgcttccagtaggtcaccactgaatattatggttctggtcctagataatggatagataatactaggcacacgggtagttttttttgtgaagcaggcaagcatatagggtcagctggtacccagtttgagtcaagaagagacatcagcctagtctagttgtcaagccatagggtggcatttgactcttacagcacacctaaagaaagccactctagccatatccatcaataattccatcagtccttggagaacccttcggaggcagtgtgaggaatggaaaagtcagtcccaaaagccctacccccacagggaccctgtgagcagtgtcactcctgcatggcctaatcttctgctccacatcaactgaactctcttaacctggatgttgtcctgcatccagtgtgatttcctgggaggtggagtgggttctgggatcctcttaccaggatttggtctggaagatcaggtactctaataaaagaccatttcctcctttaataaaacatggagcacaaacaggctccagtgccctctgagaaaatcccaagacaacacagtttcttaaaaggcacttcctccaactttgtgggcaagcagagattagagtttgggtcctaagaaaacttagcttactaagatatggctggtgcctctagaacacttttacttctctgacataatgtccgtctttgataaactttcagtgcatttctcccttttcctgttctcttactcaacacaaatcgtcattgactgcacttcgacatttctttctgtctttgtcgagacatctgtgatctctaattgattttttctccaaaagacaattgattataaaaacttaagtgactcaaaattattttacttgtaatactttaaattattatggatagtatatcttggccactttagtttgcagtcctggcttttcaagatggccaagagtttcttgaagaactagcaacaaatcagaatgattttttagttttaaaagaactttatatttttaaaaaatagagtgttgaagggctataggccagttttcctcagtaatttccatgtggcgattgtttaggggttttccaagaccacccagtattcattgacttgctagaaggacttgtggaacttaacatgcagtcaaactcaagactgagagacacaacaagaataaatattacagcaagatcaataaaggaaaagacacatcaagaagagtcttgaggaatccatgtgcaggcttcctatgctctatccctgccatgaggggccgcacagcaagctctcaccatagcaacaaaaatgcagccacatacgtgcaatatttctttccaggaaaatccatttgagacttagcgtccaaggtttttactggggtctggtcacacaggcccactctgcctagcaactaccaaaatttcagattcccagagggaaaaccaatttagggccccaggtgggcaaaacagtcttgtcacggaggggaaatttcttatcggtatagggaactgtttaccagtcaagtgcccagacttcagccgaagaccaaccttataaaaaagcctttctaaggagagcagtctcaggcctgccactttaaactctgttctgcacataccatccttttgtcccttggccaaggtatctttatagcaaaatcactatcagtatgaccccatttggcagggtgagactaacctgcagtattgatctcagtcgtgtcttttaggggtcatggatttagccagttaaaacaaatcccaccaatcacaaaggtctgtgttaaaaagccaggtggcttccttcttaagtttttgtatgaaccattttgatctggcctggggtattgatttaggtgtagcacagctctggcagtgtgttggcagttgacccaaaaaccttgcaagcctgaagtggtatccagatagccagggcacacacaagaaacacaatcccccagggcacacatggtccccatgcagacacacaacttaacaattgttagggcatcctgggcagtacagattaacagagcccccagtgtggcctcccacccaaaaaagatgtggcaggcatcctttttcttgtgctttctgaaaggcggaagcaatgctttatagtcagatttaaatgtttatttatttatttcaaattaataatgacctataatcattggctttatttaagcataataaaatggaaatctgctttttttgttttagaattatctgactggaataacctaactgctaaaagcttctaaattaagatggacaaattttttttttcattttattaaatatgtcctataggaattgagctattttgctctcaacttcaaacacaaatatttatcaaattttaagattcatttaacaatcgaattataccagcagacaaatagccttataaaatgaccctcagcatctgggaagcatgtcacagttgtgcatgttgtatttccaccatatcactttgcagaattgatagtttctgctccaaatgactatgaatgctaaattgcactctcttaaatgggaaattggcttatacattagaacttttggaaataaagataaatggagagagtgaaaaggaggtcaatgatgatacagtgctttacactttgcaaaacactgtctcatagattctcacaattgtcctctgaggttggcattctcattgccactttaaaagtgaaaaaaaaaatgagtttggaacacgttgaaaatcactctaaataaacgagtagcaatgtatagaattaaagatagatattctgactcccaactctaccttttgagctactattaataccacaaggctagctagcttttaagccttcagcctctcatcttgcttcagcatggaaattgtacagcactagagtaagcctagctgacaatttgctagtgttctttatagccttatagtgtctcaaggctgatgtttctgttgcagatgttcctcacttctttgattcaagatcaagagagttccgataaaaagatactgtattttgtatgttttctgtaattgatggtgttgatgtctttggtgttaatacatgagtgcttttgaagagccattagaacagggaaaaagttgcaagacacaaatctcaacttaacactattccgagacactaactagttaatcaattgactgtacataactagctgagcttgggcgtggcatgcaattctcactccaaaaagagctgctgccacagcgtcatcgggtttactgtccattttcctttgttgtaggctgtttcacagcaaatctttagccttagccttccctgggactggcttcttgttaaagaaatctctgctgtctactgaactcattttcatttcctgccagcaagaagagaggggataaaactggtgcaatccataggccataggccccaagtggacagttttctgtagagctgaagcagacgatgggtgggtttatgtaacattaaacccaggtgggtacttacccactttgccttggtgcaacatgttttggacttggcacaaattagtgtgtttgtctttcattctacttggctactagccagcaaggatactctattttcattttgaaatttcacctggcagatccttaaaagtcaccagaggacttttcctgagtaataaaaagcaacttttattgaaaactaattattttttccgatgaatatgccagctgtttaaaaatgctgcagtcatgttaaagcacattttaatagtgtacttgcaaatgcagatccaggcgtgaaatgctttttgacagtaacttgtaagcaccttattccaatatacctctatgcctagttacatgcaggtctggaaatctgataaatgccaaaaaatatccactaggtgagtaaatcagttatttgaaaatgggcacatattataaagttcactatataactaacaggttccccctgcttaggaatgaagactgacagaagaaatgcataccattattcatcgagcaattttaagcttttagaagggagtaggattgaattacttgggaaggttgcggttattctgggtatacttgggtttgtgtgtcactctgcatctttgcctgtgtctacacacgtagttgtgtattccctgtgttctgggctccacactaaccactgagatatgtatgaaacactaaaatgaattaaacattgtctttgcctgccaggaatttacagcttcatggggtgaatcagaagagagacaagaacagaaatgtaaacaagacagaattatgcacgtgtgaaatagaggcttaagggatatcttggacttacacaaagcctggtgtacattctgacttaagggaccaaagaagagcgtgataatagaggtcccatttgagctaggtcttcaaggatgaaaatggcaatgattagtggaatgtagagaaaggacatttttcattcattgaaggaataataacaaagacaccaaagaataaaggggcatggtcgggaagggagaagagcaaaggagatgaggctggatggagcagatgacagaaagtctcaatgtgacactacagacgttattttcttttctgtttagatttgtgagagggagaatggatttgctctctgttgagtctaggcctgtgaaaagggaactggcatacccaggctttcattctggtggtgagtagaaaatgaattggagagacagggaatagacaagactagagacagggaaacagaccagttaggagctataacaatagttcagggaagggacgacaagggtttgaaaggggcattaaaacaattatccagtgaatttaatcaatgcagagagtgatctcgctaattcggggagttgggaaggaggcactttactctcaattgcttgttttttattggcttgacttggccagataattgtctcaactttccactttgctatgcctatgtcaccgccactgtatagtttggacaaattgcttagtatctctaggtttcattttcaccagctgtaaaatagtgatgataattcttgctaccaatggtaattacctcataggaatgttctacgcatttgtgtgagtggtagcatatctgtggcatgcaataatcattaataagatttctaatacttctactaatgtgcttgaagatcttctgaaaagtcaacacacccaaatactaaaacacttgaagtgataaaagggtgactccatttgattaagcaataatccctgatggcctctctttaatttgcaaatcctctctgatttaattcaaaaattttattttataacataaatgtaatatccaaagttgtcttaagaacctttctaggatttttgcagcagattggaggctgctttccaccagctccaaagccgttccaaacaccaaagatttcctagatgatgagtttgcctgtctgtctgcaggtaacagttgaagtccagaggtgttttagagtttagcagtgtcctttattgatgacctaaggacccagtgacagaaataagttttgttatttttctaaatcatgatgaaaactttaagaaaaaaaatgcctttgttgactgacctcagattattgtagagtgttaagaaaattaggggaagatttagatgacatttcctttcaggaagtcagcctactcctcccccaacatctactccacaaaacaaaactgcacattcatgagatgcacatgcattgacatgatccgaactatgtttttcagaacatctgggcttggttggccagtattagccatacttacaaaacaaaacacccaaagccaatgttgcatgtcagttctactactaacaagcaaacaagtgaaaccattcctggggcttaaaactagttcaccaggaaattcaggcaagtgagaattgagctccccattgccagtgcagctttctgatggtggtgtggtctcaggaagccaagctgtggaagacagaagctccatttcagctattaacagcctagatgttgaagcatgttattccaggatgaggtgtttggcagccaggaagattgtgtacataaatctgggcaagactttaaaggcctctgtctcagatcagctctttctgacaagtcatttcagtgagaccatttcaaggtatggcatccagttccttgagtgacctaaatctccccgatgctgctctacccccaaaaagatcccaaagaattcatttctatctatgcctagccaagtgtcttagaccaatttatagagacgagttctgctgcacgtgtccacacctcagagtttagcagtagcaagccaggctgtatgtatcttttcccagctggtcttggcaaagcaccagtcccaaaggacctaaactgaagtggcaacgtttgatttatctaaatgagttgctttcataggaatgggaagattttctctgtgagtgtgtggggctggccctcacttgatatctgactacaggttcactttttatactccatccccaagcatctgggaaattgcattttccttcaaagtgcaacccctaccttttctcagaaataacagaagaaaggaagcatttcggacaaagcacttactttagaacaaggtagaaaactctaaaattttagaaggaagagtttaaaaaccactggatacagagtcaaaaggctcattgttcaagagaaaattctgccattttaagcacagcaaaagaaactaccctcagagtgaacaggcaacctacaacatgggagaaaattttcgccacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacatatgtttactgcggcattattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaaccatcattctcagtaaactatcgcaagaacaaaaaaaccaaacaccgcatattctcactcataggtgggaattgaacaatgagatcacatggtcacaggaaggggaatatcacactctggggactgtggtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaaaaaagaaagaaatacaagcagatgaaaaaaaaaaaaaactactgtgattttggggtaagtcacttcagtattctgatcttgtttagcttcttatgtatagaatgggagtacctagtacctgcttcaccagcctctcagcattgcttagagggccagaggaggtgatccatgcactcattctttgaaaaatataaaggattgcttatttggaagtttctttttgggatgtggtatgctttatgagcaaaaggcccataattgtccagattaactacctgtcactagaggcagaaataattcaataactcagcagccaactctcttattcaaacaacactgaatgacatgtttgtggcttccttttccttgtatataaatagcaccagcttcaaaatgatttgatctttggtcaagaggttattactgactctgatttagagatacaattaacttcccatcaataactgtgttcaacctaaaataattataataataaatattattttattggcaagatttttgtctggaggtagggttcactgttttacccttgtaagtgagctgctgagaatgaagtaataaaaattagttattttgactactcatgcaacattgtctgcctgcttggcgttatgtgttaagaacatttaattaaggatgggtgaaattgtcattcatttatttattaaaatatttgtgacacaacacccacatctccagtactgtcatcttaggtactaagtactgtaggatttttctgccctcacacattgtatccctttaaatctagtatacttttccttcttttgtgcattcattcattcattcatcctttcattcattcatctccttaataaatattggaatgaaccctttttctgtctgagaaactgtgttagtgctctggaagttggaactccgtaggcttgcctatgataagacacctgacacaaaggagacaataaagtaatttttatgaaaaataaaaaattgaaatattactgatgagcaaaaatacatattttatccaagcaaaagccatactttctgaaactccacgatttgtgtttttgtgcttgtacgttttactttttttcctttacagtgctgccactgagttaacatatcaatagatgcacaacccaccagtggatataattaatgcttggaaattgtggctttcagaaagtcccaccaagcacaggaaaatgtcttaatttgacagtgggcctgaccaaatgctagtttgtttggaaagacaaaactagccagttatgcagtgtatggtctataatctgacagaaggagaccaaaacctacctagctatttccatccagtggccttggttccaacaatagtgccatttacagcaagactattaaatatccttgcatggcatcaccttatataaacatagtggtgagggaccagaagcctggggacagaacatgtgctgcagccctcttgtccacccagtggggaccttccaggccacattagactcacacagggagggtgatgaagtgcttgctctgcactttatttgcctctagttgttgtctatggattcctttcctgtaataggcacttgtttggctactgtacttgagctattgtatgatttcagctcaggagtttggatgcagtagccggcgaggactatgaacatagtagtgagagaccagccattaaaaatggaagaggaaaggaatagttaataggcatatattatgtgcttggcactctgttaggcctttatgcacattatctcatgtgtacctcccaacaatactatgaacaatactatgaagctagtattgtatccctactgtgttgcagagagaacagccactttctcaaagccacacagtaaagcatggagccaggataccatcccaagtattccaccatatgctttattcaattcgccacactgactactacattatcttcctttgttgaatcaggaaatgacgtatatgatatctactgaagatgggtcattctcttgtttgtcttaggctaaccagtgtcacaattttgaaaatgttaactaaaaacattttaggaatcttaaaaagtctatctcaatatttatgaataagagtcccccttcctcaccacttccaccaaataacagaggcagtgaaacccaatgtctactaaatggttctttataaacatgttttttcataaattttgtgcatttgtattttttgtgtaccttcaactggtttgagtatgtacggagacacaggtgtgagaactggaagaacactgaaagatcatctagcatgtctgacagatgcagaaatttagatccagagaaggagactgttattctctccaaaaatcacccagcaagcaagtgaaaacactagaacttcaccttgaagaaaatgtcattgtgtgcctatagctataaattaggtcgcccagacttattaggcatcgattcatataagaatagacccttagttttgcagaggtttgacagatatgcacaagtggcttgcttgggaattacatgtatctcaggctttaaagcaagagatggcatgttatctttgatgctggaaagaccaaagacccaggaaaataatttttcatccaagaatgtgcaaacaaatagtttctcagattctctgatgcacagttctctttgagagtctgtgtatatttatgcacatatccacctttagttattctttctttcaatcctatgtttagcttttaggaatttaaacaatgtgcaatttttgttttgttttgttttgcatttcattaaggcacatgaagactatgttggaacacttgggctaaaatgtggttctaccatatagtttatcaattttaaacaggtaaaatattggtacatatgagaatattaaaatttgtttttctagtacctccatcttttttcctgcttatgtaaacaaatgaatgcaattcattgagatttctttatagtaaaagtaagtgaattgtacaaataagtttctgtttcttttgagtacctaaatatttattttattttatttttctttaagttattggggtacaggtggtatttggttgcatgtgtaagttttttagaggtgatttgtgagattttggtgcacccattacccgagcagcatacactgcaccctatttgtagtcttttatccctcacccctctcccactcttccccgcaagtccccaaagtccattgtatcattcttatgcctttgtgtcctcatagtttagctcccacatatcagtgaggacatacaatttttgtttttccattcctgagttacttcacttagaataatagtctccagtctcatccagatcagtgcaaatactgttaattcattcctttttatggctgcatagtattcaattgtatatctataccacagtttctttatctactcattgattgatgggcatttgggtttgttccatgattttgcaattgtaaattgtgctgctattaacatgcatgtgtgagtatctttttcctataatgatctgttttcctctggttagatacccagtagtgggattgctggatcaaatggtagttctacttttagttctttaaggaatctccacactgttttccatagtggctgtactagtttatattcccaccagcagtgtagaagtgttccctggtcaccgcatccatgccaacatctactgttttttgattttttgatcatggccattcttgcaggagtgaggtggtatcacattgtgcttttgatttgcatttccctgatcactagtgatgttgagcatttttttcatatgtttgttggtcatttgtatatcttcttttgagaattgtctattcatgtccttagcccattttttgatgggattttttttttcttaatgatttgtttgagttcgttgtagattctggatattagtcctttgttagatgtatacattgtgaagattttctcccactctgtgggttgtctgtttactctgctgactgttccttttgccatgcaaaagctctctagtttaattaggtcccagctatttatctttgtttttattgcatttgctttgggttcttggtcattaaatctttgcctaagctaatgtctagaagggtttttccaatgttatcttctagaatttttatagtttcaggtcttagatttaagttcttaatccatcttgtgttgatttttgtataacgtgacagatgaggctccagtttcattatcctacatatggctagctaattatcccagcaccatttgttgaaaagggtgtcttttccccactttgtgattttgtttgctctgtagaagatcagttgggtgtaagtatttgggttaatttctaggttctctattttattccattggtctctgtgcctatttttatagcagtaccacactgttttggtgactatggccttataatatagcttgaaatcaggtagtgtgatgcctccagatttgttctttttgcttagtcttgcgttggctgtgcaggctcctttttggttccatatgaattttagaattgtttttttctaattctgtgaagcatgatggtggtattttaatggagattgtgttgaatttgtagattgctttcggcagtatgctcatttttataatattgattctacccatccataagcatggaatgtgttttcatttgtttgtgtcatctatgatttctttcaacagtgttttgtagttttccttgtagatgtttttttctcctttgttaggtatattcctaagtattttattttatttttgcagctattgtaaaaggggttgagttcttgatttgattctttgcttggtcgctgtggtgtatagcagagctactgatttgtgtacattaatcttgtatctggaaactttgttgaattcttttatcagttcaaggagctttctggaggagtccttagggttttcaaagtaaatgatcatatcatcagcaaacagttgacagtttgactttccctttaccgatttggatgcactctatttctttctcttgtctgattactctggctagggcttccagtactatgttgaagaggagtggtgagagtgggcatccttgtcttgttccagttctcagagtgaatgctttcaacttttccccattcagtattatgttggctgtgggtttgtcatagatggcttttattacattaaggtatgttccttgtataccaattttgctgagagttttaatcataaagcgatgttgggttttgctgaatgctttttctgcatctattgagatgatcatgtgatttttgtttttaattctgtttatgtggtttgtcacattagtcgatttgcatatgttaaaccatccctgcatctgtggtgtgaaacccactagatcatggtggattatctttttaatatgttgtcggattcggttagctagtgttttgttaaggattttagcatctatattcatcaaggatatcggtctgtagttttctttttggttatgtcctttcctggttttagtattagggtgctgctggcttcatagaatgaattagggagggttctttctttctctatcttgtggaatagtgtcaaaatgattggtaccaattcttctttaaatgtctggtagaattctgctgtgaatccgtctggtcctggactttttttttgtcggtaatttttaaattaccatttcaatctcactgcttgttattggtctgttaagagtatctaatacttcctgatttaagctaggagggttgtattgttccaggaatttatccatctcttctaggttttctagtttatgtgtgtaaaggtgttcatagtagccttgaatgatcttctgtatttcagtggtgtcagttgtaatatcttctgtttcacttctaagtgaggttatttggattttctctcttcttttcttggttaatcttgctaatggtctatcaagtttatttatcttttcaaagaaccaactctttgtttcatttatcttttgaatttttttttgtttcaatttcatttagttctcctctgatcttggttattttctttctcctgctgggtttcggtttggtttgttcttgtttctctagttccttgaggtgtgaccttagattttctgtttgtgctctttcagactttttgatgtaggtgtttagggctatgaactttcctcttggcaccacctttgctgtatcccagaagttttgataggttgtgtcattattgtcattcagttcaaagaatttgttaatttccatcttgatttcgtttttgaccccatgctcattcaggagcaggttatttaatttccatgtatttgcatgtatttgaaggttccttttggagttgatttccagttttattccaccatggtctgagagagtacttgatataatttcaattttcttaaatgtattgaggcgcattttgtggcctatcacttggtcaatcttgaaacttccatgcactgttgaatagaatgcgtattctacagttgttggatgaaatgttctgtatgtatctgttaggtccatttgttccaaggtatagcttaaatccattgtttctttgttgactttctgtcttgatgacctgtctagtgctgtcagtggagtattgaagtcccccactattattgtgttgctgtctatctcatttcttaggtctattagtaatcattttataaatttgggacctccagtgttaggtgcatatacttttaggattgtgttattttcctgttggataaggccttttaccattatataatgtccctctctgtctcttttaactgccattgctttaaaatttcttttgtctgattctaagtatagctaccccctgctttaccccctgcttgcttttggtgtccatttgcatgaaatgccttttttcacccctttacttgaagtttatgtgggtccttatgtcttaggtgagtctcctgaaggcagcagacagctggtgacttcttatccattctgcgtttctgtatcttttaagtggagcatttaggccatttacattcaatgttagtattgaaatgtgaggtactgttgcattcatcatgctccttgttgcctgtgtacttttttttagttttttcttttcggtttttaacttgtattttcgttttataggtcctgtgtaatttatgctttaaagaggtgctgttttgatgtgtttccagaatttgtttcaagatttagatctccttttagcagttcttgtagtggtggcttggtaatggcgaattctctcagcatttgtttgtctgaaaaagactgtatctttccttcatatatgatgtgtactttcactggatacaaaattcttggctgataattgttttgtttgaggaggctgaagatagcgccccaatcccttctagcttgtagggtttctgctgagaaatctactgttaatctgatagatttgccttcataggttatctggtgcttctgtctcaccactcttaagattttttccttcatcctaactttggataacccaatgacaatgtgcctaggtgaggatctttttgtgatgaacttcctaggtgttctttgtgcttcttgtatatgcatgtctagatctctagcaaggccagggaagttttcctcggtcattcccccaaatatgttttccaagcttttagaattgtcttcttcctgaggaacactgattattcttaggttcagtcatttatcataatcccagacttcttggaggctttgttcgtattttcttatttttttttctttgtctttgttggattgagctaatttgaagaccttgtctttgagctctgaatttctttcttctacttgttcaattctattgctgagactttccagagcatttcacatttctaaaagtgtgtccaaagtttcctgaattttttattgttttttatttaagctatctatttccttgaatacttctcccttcacttcttgtatcattttttggatttcctttcattgggctttgcctttggtccttccctgattggcttaataactaaccttctgaattctttttcaggtaaatcaggtgcgtattattggtttggatccactgctggtgaactagtttgatatttgggggtgttgaagatccttgttttgtcacattaccagggttggttttctggttccttctcatttgggtaggctctgtcagagggaaggtctaagggctgaaggctattgttcagattcttttgtcccatggggtgctcccttgatgtagtactctcctctttttcctggggatgtggcttcctgtaagccaaactgcagtgattgttgtctctcttctggttctagtcacccagtgaatctacccagctccaggctggtactggggattgtctgcacagagtcctgtgatgtgaactgtctatgggtctctcacccgtggataccagcgcctgttctggtagaggtgatggagggtgcaatggactctgtgagggcccttagctttggtgatttaatgctctgtttttgtgctggttgacctcctgccagggggtggtgccttacagaaagcatcagctgtagagagggactggtagtgggctgggccctagaactcccaagattaaatgccctttgtcttccactaccagggtggatagagaaggaccatcaggtggggtgggactaggtgtgtctgagctcagactccttgggtgggtcttcctgtgactgctgtgggggatgggggtgagattcccaagtcactggagttatgtacctaggagtattatggctgcctctgctgagtcttgcaggtagtcagggaagtgggggaaagctggcagtcacaggcctcacctagctcccacgcaaactgaatggtcagtctcacccccactgtgcctcccccaacagccccaagtctgtttccagaggaagggcgagacggacttgaaaacttgcccgaggctttcctcctctcagctgctgaagaaaagggctttttagttcttcaccctgcctgtgaagtctgcttgcaggattggcgccctcccctgggttctggccaggaggcttctcaccccattcaaattgttacaaagtccagctaaagaattccttctccctatggagttttacaccctgctcctctggccaatctctcaatggatccctgtggtgtcaggcaagaatgggctgcttggggacccagcgagctctcaggacctttctgctgcttcctctacccctgtatttcacttggctcggctctctaacttgactcagctgcaggtaaagttggaaacttctcctggaaacagaccttcagcttttcctgtgggagtgtgtattcaggagaggagggtttccctttcctacttccacagttgaggcactcacagtatttggggtgtctcccgggtcctgcaggagcagtctccttccttcagagggtctgtgggtcctctcaggattgctggtttgttcttgcattcaatctggagctaaaattcacaatgctagcctctgcatgctgctctgtctggagctgcaatctagtcctgcctcccacccaccatgatccccacaagtaagtttcaagtagtgtccatgagttacaatcaagatgataactccatacacttcaagccaagacttctattaatcttttatatattaaaatacaaatcataatttagcaatgtttactgaacatatttctgcgaagaaatctcttactagtttctggatgaaaattatacttgattgtgtcctcccaaaacttggacctacccatgtttgttaaaataggaaaggagaaagtaagattttggtttaatcattctattatgtatgagtttgtaggaggtattagacattatctgtttcaagtacaataaaaagctctaaaataaatgtaagcatttcagttttagtttgctgaggaatatagcatgctatagtggagtaattactgcatcagagtcagaatccattgaacttctgtttttctgtctataaagtaaaaaatgggactaatagaatccctaaaattctaccacattgttggaaaacttgcatgtgctttgcaggtaagggatttaagaacgatatttgctgtaaaaaatgtgagatgagtattattttcccgcaggaataggatgaccggttgctaaatatcagtgggttatgttctctattcctagacttcccatttccttcataaactcttatcagtccatctttctgcaatcactcaagaggtctgtatgtgctttccaaatttcttctcttggcttcagaaattttatttgggttttgttccagcttatattttatttgtttatgtaaaacttgtctctactcctcttcctttttacttctttttgtgatttgctgctattttgtgtttcttgacagaggtaagtcatgtattgttcacctgtttatagctctatttctagccagctccttctgtctaaacgttcaggctcactttctctctctaaaactgactttaaaactaatattttcttttcagcttgcagttcagtatgtctgtaaagtttttgtgatactattttctcatggaccagagataaacaaatggtattacattataatgctctaatacaatcaactgttgcatgaatgaggtgtttttcaatgagtaacaatatttgtcaagcaggtataattccattctgactaatggaaagaattttgtgtccttcaattgatgaaagtgaagattttacagatcaaagttttaatttaaaaaataactactgaaaattgcaatgcctgcaagtgtttaaatatagcataggagcttctggagatacacatacacaaataatttttcttattatgtacagatattttgttcttcatggcttgttaaacaatgaaaatgaacattcggtaatgatatttaaattttgtttgatgggtgggtatgtttgtgagtgtgtgtatcgtgatggggagtgggtgagtgcacttgatttatttcctattttcttcttgtttctgctccttgcattttgctggaggaccctgaatgctttattttctcaaccatgtctactcccccagtgacaaagaacattgaggaactacatgaatagaaaaggcaagagctctaatgaggtctttaaaaaggactccattgggtggtcagagtagggtgtaatagttatttgatttaaaatgaagtccttaatggcgtctatcactaatacattctgaattgattatgggagtgtggaatgcttgcaaagaatggagaaaactgccaaatacagactgaatttgtttgaaaggcttttaaaagagggggcagaaacataagtaaatatgtgtatatgaaatatatagaaggaaatgggtaactgtgtgcatatgttactattttctaccatggtaggatttctgtatagaaacagcccaaggaatcatatctctaattttttacgttatatgccgaaagaaaggtgtaattaatggtgctaagaatccaagcagaatacccttatatttttcaaattgataccttctacctcatctcatttaatgctcacaataggcctgtgaagtagaggctcctgtgaagatagagatcctgagtctcagcacggttaagtagcaatctgccttggattacacaaccaatgagtggaagggctgaggataaaacatggcacataaccaagtgtccttgtctattttttgtaataaaattgtattattttattatgataatttagttaagaatcttgcatgtatgtaaacgtgtgaagaagaaaacaagttaaggcataatgtcatcacgcagcaatatcaactactaatgttttggtttatttcctttcagatgcatgcatgggtagacagaagacaagaattgaggttatcattgcaatcagagttttgcgccttgttttcctccttgtaatacaatatgagcttttcatcatgtcattagatagtcttcagaattataattttaagctcccaatgcctttctcctggttcatgccaccccttcttaaatgaattcatccatcattggtgacagtccaaaatggaaagatgacacatgccagcgatctaagagccttctaatactcatgatcatattgtcatggggaggtgtcactttagtgagttttgttttgtttttattttttgttctgtttcatgtttttcacagacggatggagagaaaggcctctaagctgttaggttttaaagcagaccctgcttccattcttaatcctagacttgtcatgattttctctctgtgatttatctataaagtaggagtgcccctcactggtgagggaaggattcaatgaagattcaggatcccttaatatgtaggactttggctgaggaaataaaggataggctaggatttttcaagttgtctctaccatggcacagggaatagtgagtcttgtgcctggctcccgagttaggtggatgtgttggtggattattgctcttgtaaatatccttctgtatatatcctttggtaaattaacaggtggtcagcactcctaggtttccatgttcctttaattctcattgccatataactcagagccagtcatttcctcaatgtggtttcatctctaaaatgaagatgttggattagctgatctccttattcctacaagttctaaaattgttgtacatctattgtatgctgttcagtaaatggatgaccagacatgagccctctaatgcagctccacaggcagtgatggggaagtagaaaacattttctaatttccattaaccccttcccccatctactctatctccggaattatatttttagaagccaagtgcttcttgactttttgcaaaacaatattttgatgacttaatttaatataggtcagcaacatatggactctattttacttgaaatgtccactggtttaaaaatgaaacaaagattttggcaaatgtttttaaaagtatcttgaaacttaacccaggttttccgtgcctatgcctttatatgaatgtgattattgttcttgtctctttaaatactgaagcctgcagtgcctattacaattacatgtccactaaagaacaagtaggcatcagctgacaatcatactgcatttttattattattattattgttattatttttagacagagtctgactctgtcgccaacgctggggtgtagtggtgcgatctcggttcactgcaacctctgcctcctgcgttcaagcaattctcccacctcagcctcccgagtagctgggactacaggtgcctgccaccacgcccggctaatttatgtatttttagtagagacagggttttgccatgttggccaggctggtcttgaactcctgacctcaagtgatccacccgcctcagccttcctaagtgctgggattacagttgtgagccaccgcgcccagcccgtagtgcattattgaaagggaaaaacgcctgcataagcaagcacagtgtagcttataaattaaaaaatagtagccaaagcaaaaagaagaaatatcagttgaaacagctactttattagtaatgtgtgatagtgctataggcagacaaatagcaatagtcttctacttacatatattcttaattaatcttgaaaccctgacaggcttttcactgaaaattccattttgctcctttggatatcagaccctgtttgtaagatgctatttagttttctcctagctacagcctaaccttttctctctcaagccttttaaaaatgaatatttcatagcataatttgccttcctttgtaactagagtgttttggaaagctacaaataagaaaacacaggttgcaaagccaggcagaatccctcctcttacttctattgtatcaatcagaatgttggtttttctaaagggatcaaagccatttatctgttggagcacattaaacccctgcctaaaggatttaggctactgttttctcttccagaaaggaattaccacaaccatacaagtcagcatagtaagaagctaagaacattttgtcaattctcccattcattcattcattcactcattctacgtttcctgcaacttcctatcctgggcaggagacagataagtaaataagcagtgatgataccaagctttctaatagagggatgatgcaaggaggggcttactgccatcaggcaagttttctctagtcaattcctttctggcagactgagggccaattcactggtagagactagttgggattgacataccaatgaggtagaaacagattgtaccaaagcatggaaatgcaaaatgatctggcccactttggaaagaaattcagcatgtgtagtcattgacatagtggcagagaggtagatggactggggacggggttcctagatacagagaagcattagatatttgattatttctttaagaaaaatacaaataattttcaatgaccccatgatttctacatgaagctctcctgactcacacacccagagacatttatatcaataaaggttattgttggcagtaaccaagactcctcatgaactcctattcacccttcaagacctagcttaaatagcacttttgtaaggaagcttcccttgatcctgacttcatgtcccctctcagagcactgctcaaacatcatcttttgcgctaggctgacttgcctatattgctcaccattgtatctcaaagttcaacatggtgcctggcccctagaaggagcttgacaaataatttttgaatgaacaaaagaatatatattatgcccattaaaactctatgaaggatacaggtacaaccttgagcactcacgcaaaaaaaaatattgtagctaaaagagtaaatggaagtaacacaatttgaatctttattataagacatttaacttaaaagcaccaagttgaaagtttttggtttttgattcgtctttcaaagcccagagtcactttccaaataatctgcctgggactgttttgttgtttacacatctctttattttttttcctgctgttattttcattaacaacaaatattttaatatcatactaaactgagctacattagatcaactcgaaatcttttagactctcaaaagctgggcattacatattcaaaacaggacctaatgtttcagagcttcatattctactataattatatggttcaatgcaagtgattatatctcttcttcagtaacgggctgaaaagttttggtttgctggttccctcataatttactgcctaggtataataggccagtcttgcggaaaaaaagatgataaatgatgctggctaggaatcatagatttattaaatttctatcaaacagtgcaacaaaaaaaaatctgcttaagttagaaatgggctcaaattttttaatcaaaattcatgagtcctgatgcttggttcagtaggtccaaggaaggtttgaattgaagactgattaaagaaaataaaaggcttatttgaagtaatttttcaatgacggcttttaattggatgttaaatcaaattcttatctgcctttctgcagatagcacattatataaaatacagttagcggcactaccactgtaacggatacactgaataacaattgacttctcactttacactgagagggtagaagggctgtgtttgtcagcctgtcagaaattaagtatgtaaattaatgcttaagtgtatgaatatgaatatgatttacaagaggcttggagtattgttggggaaaatactgaggtttttctttccccttcaaggttaacaagtactcagtgacctttacagacagcgtgcagccatgagtgtgttagtgtgtgtacccacgtgtgcattttgccagtgagcttgggctgggagcttaaatactcccgaagagcaaataccggactcattctctaatgtccctttctgccatccatgagtgtcagcccataaaagcaatttcattagcatttcctcattttccaatataagcagtcagtgtggtactaataatgggtccttatccatcctttgcagaggatgggtattgtgccctgtggagggaagatgggctaccttgactggggggctcagagagcaccctggccagcatatgtaagcacttgagaccctatttgggaaaaatggttggcattcctgaaaaagtgcttaaccttttgcaggccatagtggggacggggatggaacagattcatctttcacagctgactgagatgaggttggtttgcaagagttaatggaacttttgttaagtactgaattaactcccaggatagcgtctgcagattgagggaatggagtttgcatagaatggttttctcacatacatttttaatggtagatctttagtagacagctcattaatttcatgattcattaccatgaataatatcctttaggcttgggaaaattttctcccatttttattctaatttttggaggaactgtaaaagctgtgcttcacagaatttaaaaaggggaaaccccagtacatagtttagttacaaatacatattagtttctctgttgccctaaacagaatagcttctatgttggctttccatgtttgaatacacacaatatcatcattttgctgattgagaattattatttaaactagtgaaatttacgttgccttcctaaatagtcttttttttttttttttaagtttagaaacagagtctagctccatcacccaggctggagtgcaatgacgtgatcatagctcactatagcatcggactcccgggctcaacagatcctcccacttcagccttccaagtagctgggacttcaggtgcatgccagcattcccagcttgtctgttccattgcatattttctttaccacttttagagtaaagttattttaattgacaaattctaaattgcattaataataataatacctacatctgctatatattgagtgcctcatttggatcaggctggttacttgatattgatggttaacagcagcttgtggtgagtcctgtagcgcctgaggaatattccaaggccatatggtcagaagtggcccagcaggcattgcagccccacttggattgaccccagaccctacgtgctgcaccataatgtagcatgcttctctccgtcaaatcttcacagcacttgcaaggtagttggcattaagcatcttttacagatgatgaaactgaggctcaggaatggtaagtaatccagaacacaattaagacattggtgagacatttgagcaaaaagtatttccatttctacccttcacccactgcctcctcctcaccttacaccgtgagcactttctccaccatgatgctgagggcctgcaccctttatttatttatttatttatttatttatttatttttaagacagagtttcactcttgttgcccaggctggagtgcaatggtgaagtctcggctcactgcaacctccgttccccgggttcaagtgattctcctgcctcagcctcccgagtagctgggattacaggtgcccgccatcacacctgactaatttttttgtatttttagtagagacggcatttcaccatgttggccaggctggtctcgaactcctgacctcaggtgatttgcctgcctcggcctcccaaagtgcttggattacaggcggagccactgcgcccagccgcctgcacccttaacatttattcagagactcctatgcagtcgtcttttctgggacctcatctttgttggttttattttctggggggaatagcatttgacattttcccatccttcttttgaagactcttgacattgtattttcttggctctcatcccgcctgtctgtctgtgatttgctgtttttcccttccatccctcagcatgaggtatcatttcagtactttaactttgagccttttcagtaatcagatgtagtcattctcttatccagtcatttcttactgtgccatctctcccagactgctgtctcacacttctagccatgctctacttgtgtcagatttggatttaaatctggatcctatgcaaccctggaaaagtcaatgaacatttctatgtctcttcatttgtaaactgggaataataatagtttttcatagtgttaaatgaagtgtaatatttatagggttaaatagttcttgcaaagattaaaaaaatgagatggtgaaactggagaactgagtacagtggcttgcacataataagcagtcagcaaatggtaactcttgttcttgttactagcatccacttttgggtcacatggcacaacttgccttgcattgtcattcttaatgaccatatcttgtctccgtgagagaccatgagcaacttgaagctgtagatatccatatatcattctgcctcaatcaaaaggtatattcttgtcttctcttttgataacaagcatttagagtggtttattttcattctgtgagctgagtataacaatttatacttatttccaaattctccagtgtttgctgactataattgaaaccacataaagatactctgtttaaatcccataagtaataattctgtgctaacaacatttttgaatatttcaaggaaatagccagtttctccagagaattgctagtatcaccaacatttttggtgaagtttctgtcttagtttgtttacttttgtagccagtttgaaatgctagatgtggactgctgtggacagggtaaaaaccaacaacaaagttctctagctagttcattaccttcattatgatgtatgtgagagctagattattccctctatgcaatagttgtgttttctaaattagggagttgctttgggaatgaggggcctgtggtacttctagagcattcaggatttccagatttgtaaacagttatgcacaatcttatgatgccctactcaccatgacagagaacatatggccagactggcctttctgtaggagaaagcacattacaggataagagtgtgctaagcaacctctagtagacagggcttgttctctggagaaatctgcctattgtgattgtgtgggcatgtcagtggacatgaggagtttctgattagaaagcccatcttgtcctgggtagccaaatagcaggtgcttaaaaaatggtggtattgacagccatcaccatttcttaactaggcctcatggattctgcctagttaatttgcctgctttctctgacatgatttatttgttcactctccgtgcatgttgcttatttcaactggggttgctgtaacaaagtaccgtaaactagaaggcttataaacattaggaatttatttctcacagttccagaggctgagaagtcccagatcacagtgccagcagatttgatgtctagtgatgtcctcttacattcttagtatcttcttgcggcaatcctcatgtggcagaaaatgcagaaaagcaaggcagctctctgaagcctcttttatcggggtaccaatcccattcatgaaggaggagccctcatgacctaatcacctcccaagggcaacatcttctaataccatagtattgagggtgaggatttcaacatatgaatttgggggaatgtaaacattcagactatagtacatgtactattcccactgccaggaataccatcctattttccctgctaataatcgactctacctttgacaacagagcaaacaagttataatatgaactttgttagtcattgtcttttatctgctgctgggcttttcacctacctttgtatccagtacttaccaggatgtcctgaacccaggatgagctctcttaatgtctgcagaaggaaggaagacaagggaggagaagtgggcaatttagtcaaaccactggggaatcaaacaacttgttaataatcccaactatggagtttgtccatctagtcctagccctgaatagcatcccaattttttaaaaaatgaatttcaagtgagagaatgtcatgttcacattagtattgaatgagccacagcacgtccctgatttatttatgttgtgtgaaaatttaagtagtgatgtaagaacatatcactttggggacatttgctgttttttaatttaacctttgtggcagcagaaaccatctcctcaatgaagacccctaatgaaagctggcagaaattcgtgtttttattttaacttcatggaagaaaaatagtatgttacttacataatgtttctaattatagctttttcgttatactattttaattgtcttcttaaatgcaatatttgacatgctgccaggaacttctcaatgatttcttcattgagcaaagggttcttagacatcagctacgtttcttaaaactgtacactttcgcaacattaaaactcaatcttttctcccagagtcatgttgcatcttatattcctcccttcccaggacacatcatgcccctttgcataaatatggagggtgaggtagggagaacttgagcagccatttgtaaggctcacttctttttaagctttaagaccttggggatgttgtgatgatatagctgtttgtctgtgggggaggaaataggattaaatgaaatgaaaccataccagaatcactcaactccacatttttatagtatgcataatctgctttttttctggaagtcatgaaagatgttctttatttcttgttttacaaaaatagctgcctctgggtatcgataatactagtttaaattcttcaaaagaatccatgaattgtaactgctctgatagttctgcagctattttttaatttgtatttttgctgagaaaattataagctgtggagtaaattttaagtgcaattatatacccctggaggaaactcttgaggcagtatcataaatggacttatgaggcaacctcctgataatatgggacagctgattccataacatatgcatctggtcttacatgctttggcacattttcatttatctcattaaatccattctgacacatttttcatgtaatagcttttctgataacttcggtttgtaaaacattaatattgaatcttttgggggaagacagtgatgtctctgttttaatctcctgtagctatgatgtgtatcctgcactttaccgagtggcagaaggcacagcttgtcactgttaattgtgactgggatatgttgttgatgctaagactctatccaatgtcctgaactgaaaagttttccgtagaccactgacaaaaataggccatggagtctgtgttccttcagtttagttctacattccatgaaagccactactacctggcctgttgcttagcctttcagacatctctcccattccttctgaatacataattggctctcaatcttactacgtatgtctagctaaggggtgcagaatacaaactccagagcctcccaatatttaggcaaattcttttgcacttgagggagcaaggcggtaagtgggggtttgatcaagagcttcccatccaatcaatcatggctatgatcaaaagtagaccacaaaagaggaaggcataatgataagattccaaatcactgaacctactaaaactattttccaaatcctattagaagagcactaacatacaaaacacattgattatacaatagatgccattatgccacatacaatatgcaataaacacaagtaaccatgctatgtaacactttttatctctactaatctaataagcaagctctaacaagcattaattcaacagtaagtaccaataattgtgttaggcttcttagaatcctaagaaactttggaggattgatttggttttccatgtatttttaaagtctttttttttttctctgggaaacaggagctgataactgttttcttcccgtcaatacatttccctgtagcaaagaccatcaggaaggcatgaagagggcaggaaatttatttgctttgaggatccagaagctatctatgggcttcttctagggatccaaacatctgacctttcttaatctcaactaatggaacgagtcacctttcacctcttcttcctgtgtggcccctcccactattccttttccctacaccaggaggatagagtcctgttacagaatccattcaatgtttggatgttgattatacattgttgaaggaacaattaaccattgttacaaggggatgtataaagtgctgaaaagtggtgacttgtgattagaggtgttccccttctttcttgttgagagactgttcaattcaactgtactattaatgaacacaagaggaataatacacgtaacccctgccctccggaagctcataatctattatgaagactaagataaatatacaaaggattacaatgaaataaataacaggactctttcttataacatctttaaggattctgaataagttgaatgaaggcatcaacatgctgattgagttcatgcactcatagatgggcttttcatgttgattgtagtggtgattacgttttgtaactgtcctagcgagtgtaggagtcaaagagatagattaatatttgaaacttcctgattgcttttcatcttggcatcaggttatcattttacttgcacttataccagaaactcccatgttcaaacacttccttccatattatgtatttagccttatcttgattatgactgaagctgcgtttgtcacttttgttttcaaatcatcgtgacgctgagacagttcaatgctttgtctgtgcttaattatgatattgagttacagaaaaacgtttcccttttttttccaatttgccttaatcagggccttaagtctgacctagctctgagtcatgttgtatttgctcctcagcgaaatagcaaagcagtccctgttcaggttacactaaatcacaaagtgatgcgggggcgacaggttctgcagcaagttagaatcacatgctgttaggtttttgcctgtatggatcaaattctaacagaaaaataagaaaaggtggaggtcactgcatatgtccagatactctgaagtgaaatgacagcattagagtgacagtatcttattcttcagacaaaggaattatacagaatttctaattagaaaatcaaaaatactcaaacattatttaaattatcatacggtaaaatatccagtgattatctgttatctatctatctatctatccatctatctatctatctatccattcatccatctttctgcttctgtttactgagccatcatatgagatgtttcataaattttgcttggaacacccaaatatcttccctgaaacaaatatgctgttggtcatctgagccctttgctccttcaaggaaaattagtggggcagaacaactgaagttgaaacactggctagttttaatgtttataattagagattgtttacaagcttgatggactggacctgagccaggaaactattaaaagaggctgggcccacatcattgtggagcaatgtaggataggggattcatataaaataggctttagaatataacagcctgcattcacattcaggaactgtctctttctagctgtaaggaagatatttaactgccctgagtctcacttccattatctgcaaaatgggaacaataatagtgcctaccttagagggttctttaggatcacatgaaataaaccatgtgaagtgcttagcacaaaaattggctatgctgtatatgtgctaacatttatatagagctggcttggtgtaagaatggcactggctaagattggtgggaggtaagaacagttagcaaattaatacagtgagcttctctccttgtgctgtgtaccttgaactgggaatgatctcatatgaaagacttaactgtgctttccattttgctggtgaattatgagaattctgaactttatgattttggaatgtgaacatttcatttgatagtggtgatttgtgtcctttataatctgcaaataatcaacctatttatttgaaattaaaaagaagacaattcaagaattgacttatttccctctgacatctcagtagtagtacatttgaatcttcattcattcaccatgtctaactcacataaaaacctgcccaagcatgatgaatgaaggtatagttttgaattttaaaaataaaatatatgaaacagatgtttgcagcaagcttcctcactttctggatgattagatatacatggtgctgactgaatattttgtgggctcatctggcagcttaagcacaaagtgcatgcttgcaagttagcaactagaatataagaagttgagacacataaatgtagtaagtgaataaaagtagaacttttgatttctcaagtcattacatttgacctgttgacccctggtcagggtgggagttcataaatgacagagaacaacaacataacatgagcacatggagtccaaaaaaagggtcaggtggggaacataatatgaggagggtgaattttaaaatcatattcaatttaaattcattctgatatatttagaaaatgttcagttctgtaataatcttacctcaaggtataacatagtactggccgccatggccaggattgtattaaagttccatttggtatagaccaggagcttacaaattacaaatgcttgtttttacaaataaagtactgtcagcacacaaatatacccattcatttacatattgtccatagttgcttttgcactgcaagggtagagttgaatagttgtgacagagaccatatagcccacaaagctgaaaatgtagtatttggtctttcgcgggaaagtttgctgactgcgattttagaggaacaagaaaaaagttatcagatacatatatgcctatatgtgtgtctatgtatatgtgtgtactgtatgtgtgtgtatacccatatatataaaaatacaatttaaagcaccgtatatacatattaattagaaaattataaagagtactataccatgctactagcatggtagttggctctcagtaggtgcccagtgaatgagagttattagaattaaaaatagtctgcataaaaaataacctagattagatctttaaaaagtgttttggatcagcaaggactattttataaagaaagtgaggagcaggaagacttgttcatttctggtaaaatgagaactaaccccaatctttactcttctttgccaaaattgagcacaatcattgacttaataagacttaaaaatcctcaaaccattttaaaaatctatctttcactcttatttttgttcttatgctttataattattcaaaaaggttaaactctcatgcatctctctgctttataagctgggaagagaaccagcaatatcaaaaaacaaaagttcgttctcataacaactgtaattttgtcaaaacatgcaatgtcctaaatgctaccacggagctcattcggagtaaattcatatatttagatgaagtcaggtgacattgataactatctgagtaatccattttccatttggcctgctgttattaaaaagtacatatttgcattatttagcatgatcctatgtagggcaaagcctcacactgagcaatctggttgattcctgtgtattgtatttgagcaaaagaccatgtaagtaggggcagaatgcaagaagcagagtatgaagctcttgagagtaatgtatagaacaattttctgaggccaaatgttagcttggaaaatttgagagaagaactgtcaacgtaaatgtcaggttatttgaaacaacatgattcttaagacacagaaacacgtttctcaaatattggatagctgtttttgtgattttgcttgtttagttttaaggttggccctttggcagacatttcctgtaacttttttaaaataaaagtgatagaagttgattgtggaacattgggaaactgcagaaatgaataaaaactagaatgaaaatcacccataatttcatgaataagcaataaccactgtagatagctcggtgatatctatgtctctatctggttatttatctccccaaaacagaatcataatgagtatgtggttttctgtcatgcctttttgagcattttcacttatcattaatttttaaaacttgaaggaagaccttctataaatattatagaacgtgattacatttttgatttaacatttccccttttgttgaacatttagacatttccattctttggtattgtaaatagagctgcaataaacagcattttgcatgaatcatttcatgcatatttagcttttctcccttaggataaaatcctagaagtggaatgattggatcagagagtatgaacatttttaagtctattgatacatatttcccaactgtcctgagattcccaactgagctgggattataggggtccgccacaatgcccgactaatttttgtatttttagtagagactgggtttcgccatgttggccaggctggtcttgaactcctgacctcaggtgatccacccaccccagcctcccaaaccgctgggattacaggcatgagccactgcacccagccaagaatatgttttaaggagtaccaacaacagtcctgaattttcgatgctaaactcggcagtcctgggcagatgagaacagttggtcattctattttgctttgtgtcgcctagacataggacttaaatcccggaaatgtcacgactttgggtttggaatttgagagaatctttacagaaagctgcatttctgtgggaaagtcactcgtttagttcacatgatcctagaaaatatgtacacaattataaaccattctactttctcttaggtttttgtactagacttaactatgtgcatgacattcagggttctgatttcttttgaattatgaaataaacatgtttatacccaaacaagaaagaatgaagagttgtatttcccaagaaatattgtagaatgagttcaaggattattactgagataagaaaggttgaatgcagtgtgacaatgaaggcccagtgaattcagagaagcaaaatggttctgaaagtgacattttctcacatagtcctctctgctgacattattgtaaccactgaatgcacagtgcaagcatggtgttgattttaaatcacagtcagagaaattggggctggacacatttttcattatgttttgaggatagaaggatcattatgttatcctaggaatagttttgttaatggaaatgcctctgattctccctagatctatcataaatagattaaaatagcttcagcagcatttatcctgtgcttcatttcacttccacgatgtactgtgattatgacaatgcctgaactgtgtctgagaattgtaagttacattcagcctggaataagaaattattgtcccaccaagtaaatccagtaatgccatcaactttttaggcacattgtgaaagcaattgtgaattaatacttgctttgagccacagtagacagagtagagagtggacaattcacctgaaagagctttttcacttttctaacaaatgcatctgcccaaaagccattttgactcttttcataatattaatgttttaaaattaaaaataaaacattgaaactaagtcatttgtgattttctttgttccaatttaccatagttggaattttcatcagattggaaaaataattcacgcccaaggtaacagttactatgccaggtttaataaccaagctttgaacccacccaaatcaggatttagaatggaaacagtgacacacctcctgaaagctttaagcagcattgaatggagctgcttaaaaagccagactggagttttctatgggccttcttaaaaagaactccaatccctgcctggttacagaaagcagtatacaagacaaataagaaatactacctttctttcttcttttctgacagaattcacaaaaatttcctcaagctttcaacagtgtctctgtcagtggctcctcaggaagaaggatggccttcaggcatcatcaaatattcacagggaaggaggtttttaagaattgtagtgccaattgcatgctcacagctggactgactcaatgggttatgagacaatggaagggcaagtttttagtgatattgaggagaagcaaaatcagtgaaaataaattggaaatttccgttgtgtaaaacagtgaagtatgctgaggtatagaagtgcatgcctagagtttgtattgttcatctatttgaacaagtgccttaagtgaggcattgttggatagtttgtcaatataataaatagtatacacagcttttattaaaacatgaagtcatgtccttagaatataactaggtaagattttaacatattcctgtgttaagctgacattcaatgccaagtctaaaaatattgaacataaacacctctatttgccaatagatttaagtgcaactcttctgcattgggctctttccatgttacctcatctatttatgtggccctagaaagaatgtgtgaagaaagcagtcttacatttaagaacactattcctatgtattctgacctcagtttccttatatgtaaaatgaactttatatctctactatttaatgaatttgttgtgacaatcaagggttatgatcaagggtaacattgatcctgtgtttcactttacttcctcaatgtacaaaaatatagctggacgaaagtatgggtaggtatagctttgaccagaatggaaatatctggctatttggaaacattgagagatttttctttctttttttattgttttaaactactatttagaactattatgtaacattttacagatagaatagttggggggaaaagtcactgtacttgtcgcttaggcctgtgggtgtatatggggaggtcatttacaaacaattactaaagaggtagatgattttgatggcatatcactcaactgtcctccagttttttttgtttttttttttttttcataaaaacttggcccattattttgccaattgaaaacattcgcaatccagtctaccttgattttctgggtcaactccccatggctgattagctctttagactgcaaactcattcatttgtttattcaacgaatgtttacagagtcctgactctatgtcaggcatgatatcaggtgctggtactacagcagtgaacacaacagacaccttctgtatcctcatggaatgtaagctgtgtgtcttttctgttgtggctgcccaaatgcctagcatagtgcctgttgcatagtagatcttagtgagagtgagatttgctgatgggtgacagatgatagagtgaatcagtatattattaaaaaagtgagctacaatagttccctgcaagtgtagactttgtaagctccaaacactattctctgccaataatgaacctcactatatatatgtgcatgtatatgtgtgtgtgtatgtgtgtatatagatatagatatagatatagatatagatatagatatagatatagatatagatagatatatattttaggagaactgttgattatttttacgtttttaaaatttcaataggttttgggggaacaagtggtgtttggttacatgaataaattttttagtggtgatttctgtgattttggtgcacccatcaccgagcagtgtacactgtacccaatgtgtagtcttttatccctcaccctctcctaccctttcccctgagtccccagagttcattgtatcattcttatgcctttgcatcctcgtagcttagctcccacttataagagagaacatacgatgcttagttttccattcctgagttacttcacttagaataatggtctccaattccatccaggtagctgcgaatgccattattttgttcctttttatggctgagtagtattctatggtatatatatatacacatgcacacatatatatgcttagtgatatatatatattatgtgtgtacatatgtatatgtgtgtgtgtgtgtgtgtgtgtgtgtgtatataacattttcattatgcattcattgattcatggccatttgagctggttccatatttttgcaattccaaatgatgctgcttaagctagatctgccatgcatataacatctcattgtgaagatccaggaaagcaagttccctcagatcgctgaggatagttgactgattctcatttcgtgtaccccatgcatcttataacttctcaggagcccctctgtgctctggctgctagggaactgactgctctttgtgacccacttggactaaatatccaggctctctaagaaagtacttgtgctacttaatcttggcctgatctcaccatccatatttcttacagttttaaacattattgtattgtgtttatatccacaaactgcctgacatctattttgtgacagaacaggattgaacatgtaaaatataaaaatgcatgtggcacgaggtcactgatcttacagcccaggctgacgacactttttctgaatagctaacttctagaactctgtgtttgctttgctgaattactgtatattttaaaataaatataccatgtcccttctcaaaacaacaaatattgatttcaaaaatctttttttagttttgagaatctcaatgcattttataggttaaaggtatctagacttgaccatacttttctgctaaaatttatccagcagtacttgacattgtgttgagcactgataaagtatttagtgaatttaattatactccatattttacttcctgggcttttccacgggagtacaaatcaaaatcaaaatcttagtctctgagatatgtgtagaacatgttaatcgagtattaaccctcaggttggctttcatctctgcatcctagaaccagtattagttttgggatgctatattccaaacactttctactttgaaggaatgggaagagattgctgcaggggtaatttcttatcttccacctgatttttttttttttagagagaagtaggtgatatggcatggtgactctagttattaacaatgtgttgtatacttgaaaattgctaagagacattgtaagtgttctcaccacaaataactaatacgtatgtgagataatacgaaaaaatgaaagaaagaatagaaaggtaggtggaacataaaagaacaacagccaacattgaggaatatagaaatccacctgattatttttatgaagtggcacagtagaaaattagtaagataaattgaggatgaatgcaaggatgctccagttctggacctccagaaggacagctttgaatctcaactgatttttatttctaccactgtttctatattggtgccagtcggaagcatagcatgcaaggtgtcacccaataaatgaatttggccagggaataaactaacaacgataacgttttcctggaagctaagggagtaattagagcaatgacttttagagacttcatttcagaaaagttcatgctttaatattcaaataattacattaatctgtagattagtcagctgaaatattaaattttttggcacaagcttaatgaaaattgtcataatggtgccaaaaagaaatcttatggctgccttttaaataccaaagaaattctccattgttgtgataaaatacagatgtggcatagaaagaacttgcatggtgagcagaaatagaatatataattagaacaaagagggcttaaatcaaattaatcttcatctgacaggaacagttacatttacatcattgagtgcaaagtcatagccaaaattgaaattagaaacagataattatgataagagaggacacttatgctgacttttctcatgcataattggagagcatacaaaatgcaatgctggttctaattagaattagcattaaaagatgccagttttgatgaattctgggttttgccataaaataagttgtctaaataattgaactatggacatgcaaatttgtttgcctgtttgttgtttgttcaagatacaactttaatagtatcagtgatatgaatgctgttaatttcttttgtcaatgtcatattgtaattttgttggctttgttttatttctatttttcttgagaatctgatttaattcttaaaagtccatcattcatttctgtctgcaaagtctcttttcgtacgtgtacttacatatacacatgccttataaaaatacagagtttaattgttcacttggcatgtatgaaaagagtgtgtatgacagtttcagaaatgcagatgtctaaagactctgtgatacaatcctgcttttttcaccttggagttcaaatgtgctatttctgaatggttgtactcaaagggaaaatgcgcatcccattgacaaattctttttgaaatatttcttcccgaattatttactagaatcaaccccttgactgggggacttttccaacaatcctagcagttgagaaaagcaggggcaggtgttggccatcatcttggggcttcattaattcatggtaggtgcttcacaactctgtagtctttgcttttctttcattgttgtcatttttaaaaacttttatttatagagatgggctttcgctatagagttgttgcccaggctggccaacaactcctgggcccgagcgatcctcacgcctcgacctcccaaagtgctgggattacaggcatgagccaccatgcccggccaatcttagcttttctttacctcttgttctgttactcttttcttattttcttttttcttcttcccttttccttctccaaggtgaagcttccagtctcttcagtagtagtagtgggtttggctgtttaactaaatctccaggggctcttgggagcaatttcattcttttccattaaattcattctgtcatacaatgatgcatattattgtagattgtgaaactcctaatttcatttttcttggaactgcatgagtttctgtcaggagaagtggacccagaccaaccaatgaaaatgcatttcaaagctccttaattcttgattttggataaagagtttttctctgcataaacaaaatagatcttagttgtatagcatacagcgtttctggctagggtaacattgaatgcctttccacctagggctctttaaaaccctgtgaaggattagattaaaaccttgtgaaggttgtagatttccttcctaagaaagtctttatttatttatttatttatttttattttatttattgttattatactttaagttttagggtacatgtgcacaatgtgcaggttagttacatatgtatacatgtgccatgctggtgtgctgcactcactaactcgtcatctagcattaggtatatctcccaatgctatccctcccccctccccccaccccacaacagtccccagagtgtgatgttccccttcctgtgtccatgtgttctcattgttcaattcccacctatgagtgagaagatgtggtgtttggttttttgttcttgagatagtttactgagaatgatgatttccaatttcatccatgtctctacaaaggacatgaactcatcattttttatggctgcgtagtattccatggtatatatgtgccacattttcttaattcagtctatcattgtttgacatttgggttggttccaagtctttgctattgtgaatagtgccgccataaacatatgtgtgcatgtgtctttatagcagcatgatttatagtcctttgggtatatacccagtaatggaatggctgggtcaaatggtatttctagttctagatccctgaggaatcgccacactgacttccacaatggttgaactagtttacagtcccaccaacaatgtaaaagtgttcctatttctccacatcgtctccagcacctgttgtttcctgactttttaatgatcgccattctaactggtgtgagatggtatctcatagtggttttgatttgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgtagattctggttattagccctttgtcagatgagtaggttgcaaaaattttctcccattttgtaggttgcctgttcactctgatggtagtttcttttgctgtgcagaagctctttagtttaattagatcccatttgaacgtctttataagcaaggaggattctgatccatcaaggattatttagagtgatgctgcctgaggtttctccaattctatgaccctgatcattgtcagatttcttgttgatttagtgttctctcaaaatttcccagtactcagaagtgccaaaagaaacatcaaagtgtggattctctcttgaatcttggttgtagtatctttccttagctttcacatttttctttgaattgtatttttatttgtttggttcattttggtctaagggctggggtaaagggcaaaggagaaagtcatttcattttagggaccacagtagaatgatacttgaaatgccattttaatataacttctcagataactgttttgtacaggtaaaacagttgttgccaggatgaattatataaatgattcatttattgtatattatgttaaataaaagtaacatggaagagggaaaggattttaaacatccaaataaaaataataatttatcataagaagctccagtttttattgttaatgtggttggatgatgtatgttaaataattgttgattaaaaggtagttgtaaaagctaaacattaataacttaaataacaggattttagttgagaagatgatgtcatggaagagagtgtgattgtgatgcaacaagtggcatcaatgtgaccatgtcaggaagatttttgtttctaaaacgcaaacaaagcatttcaaatgatagactcaaaagagcactttcaattgagatatttagtcatataggctgatttgcttcaacctgaatgcaaagtttctcagggaatttgcccctgaaagccactagcaacctaaagctcagtcttaagacagaaaggcatcctaaaccctgtgatttcataatatccttgtaaccacatgctgaaaaactaatttgctaagaacttaaaagggttgacaaacaaattacagccatcttgatagggggtgattattggcattaccaactcagttgggtattcttaatgaaataagacagctttattttcacaacttgccttgaaatgtaggtgaaggatatttaatgcttttaaattagcaatattatgtagttacatagcacttcacatttgcacatattattgaagtcaactctatttctttttccttcaaagacttctgggaagtacgtcaggataaccaggcccattgtatggaaggcataattgtaacatgtgctctatctgatgagccttgcctatgtaatctgaactcttacatactatggccatccgccctgggaggctgactggtgcctactgccgccttatgcctcctccatgctgtcacttctgcttggaatacttgactgtttccacttacttcctctgcctggtgaacttttattcatcctacgagagactgatcaaatttgtctctcttctgaagtttgttctgccccttttcagcccttttctgaacccctcaatcaccctcacccccaaatccagcagttagtccttccctttcctagttcaaactccctctgttctgttcttatggctactatggcatctatcacgctgtaatatagtgatctcgtcacatatgcttcctgcacttggctggcctgggacatgtgtccaggttacctgcaaatgtctcctctcctgaagaagaaaactaagagtccttaattaaatgcagttcacacctccttgacgtcacttccaggccttcagacgtgaagcctgctgttaactactcctgctgttcttgctgacaattttatggaggatctttaagggctttcacactgggccaaaaatgtgtgcatatgcatacacacacacacacacacccataaacacacatatttgcaagttaatgtgatctgcaagacctttcagtttgagaagaataatagctttggctatagagaagctattcccatagctatcacatagagaataaattaaaattaccttctaaggcacagattagggagggaaaacagcattttgggatcattcaccaaaaggtctttgctgtggcagaaagttatgaggacatgtttttgttcattgtttttctcatttgttgtacaactggccattaaattgcaggtggttcctcccagccgacagtcccatctgtgtcctggatggtggcaagtttgtgatggttcaagatcaagttcaagattcagatcaagaatcagatcttgccaaaatgtcacttcttttttatttcaacttttctcatttaattcctttgaagtagatgttattctttctcatttaaaggtgacaaaattgagactttgaagggacaaggagcttgacatgtgtacagctagagttttatgcccattggactgagccttgaaactgtgcaacctctcatttctttccacagaatggagcagggaccctgcttgaagaaaacttggtagatgaaaaatgatattataagacaagtacattagaatttttatttttaaaaggcttactatagaagtctttacaatttggacttgctttgtggaaggcaagatgtgccttccttctgaagaggttccattgaatacattgggtaaaaggcagctatagtgtcatgaaggctgccagcaggcatggagtgtgagtggttttcatgagtgtgagtggttttcatgaatagcaagaatacaaacctgtaacagaagaaactaaggtaacagggtaacaggcagcagggacaatgatgtatttttgttccctatcgataaactgttgaacacttttacaatacactgttctttatgttcctcagaatgtgtcactgggaagctcagttagaaatgtagagccatttcttagtacataatggactaagacctcagtcttgcccctccatcctcaacttggctcctgtttcgctctggggtctttagtttcaatgagaatccagaacagacgttctgaatgttttgggagagagccagagccgctggagtagtatggaaaatgatgcttctcagactcaggactctaaattaatagaacagattccaaacccagaccccttctccttaacttgatattatatttcagactgactcccaggaagaatccccagatttctagctgctgaaatgggcagttacagacaaagaagtgcattttgcaaaccaataaaaatggttccatagcattctgatctctgctgctgggggcagagctttccatggaaaggtatgccgtctttagaagtccagttatcagcaatttcacaggggccaattcaaagcctttccagattattcagtcttccatccatctgacatacatttgctgagtgcctactatatgcgagtactgtgctaaacatcagtgatgatgtgtgatgggggaaaaactgcaaaggacaaacatttatcatgattggattagacactgccttggtgtggcttgcagattaggagagaaaatcatgcgtgtggcatgatattcacacaagcatctatagctcaaggtagaaactgctaggagaggtgtagattaactccagccagtgttgctggggatggcttcagaagcagaagattatatttgagaaaaatcagcagctcattctatacgtggacatcctgaatttgaaaactgatattttcttatatcaaatgacacaaataaaattgttactcctagatacactttaatcctgtttggcagggtcccacacacttgaaatatcagtgggatttgtaattgtaaagttgggggtatcattccaagagcaggaggtactacaaatggaggaactgttaataaaaacatggacaaagaggtagaaacttgtgcaaatttaaatcacataataagtgatattgtacagcagtccataatctattgataagtgggagggattttcctggctcctgtcgtctggaagggcctcacacaagtcttcaatagaacatatgaagagctgggagaaagcctctcactcctttgtgaggatggtaaaacatgttttaatgcagatacttccttgatctgcttatgatgacctttctgttgctgaaattatttgcagcttaatatggtgtaaatgtatttcactgcaggagtattggtgcagaaaagagttaacattgcagtactgaaactgtagtttcctgaagcgcctgcttacaagattggcctgtggctggcctctgggaatatggctttgaaaatgttccctaacggaaaaaatgtggctcactgtgcctcaattgtttgtacaaatgttgtgattcatgctgaatacctgctttctttcacaggatctggaatttttgtacatgctgggcagaaggtgcctatgtggctagtcccaaatgaaaagattcagtgctaattctataatgcgcttccatgagcagaacttctcatgagatggagagaacacaaggaagcccgcatatggattcctccagactctgcctatttcttttttccttattttcctatcataagccttagtcgtgagtgaactatatgttgaattccatgggtgttcctagtgattctccaaatgtgtgggtggtcttatggaccctgccaaacataattaaagtgtatctaggagtaactatcttctttgtgttatttgagagaagaaaataccagttttcaaattcaggatgtccaattatagaatgtgcagctgatttttcacaaacagaatcaagacctgcatttcctccttacattcattttctccttctcttttccatgtgtaattgcaagagaatggcccctgatttttatattgaactgcctagtaatgagcattcctccaacacactgaattctcagaaaagaagccctttcaggcttgtgaccatcttgtctctgttgtgattggcagtaatccaagtaaagacagtagtaaatatgttttctcctctcacaccaggtgatcctcagtgaatctgattgttgactcatttgctctctcactgtaacagatgttgcttttggagatggaaatcaatgttacaaagtattaacaaggggagaacttacaagaaagtgaacctaaatgattctttgctgatttaatacagcctgatcttggcctgttatgtcagattttgcaaacagattttaaagggtgtaattttaagtaggaaattagttctgtgacgtgtatatatgcatcccagatagccaagagtagtgaaagtaggaagacgagaccccagtttgaaatgtaaagacagatggaaagtttacttgaaaaagaaacctgcaagattcatgcaagactggatgtaggcaggagactattggccctacaaatgtgttttttgacccataataggttacagcctgatttaataggtcacatttcactgcctttatgggcatccttacatcttcttttcagggtaattatctcaacacacatctgatgtggcaaggtaattgactcttgcttttgtacagttataggttaatgaaccagactgacttttttagaccaaatcactcgttttgtttctgaaatgaaatagaaatgtatttagaaggcaatgtttgatacattaaaaattctcagatggctgacaactttgatttctcatcctttatgcatcacagtgtgtagccatgaagaaaggattatagaggcatctgaaagcagcttggatgtttgaaatttagaatccaagaggaaagaatggcaaaatgatgcttttgatgagtttaacgttggctgtatagaacaccatgtgattattatagaagagtggcttacattttcaaagttgtttttttttctttcttttttttctttctttctttctttttttttttttttgaccagagccccctatgattttcaggtataatatgtggttactttaaattttcagttaaagttctttccaaaagtctgtttcagatgcaatttgtttgtcctctgatgaagctgcataaatatttctttattaataatttctaagtggaggcagtaaagatattgaaacttagaattgagattgagaaaacaaatgccttatcatttattttacattgtcatggagttagccctatggaatcaccaacaaaaaatgagcagcaaataataactaataattcaaccattgataaagaagcaactcattatgtatagcataatcatttttgtttaaaaaatgcttgaataacatagacacagagaggggaacaacacacaccaggacctgttgggagagggaacttagaggtcaggtgcagcaaaccaccatggcacaaatatacctgtgtaacaaatctgcacgtgctgcatatgtatcccatgtttttaggagaaatgaagaaaaaataaaaataaagataaaaaagaaagtaaaaaaataaaacaaaaaatatattgcatttgattaacagaaagaaaaacacttgaatatataaaaaatactagaagaccatacaccaagatgttaaatctagtaatttctaagtgaagaagccatggattcttcttttaaaatatatttcctgaatcatatttagatatcatgcaatttttgttataagatgaaagaaaatatatgtatctcttttaaaaagtaataattagtgcagggaggtctgaaaataatagtgactatatatttcattgtggttacatctttttccccaaatcttcatgagaagaaagtaatcctccaaagaattctgtttccagctcttattaactagcctcttaaaaccagttgagggccagggcaatttaacaagcatttgtgaagagggtagcctcctgagtagtaaatgagattcatcttggaaatatgcaaaatttgggagagaattaatcagagtgacaaatgcaaacgatgagtatgctatagagatgtaaagctgctgttcaaaaaggaaggaaggaaggaaggaaaggagggagggaggaaggaaggaaggaaagaaggaaggaaggaaggaaagaaagaaagaaagaaagaaagaaagaaagaaagaaagaaagaaagaaagaaagaaagagaaagaaagaaggaaagaaagaaagaaaacattgtcaaaggtttagtggtagaattagctctcatttcaggagcccttaaagctgggaagaagaggattccaaatgtgcaggaaactgggtctcttatagaagatctgagctacaagttgttcattttgcaaaatgtcagaatctaggagaagtgtgaccaccatgctccaataagttatttcatagacattcttaagctttttggagaacaccaccatttccaagaatttcctctgaatgaagaattagggctcatcttgagttattacaagtataactagcagcacatactcatcagaaatgccaagtcagggtgactgcctagatcctataattttaaactcacttgccattattagtttacatgccaacttttcccaaaaatgaatcaggtcagccacaaagttaaaataatgtcagcaaaaacaattcaaacaattcaagtaaatgattaaagatttataaaaaattatttagcgcaagaggaaagagacataccaggaacctcacatacaatcaccatccaaagttgagtacttaatttagcactggtaatctttttagcatgagatagatgtcatatcctccttgtatgagcacagactgacgtggaagaaaacaagagttcggaaagatttgtctaacaccctatagattcatactggtttcctgtgcttgatgagcactttaataattttatctcttcctctccttttccctcttcctttccactctgctgaattcatattctacattcctctcttatttatcagcctctctgtgtgtttccccggagatatacataatttcactcctgctattctaacacacatggccgctgctctaaaaaaaattcctaatagcaacctgtgcaattcttccagaatactcactctctccgtcttacttatatttttgtgaatatgttggttttgcttggggaaaattttgtttctttgggctcagatcagtacgtagggactgcagtttatagctaactggacaggctgttctctgtaaaacagtagcccaatgctgtgcttattctttggtcaaatggcagaaaagattaaaaacaatgattgttttatcatgtaatgaacttatgggatcttttgagtgattaaaatgagtgaggtggactttattggacttgaaccggcagagtaatttttattaattgtgtagttaagctcttttgcttgattatttgtaattatgcataaccaacacatccttattttgaatgtttattcatgcaaatggatacacctttagtgaaaagctctacaaagtagtatagccctctttcttcatttagatacgtttgataatcaggggatatatttgttataaaaattgattaggtggccagcaaagagtcttatatctatcttggtttataactttttacctataagttctgtgtaatatgcatgttttacctataagttctgtataatatgcatgttctactctggtatctgaaaatagcttataaaattagaactatcgaaacagacaagctggaataataatgacctgtgtgctggcatgcactttgccttctttgacagcacttggtaagtgctatataaatgttagcatttattgtttttacttaaacttttcacattaaatctgtgaggtaggcatggttagccccatttgccagtgaagcaaagtgaggaccaaggttatatagtttctctatggcaagtgtaacaaattaccaaaaactgggtaacttaaaataacagaaatttgtcacctcctagttttgaaggttagaagtccaaaatcaaggtgactgtggaactttccagaagcttttggagagaatctttccttgcctcttttagcttctggtagctgctggcagtctttggcttgtggcctcattgctccaatctgtgcctctatcttcacatcgatttcgtctctgtatgttttgtgtgtcttctattcttctccttgtgtctgtccccaaactccctctgcctctctcttataaggatatgggtgattatatttagggtctaccagataactcaggataaatgcatcctctcaagatccttaacttttttttttcatgtactttaagttctgggatacatgtgcagaacatgcaggtttgtcacataggtatacatgtgccatggtggtttgctgcacccatcaacctgtcatttacattaggtatttctcctgatgctctccctccccttgccccccacaccccaacaggcctgagtgtgtgatggccccctccctgtgtccatgtgttctcgttgttcaactcccacttatgagtgagaacatgcagtgtttggttttctcttcctttgttagtttgctgagaatgatggtttccagcttcatccatgtccctgcaaaggacatgaactcattcatttttatggctgcatagtattccatggtgtatatgtaccacattttctttatccaatctaacattaatgggcatttgggctggttccaagtctttcctattgtgaatagtgctgcaataaacatatgtgtgtatgtgtcattatagtagaatgatttataatcctttgggtatatacccagtaatgggattgctgggtcaaatggtatttctggttctagatccttgaggaatcgccacactgtcttccacaatggttgaactaatttacacacccaccaacagtgtaaaagcattcctatttctccacactctctccagcatctgttgtttccttactttttaatgattgccattctaactggtgtgagatggtatctcattgtggttttgatttgcatttctctaatgatcagtgatgattagctttttttcatgtttgttggctgcataaaggtcttcttctgaaaagtgtctgttcctatacttcgcccactttttgatggggttgtttttttttctcaaaacttgtttaagttccttgtagattctggatattagccctttgtcagatggatagattgcaaaatatttctctcattctgtaggttgcctgttcactctgatgatagtttcttgtgctgtgcagaagctttttagttgaattagatcccatttgtcaattttggcttctgttgccattgcttttggtgttttagtcataaagtctttgcccatgcctctgtcctgaatggtattgcctaggttttcttctagggtttttacggttttagttcttatatttcaatctttaatccatcttgagttgatttttgtatacagtttaaggaagggggaccagtttcagttttctgcatatggctagccagttttcccaacaccatttattaaatagggaatcctttccccattgcttgtttttctcatgtttgtcaaagttcagatggttgtagatgtgtggtgttatttctgaggcctctattctgttccattggttatatatctgttttggtaccagtaccatgctgttttagttactgtagccttgtagtatagtttgaagtcaggtagtgtgatgcctccagctttgttccttttgcttaggattgtcttggctatacgggctcttttttggttccatatgaaatttaaagtagttttttctaattctgtgaagaaagtcaatggtagcttgatgggaatagcattgaatctataaattactttgggcagtatggccattttcaggatattaattcttcctatccatgagcatggaatatttttccatttgtgtcctctcttatttctttgagcagtggtttatagttctccttgagtaggtccttcacatcccttgtaagttgtattcctaggtattttattctttttgtagaattgtgaatgggaattcactcatgatttggctctctgtttgtcgattattgatgtatagaaatgcttgtgattttcacacatcgattttgtatcctgagactttgttgaagttgcttatcaacttaagaagattttgggctgagatgatagggttttctaaatatgaagccatgtcatttgcaaacagagataatttgacttcctctcttcctatttggatacactttatttctttctcttgcctgattgccctggccagaaattccaacactatgttgaataggagtggtgagagagggcatccttgtcttgtgccaattttcaaagggaatgcttccagcttttgcccattcagtatgatattgtctgtggttttgtcataaatagctcttattatcttgaggtatgttccattaatacctagtttattgagtgtttttagcatgaagcagtgttgaattttatcaaaggccttttctgcatctatggagataaccatgtggtttttgtcattggttctgtttatgtgatggatcctgtttattgttttgcgtgtgttgaactagccttgcatcccagggatgaagccgacttgatcgtggtggataagctttttgatgtgctgctggattcggtttgccagcattttattgaggatttttgcatcgatgttcgtgagggatattggcctgaaattttctttttttgttgtgtctctgccaggtttttgaatcaggatgatgacggtgtcatagaatgagttagggaggagtccttttttttctgttgtttggaatgatttcagaaggaatggtaccagctcctctttgtacctctggtggaattgggctgtgaatctgtctggtcctgggctttttattttttaattttttggttggtagtctattaattactgtctcaatttcagaatttgttattggtctattcagggattcagtttcttcctggtttatgtgtccaggaacttattcatttcttctagattttctagtttatttgcgtagagggttttatagtattctctgatgatagtttttatttcagtgggatcagtggtgatctcccctttatcgttttttattgtgttgatttgattcttctctcttttcttctttattagtctggctagtgatctatctattttgttaatcttttcaaaaaaccagctcctgaattcatttatttttttgaagggtttttcgtgtctctatctctttcaattctgctctgatcttagttatttcttgtcttctgctagcttttgaatttgtttgctcttgcctctctagtttttttaattgtgatgtcaattttagatcttcctcactttctcctgtgggcatttagtgctataaatttccctctaaacactgctttagctgtgtcccagagattctggtacattgtgtctttgttctcattggtttcaaaaaacttacttatttctgccttgatattgttatttacccagtcatcattcaggagcaggttgttcagtttccatgtagttgtgcggttttcagtgagtttcttaatcctgagttctaatttgattgcactgtggtctgagagtctgtttgttatgattttcattcttttgcatttgctgaggagtgttttacttctatttatgtggtcgattttagaataagtgctttgtggtgctgacaaaaatgtatgttctgttgatttgaggtagagagttctgtagatgtcaattaggtccacttggtccagagttgagtttaagtcctgaatatccttgttaattctctgtctcattgatctgtctaatattgacagtggggtgttaaagcgtcccactattattgtgtgggagtctaagtctctttgtaggtctctaagaacttgctttatgaatctgggtgctcctgtattgggtgcatatatatttaggatagttagctcttcttgttgcattttttttgctttcaatttgcttgataaatattccttcatccctttattttgagcctatgtgtgtctttgcacgtgagatgggcctcctgaatacagcacaccaatgcgtcttggctctttatccagtttgtcaatctgtgtcttttaattggggcatttagcccgtttacatttaaggttaatattgttatatgtgaatttgatcctgtcgttacgattctagctggttattttgcctattggttggtgcagtttcttcatagtgttgatggtctttacattttggtttgtttttgcagtggctgctaccagtttttcctttccatatttagtgcttccttcaggagctcttgtaaggcaggcctggtggtgacaaaatccctcagcatttgcttgtctgtaaagcattttatttctccttcacttatgaagcttagtttggctggatatgaaattctgggttgaaaatccttttctttaagaatgttgaatattggcccccactctcttctggcttttagggtttctgcagagagatctgctgttaatcgaataggcttccctttgtgggtaacccaacctttctctctggctgcccttaacattttttccttcatttcaaccttggtgaatctgatgattatgtatcttggggttgctcttctcaaggagtatcttagcagtgttctctgtatttcctgaatttgaatgttggcctgtctttgtaggttggggaggttctcctggataatatcctgaagtgtgttttccaacttggttccattctctcctgcactttcaggtacatcaatcaaacgtccgtttggtcttttcacatagttccatatttcttggaggctttgttcattacttttcattattttttctctaatcttgtcttcatgctttatttcattaagttgatcttcagtctctgatatcttttcttcagctttatcaatttggctattgatacttgtgaatgcttcacaaagttctcttgctgtgtttttcagctccataaggtcatttatgttcttctctaaaccggttattctagttagcaattcctctaaccttttttcaaggttcttagcttccttgcattaggttagaacatgctcctttagctcggaggagtttgttattacccagcttctgacgcctacttctgtcagttcgtcaaacttattctttgtccagttttgttcccttgctggcgaggagttgtgatcctttggaagagaagaggcattctggtttttggaattttcagccattttgcactggtttttcctcattcttcatggatttatctaccttcagtctttgctgttggtgaacttcggatggagtttttgcatggtcatcctttttgtggatgttgatgctattgctttctgtttgttagttttcttctaacaggcccctcttctgaagatctgctggagtttgctggggttttccgccagactctgtttgcctgggtatcaccagcggaggcttcagaacagcaaagattgctgcccgttccttcctctggaagcttcgtcccagaagggcacccgccagattccagctggagctctcctgtatgaggtgtctgtcaactcctgctgggaggtgtcagggacccacttgaggaggcagtctgtcccttagcagagctctaacgctgtgctgggagatccactgctctcttcagagcctgcaggcaggaacgtttaagtctgctgaagctgcgcccacagctgccccttctcccagttgctctgtcccagggagatgggagttttatatataaacccctgattggggcttttgcctttcttttagagatcccctgcccagagaggaggaatgtaaataggcagtctgactataccggctttgtggtgctatggtgggctctgcccagtccaaactttgtggtggctttgtttacactgtgagaggaaaactgcctactcagtcctcagtaatggcatcccaggtcgacttcagactgctgtgctggggcagtgagaatttcaagccagtggatcttagcttgctgagatccatgggggtgggatccactgagcaagaccacttggctccctggcttcagccttctttccaggggagtgaatggttctgtctcgctggcattccaggtgccactgggatatgaagaaaaagctcctgcagctagctcggtgtctgcccagatggccacccagttttgtgcttgaaacccagggcccttgtggtgtaggcacccgagggaatctcctggtctgtgggttgcaaagaccatgggaaaagcatagtatctgggctggatagcaccgcccctcacagcttcctttagttaggggagggagttccctgaccccttgcacttccaggatgaggcgacgccccatcctgcttctgctcgccatccttgggctgcacccactgtctaaccagtcccaatgagatgaactgggtacctcagttggaaatgcagaaatcacctgccttctgcattggtctcgctgggagctgcagaccagagctgttcctatttggacatcttgcctggggagtctttaagatcctcaatcacattttttccatataaagtaatataagttaatgttcacagattccagggatttgacgtggacatatcttttgggaaccattttctgatcttccacaaaggatatccaaccaataagtgacagagctgagatgattaactgaaatttaggtatcttgatagacaagcctgtgttcttctaatcctgtagcaaactacccctatctctgctctagaataaatttggagaccagtcaatgttacgtctacattttggaagttaggaactgagtccccaaaaggagagatgttttgatatctggttaagaaatattaataacaaacaaaaagacaaatcagattcacagttaatatagcaggatggtttttcccatttctctttaaggaattaaggattttgcttggtatattttattttaaagacttctggatattgtttggattaaactaagctaaaaataatattttattttattatgcattttagtgagcttattatcagtaatatgtttagcataaaatttattagtgacatgccctttaatttagcctaattggtactaatttagttagattgcattaaattacaccatttaatgtagttatacgtgggtcaagaaatttatttcaagaacttgggtaatgtttcatgaaactgaacagtaaaaaacggcatctaggtggctgaaaaatgcaatgttccaaaataatagttttcctgaagtcttgttagaaaggcacacagatcttgtcttccatctctactcattttcccaatctgtaaaaattagctaaagtataaatcaggaaaaggggactgacgctcataaggatactggaatctttacagacgatccttgctccagccttcatttctgattcactgtgttagggagcaaataacattgaaaaagagaaagaggctgttttctatcctcaatctttatgtcttcctttttggattttgttggttaggtgatggaagtatgatgctattgatatttccccctcggtggtataaagaaaaaagccaatttatgttcagaaaacacatacacaaaaacaaaacactttgccaatgtgaagcctgagccattttctcagactctgctttaaccaccatgaaccaccaagaggtttgggtgaggttttatgaagacataaagatcaaggatgggaaacaaccattttttttttatttttttgatgttatttgttacttaacatagcaaatcagaaatgaaggctgggaaaaggtttatttgtaaagattccggtacacttacaagtgttaatctccttttcctgacttgtattttagttagtttttacaggttgggaaaataagcggagattgtctttcaggggatctttccttgcccacttgttcctctcatttctgttaactctgtcagttccaaacatctcctatagacaactaaatggttgctgtaacactactggagctcattctagaacttaataaccatcccaagatatgatttttttttagcttgtctctagaaggaagcattgccttggtcttgaggggaggtggatctgcaataatcctaatttgacccataggtggctttttctgcagtttgccttcagatagctaacaaatgagggcagacttgcagaagtatagacagatttgacagagacagaacacttctcttaaggggacctgtgagagtacaggtgaaccaagcatcagattctacaggccttttgaactaagggggcatcacacagtattagcagtagccctgggtctctccatgtgtttgcagcacaattgagctgctgcctctcctccttagctttctatagttctgggagcaaatgccccacagcccaactggttttgccattttgcaagttagaaactcaagccttcagtgaatttcctctccagtggctgaggagataccaacatggctagggggtgacaggagttcagagtagattaaggaaacttccctaatgccagagaacttggaaggtgtgccagccattgctgtcaatgtccaacaatgctgccacccctaagcagacaggctgtgagtaccacctggttactgccactgcctttttgggtctcttccttgccagaggcagctgaggtaatgtctttgttcagcccctagtgctgagctcttgtgttactgaacccacgactcaagaaaaatgggacttaattaggaaaagctgcagggagccatcaaagtgtcagcagcattttgaaggagagacaagaggaagttggggatactctggagtcggaaaggccaaaggatagtgtacaggctggcagcattatggcaggggtgcctgtgttggcaaaaccccagggctgaataccttgatgaggtgaagcgttccccagtacctaatgctacggtgcattaaggatgagatagttctcactgagtactgttccttgtaataataaaattaatttgaccatttggaacaagatttataatgggcctcatccaagcctctaaatatgcatattccactttggaactgtacataattgctcaattgcacctgcaaatcatgttgttcgctcactaattattcaaatagtgggggcaattccacaattgtgtatgtaattgtgttaattgttaatgcagttaggtacaggtgcaccgtgactaattacacatgcagaagcggctcccaaacggctcactgtctccatgcacgggctgcccctctcggagacagacataagtgggtgacacaaacaaagccataggccatcagtgggggtccatctggcaagcctttcacttgggagccgcatatacatttgggaaacaatcaggtctttgactgaattcagctgtttttgctttcgcttctcttgctcccccccttcccccaaggcagtgagaggcttggggcaccgggctcctgagcttgtgtgagtatgtgtgtacgcatgcgcatgcacatatacacagagtcacacagaaactagtttgtagggctcgctctactcatctttttgctgatagttcccttgcctgatgagattagcttttagtcctggattttattactatctttctctgtcatccatatggtttcaggaatcaagtttatctgtacccagtatcaggatattaatgccattttcagggtaagagatgcagcctgggaggtgaaatttaggtgatttctgggacattcttatggcttatgtcaatgggaccagaatagggactgctgccacatttatactttacctatttcctcatttcttcacccaggtcggcctcattttgtggcttggtgcacagcattagtaacagccttcctggctacaagacatgtctgaaaactggtgaagtagctcttctgtgtctgtgggtcaggggctggttgcatatctcatgctgtggaaggtatgctatagatatgttccccaaattttaagactgacttctagcagccatcaacatgtacttattgttttgactttgtgctctgtaagcctagctctgaggaactggctctctcataagaataccctccctgctataaggaaggcaggtcagctgtaaaaaattaattagcactggcttggaagctcaatgccaaaaggaaaataagccacacttaagacaaatcagtctgtgactaaaaaaggagaatattttgagggagcactgaagttacgagtaagggaatccacgcaaattggcctcatacaggtagaagcaattcactctgcatcactgttggacaaggaacagaattgactcacttcgtacccaggtctctgtcccagcaaggtgcccaatgtaacatagggataatgtagaactcacatcacaggatcgttgtgaatgttaaatgagataatctttgtagggcacttagcaccatgcctagcccatattaagtatttagtaaatgtgactgtatcattactgtcattattgttattgctgtaattatttctactgttgtccttttactcaataaatatggaaaattaaccctgcactgctgttgcctccccaccccaccctggccagtcattaactctgccctcctgccattgagtattgttcatgccttcctcttctcattttctatagtctgccttgtagtacaggcattcatgtatttgtcttcacccactaactaggctatatgactgaattaatttgctagggctgccataacaaagtaccacaacttgggtggcttaaacaacagaacttcattgcctcacagcctggaggctagaattccaaggtcaagcttttggcagtgttagtatcttcggaggactgtgagagaaaatcagatccagatctctcgttggcttgtagatcgccatcttatccattcttgtgtccgcatatccccttccctctatgcgtatctttgtatacatttctacattttataaggccaccagttatattggattaggtcccagcctagtgaaatcattttaactttattacctcagtaaaggccctataactaaagaaggtcacactgtgaggtactgggggttaggaattcaacatgaactttgggggaactcaactgaacccaaacaatcaccatcaacaatatagtctgcattttatttgtgtttgaaactcctacaatgatgtccagtacagtgcctggactatatttgaagaagcaatgggcctgatgtggtagaagttgacaggcctgggttctaatctcttttctccccacccacggaccagttagccagtctgagtctaattctctatctaaatgtgaggctcctcattcctaccttaatgggagtaataagcactaatgattatatacatgcaaagtacctgcacatattagatgctcagtaaagttagttattactcaaatttttgctgagtaaactaacgaacaaataatgtctgtaggagtgattgaaacctacatatctagtcacaactgttggccagaattaagtttttaacatctttcttaagttggcctctttttcatttcctttcatggttttttacctagtccgtgtgtaatggaaagaaattaatgcactggtttggaatggtgtgagcagccagccaactttatgaaccaattttgtgaggaacaatcaacattgcggctgtgtgtgtgtgtgtgtgtatgtgtgtgtatacatacgtttatttggacagtccaagttgcctttttaggtgtgatatttaatttgtgaattggaaaatccagtttatcacttcaaattaaaatttgtctattaaacttcagaaatgtatgtaatttgtaagaaaatattcccaatgacaacactatatctaaggccatgatgtccagtagttaggaaacagaaaataggcacttgtccagaaacgaggagaattcaaagttcacattgacattgttcttcattatagtttcagttcagtaacacaagagtgtcaaaatcaaatccaatttccttttgcctgctcgtctcaacattgcaacagtggcttaatgtgcattatttgctacttggttgacatagatgggaaaatcagtaacaccaaacagccaacctcataatcactgattttttcacactgtgtcagttgcagtaaatcacagagatatagatacgtatatttgtcatgttgaaggtgattaaaagatgttgaatctgtaatcactacaatgaaagagattgtcatcaataaaaagactctagagcaagggagttatattgatctgagcacaggaatttgcaaactctctttctcagtatcttgcccttccagaactgtaaaagatacagtagcacattttgtggaagaaggttcatattttagttcagagcacttttttcattttcagcttccaggtcctaatgtggaccttctcagtggatggctacattgtcattcatgttatctaaaagttgatctatatctccctactaagctcagcttccatgcatttggctgcacatcctaactgggttaggcatcatggaaaaatcatttggaggagagagggagctatagagactgtttattttcattcagaattatccactggctgcaattggtttcatactaattctataaagcagtatagaattgtgagtaaaaatgcatactaaacaacttaatgcaataaaaatgaagcaagaacactgtacttacattaagttttctcttttcagcagttacatagagccacgtatcaagaacatatgtctgtgtgggcccccattaatataaaatttgcattattgcaggtcagagggtccatcgctatttatattggggcctaagccaacattatgtgtgccaagtctgtgcaccttcccactgtcctgcctctgttctcaccaccctcttctttatgcttgggtggtcatattttgaaatttccccaggaccagtttatcatgcagtcacgtttctcatcacatctgaaggatgttgtgcttcgcatggtaatgaggccctctttgtttcagctgctgcactgctctcagtaactcccatcagttcctgcagtctgagggctagtgctgtgatggtagcgtgtggagggtctctcagggaaaacagcttgcttattacttggttgggttttctaaaacagatttaaatcagtttcaggttttaagctgttatgtttactctggttttttaatgcatgaaaacaatttatgagcatcagttgcaagccttgggtggttatgtttgtccagattattgtgcccatgtatacaactcactgcatattttcaaaagaggctgaaccaagttaccgacactcacttgaacatgttctaaataaagaaatgacactcctggatggcattaatttatttacggatctattaactgtgatagtgtatttctcaccagaattgctgaagaatattattttctgtcttctttcaaagtgattattatttggtttcaaattgctttaaattgcatccaaagaacatgtttcctccatagagatatagtctgtcaattttataaaatatgtgcccatgccttatctcagctaattaagcatctagtcctgcaattcttatctagacccaaggaaattatgagaatttgatgcagtaaaaggatgacaggattgagtttgttttcccattagctgattataccacgattccaacaaaatctatgtcccctgaatttggacagaaatactgcctattaccaaagataatgatttcactgaaaaactctctgagatcttatgaatcacacttgtaaactcatataacatagaagccagaatagaccaaatacactagagagggaatcaggacccttcatttcatagtgaggagactttagcccagagagcataggtgattcaccaaaggcacacaactaggtaaattaaacttgatttaaaaaatggaccctaactgccagaataaatagagaggtatggtccctgtaatatattttgaggctgtcaaaggttgccttgacagaatggagaatgcttgacaggccaacatttaccaagtgttcttaatgaaggaataccatgttcccctgaaaggaatcatcaattgtagagtattataaaatgactttctcttggcattgttaatcggtataatcaatacattttatctcaatttacagtcttacacatctgggaggggtgcaaaacctggaatacctgcttttccagccttttcaattcataggtgaagaacctgacagagatctaaagagggggaagtataaccaggatattctgacctcagctgctgggctctttattatgggtcacccctcttctttcacagtaaacctcccatttaaaaaatggcccattatgagatttacttattgtccaacttagcactctgaaaacagagagctgtaagaataagtccattgatatgttgaattgcccaaacagtggtactggttgtcaaatggttagcttggccttgctggtcagaacggcaattattaaaaagtcaagaaataacagttgctggtcaggttgtggagaaattagaacgctttaatactgtttaatactgttggtgggaatgtgtattttttcaaccattgtagaagacagtgtggtgattcctcaaagatctagaacaagaaataccatttgacccagcaattccattactgggtatataaccaaatgaatataaatcattctattacaaagatacatgtacatgtatgttcattgcagcactattcacaatagcaaagacatggaatcaacccaaatgcccatcaatgatagactggataaagaaagtgtggtatgtatacaccatggaatactatgtagccataaaaagaaatgagataatgtcctttgcagggacatggatggagttggaagccattatcctctgcaaagtaacacaggaacagaaaaccaaacactgcatgttcttacttataaatgggagctgaacaatgagaacatatggacacagggaggggaacaacactcactggggcctgttgggggtggggttgggggagggagaccattaggaaaaatagctaatgcatgctgagtttaatacctaggtgatgggttgataggtgcaaaaaatcaccatggcacatgtttacctatgtaacaaacctgcacatcctgaacatgtaccccagaacttaaaataaaaataaaaagattgagggagcattttaaaggagaccaaattgcaaggtctatgcactttgaaagctttgggagataatactggaaagagcaggttttctctcattagagctaaatggaaccaaccaaccagtagttagtccattagacagaactcgtgagaaatgcagcttttgaaaaattaagctttaaaattcccataaggaggacccattttaccattaaattgtcaattgcaggtcaatacatattattctatgtatactctcacatagactttcacatatgcagagagaaacactaaagttgctatattagtctgttctcatgctgctaataaagacataccccaaactgggtaatttataaaggaaagaggtttaattgactcacagcaccacatggctggagaggcctcacaatcatgatggaaggtgaatgaggagcaaagtcacatctaacatggtggcaggcaagagcatgtacaggggaactccccgttataaaaccatcagatctcatgagacttattcactgccatgggaacagcacagaaaagacctgtcccccatgattaaattaactcccaccaggtccctcccatgacatgtgggaattatgggagctacaattcaagaagaaatgtgggtgggcacacagccaaaccatatcagttgcaaattcagaaatccatagcaggtcaattaattgttttaaaacttccgctcttgaattacttgtctttattcaacagcctcaagataatcttagcttctcatttgatttaatctgttatgcaaaaaatagcacgaagtcctcttatggctgttttaatcagttgctttttgagattttataaaatagccaattgagctccacattgtattttttgtatgattaatttgaagtgattgtattggccatagtggttatgaatgcaaggaaataataatcttatcttgcttatgttactgagccgggtgtatataactttatgctcatcagagcaatggacaaattgggctcatcgaactgcaacttacattttcatgatcattccattgtattatattggtacaacaaaggaattttgcaaaataaaaataatgaaacatcttatatttcagtagtggctactagatttatatatacatataaatataaattcctatttgataatatagttgggaaccagtttttttgtacagtgattaagaacatgggtttgaagtcttacagacatggttttgtttcttggctttatcacatattaactgtggaaccttgggaaaattactgagcctctatgaacctcactttcatcatctacaccatggcgacaataatgcctgtagcttagagttgtcatgtagaataagcaagttaaaggataggcctggtacacctaaatgctcaaaaagcatgtcctataaaaataaccatttatatacaaaaattagccgggcatggtggcacatgcctgtaatcccagatattcaggaggctgaggcaggagaattgcttgaactcaggaggcggagattgcagtgagccgagagcgtgccactgcactccagcctgggcgataagagcgagactccgtctccaaaaaataaaaataatatataaccattcttatgactgttttaacacaaaagtgataacaaagggccttgctgacacaagttattttcatttttgtaccttacctttaactcagtatactattaatcattcagttgggaaaatagttatgtaaaatggcagtgctaagagggtctttatatagaattctgtgtgccctggaggcatttgtgaaaaagtgttttctctaggatggactaagcctgaaggttactgttaggctatgatttggctgatggcatataccacaatgcctaattagggaaccccattgaaagcgatcattttctctttgatgtggcctttccatttaaaggttgaatattagggttacatgaatgaaactagacaaaaaaagaaagaaagaagacaggaaatttcctacactttcagaaacacagctcacagacaaccttaggaaggaggcatgcctgggtcctttacaggagtggggcatttgcagctgctctaatgtatatctccccagaaattaataagtactattattttctgcacttaaatcataacttacaaaataggtttattcatccaactttctcttctcaatacttccaaattgctagcattatattttctcatctccttgttttgaacatggctatgacctcctacacactagctaacctcacctctacagctaaagattctaaggaggagctgcagccctttgcctaacataacatacctggcactaggcaaagctgtattctgacttctggatggtccagtctttggcagggtgggtgggggagggcagggcctacactgctgggtaactggagagcaagtgcatcaaaaaggtgcccacagactttgcctcccttttatgtaacttctgttcttgctttcacactgcttttttggacatctttttgtcacagctttaacaattaccccatcatcacagtatttagaattttttgaagagatactatgttttcagaagatactgttttcagaagtaaggtggggcacaactcctctcctctcctccacccctgctgcttcccaagagaatacagaagagactttgtaggacttccaatagaagaagctcgattagagcttcttgagttgctgaattaaatcgtaatcaattcaatggaaccaaatggaatcatgaagtaacaaatcccctgtcatgagagtcatgtcagcagtacttgtatgatatgatgacaggacttggattgatcagatggtttaaggttaatcccataccttccattcacatggttatgtgaccttgggcaaatcatttcacctctgtgcactgtatttgtcctcatctttaaaatgggacagaaggtagaaggctggagtatataatccccggggccttttctctgtcaggagcctgtataggagatgagagtatccactcatttctggacaagcaactcaaaagtattccattgagaatgaacaagcaacattagctttgcatgtgaatgatggcacatttattatcagatttatttcatgtattacctgtccttcccctccctgtcttccaacagatttagtagatctcagtcagttttaatgctttcggcctctgctgcacctgtagtaactgtctgccagaggcagccctttttcaaagtccctatcttactgtaagtaaaccagaatttctaaagatggaagggttgcccctgccaactctatttcactgtttctctatttcttgaaaggagcaatgaaagggagatggtatcccatgttgaataagcaagtgtctgccttcattccagccttgtcatggctccagtaagctcatttcatcacaaatttatgactcctaaaatcaatattgactgtggatgttggggggaggacaattttgagggcacatctgaattaccagtgaacccataggaattcccttcagttgggtgaaaaatgatcaagaaacaaaagctaaaggaggagtcaaggagtacagcatcaaggtgctgaactcattgttaaacctgagtccttagtgcttagcaactctgaagtcctggatggaggaaagacttggtctgtttgtgataacagcaggtgctttccaaggtacagactgtctgagtcattgtagaggcaacattctctcaagatcttcttcactttcaagttttcaacatgccattttgcaggttcctttttagactatcagtattttgcctttgatgttgatggtcagcttggaatttgtaataacattatttaccatataacagggataaataatctttcatcttgcagaggcaggggtggggggttcatggcagtttatcaaattgtctcctggattgctatggctctagtgggaactacatggataaatctatgttaaacaacagcagcatgaaatagtggaagaaacactggattgtttagccaaaaacccaggggctagtctccaccacctctgactagccataaaacttcagacaaatcatgcaaccttttgaagcctcgcttctttttcatcttaaaaaatgaaactcattttatcttatttgtctacttcagaagattgttgtaagcaacaaatgatactgggagggggataacagatggagacgatgtgaaaggactttgtaacctggcaaggactctaaatttccaaggaatgatttctattagcgatggtcttagtagcagtaattgaagatattctttatatcatcctcatatataaattccctcattcccctttgttttcatatgccaccagggttctgttcttaaagttttgaattaaggggtaaatatcttcactttaaggatttaggagatgtctctcatggggttagattatcatttataaagaactgaaactgaggatctggaaaatgctaattgtaaagcttatcattacagagtagatgttagatgctgccctgaaactttgtagcatcctgataaggtataatgctttccttttcagcatagattgcaaaatgaagggtaaaacatttagaaattaataaagcatatttataaaaaatatacctggccatgctcagtagatcatgcttgtaatcccagcactttgggaggctaaggctggcagatcacgaggtcaggagatcaagaccatgctggctaacacggtgaaaccctgactctactaataatacaaaaaaattagccaggtgtggtgacatgcgcctgtagtcccagctactcgggaggttgaggcaggagaaccgcttgaacccaggtggtggaggttgcagtgagccgagatcccgccattgcactccaacctgggcgacagagtgagactgtctcaaaaaaaaaaaaaaaaaaaaaaaaaaaaaaaaatatatatatatatatatatatatatatatatatatatatacacacctaagtgtcagactagataatttcaagattagtgtgatcataataaatttttatttaccaaataccctcagcctagagcttttcaggtaaccaattaaatgcacactaagtattactaattgcattatttaaattggtatactattttaggtttagaaggtccctcttcttcatgataatgcattttcatgaagaaagaccttaaagctgattctaagatcttcaaataacacatcatagtgtagtatatgttggtgagtttatttatcttgagttgggagcttttatagattccagctatatgtcttcaccacaaatcttgttgttgttgttgtttttgtgctgatggcatgagtgagaataaatggaatttgtggagtctgtgaaggccactggagggaaatttcccaatctcctaatatatcagtgtctcttcctgtctgtttctgatggggtcctacagcaggtcaacatccttaggtaaagaaaagcttcctaagagttagcagcagtcattgaaagtaaattaatgaaaccctgcatctgctgatctatttgacaagaagaaattctggctgccaacagttagaaaccactagaaataatctccattggaaaccgggcttcgactttctgccctgggctgcccaaagtattgcattagacaatgcgaaagtaagttgaactttgaattataatttcaatgactgtctagcgaaatggattcatgctctgacactgcacctttgaggctgtgggttggttcacataagataaaaatctgtctggcctgacagttgaaaaggtcgcaagaacgcttgatgtctgatggtctcagtgtattgccaaatcttgattaaaatggaagacttaggaacaattatgtttttttctttcaaaataatcttttcaaacagagccatttctacatgttttggcttgaaatttattgacttagcaaagtatcgattatattttcactaccatttagcaataacctcatacttaacatgaagctctcacatagttgagatactttggccttggggcaacaggttatttttgaaaatgacatctaattgtcattgtagtatgtttggtattaaaaattgaactatctacattttaatgcttccactttagctctaaagcacgttgcctgtcgtctgttttcgttatgaaaatacttgcaggaatggcttaacatttttacttctgtagatcatgcaggctctgtacctgtgaaatgtgtagcttttaattttagattagagacttctactagctagagattaacacaagttgaatctttcaaattaatctgcttttgggccacagattgacagacttaacagacacgagtcaccttaaagactggattctaagccaacccgcttgttttacatctgggaaaactgtgacttgcccaaagtcatacagtttgtcactgaaccaatagagtttcttcaagacagtcagttcaagtatattaaacagtatctcatgaagtgctaaaggaatcctgagggcagggacaaagtgttacatatagatgtccaccatactcagaggaactctgttcagattaatctaccacattttctgttcttagccaattacatttcactatgccaaaaataaagtactttcaggaaactactttctgtcttttccaaatgccaaagtcactctctatctgaattttttctcttattcaaagttaaggtcctgtcttacttccttgcttgaccaccagatccatggacagtttttcctttcgtgactttctattaaagttattgtcagagccatgaatctggctttttaaaatatgatcaccacataaactggatttccaggatagccctgatttcaattcattctccccataaattggtattctagaaattcccatatttggccatgtaaatcacgtcatgcaagctgactttggtacccactgaaagaaaattttttttctgccaatgtgcctcatttagggatcaaaaaaagatatctgctaacatgcactgtaattcctcactttagatatgcaggtcttgtctactcgtctatagtataccctccctgtcttagtctgtcttgtgcttctataacagaatacctgagactgggtaatttataatgaacagaaatttattggctcacagttttagaaattgagaagtccaatatcaagatgtcagcatctggcacaggccttctttctgcattataacatggtagaaggcatcacatggaagaagttggaggttggggagagagagagagagagtgagagagacagagagagaagcagaaacaaaagagtgccaaacttgtcattttatcaggaacccactcccatgataatgacattaatttattcatgagggcagagcccccatagcctaatcaaccctaagggccccacctctgaatactgttacagtggcaattaaatttcaacatgacgttttgaaaggacaaacattcaagccatagcactccctgtggacagccattgtttatcatgtactgcattttacctaatgcttagcttagtgcactgtgcatactgagggtgcaatgcatatttgtcatttgggattatttcctttacatgaacagattttccaaacgccaaatttagaagtactgcaacacattaattctggtcaagagtaggtctggttagttcattaagagtttattttatcagtaatgtgttgtgcttgtacctgaaattataaatgcctgccaggtatctgtttatcctacatacttccacaactcagaaataatcaataccttgttttcttgtggatgcgagaaaagttaggatcactgatgctgggtatatgctgtccacgttaattggcatagaccgttaggcttcataaaccatggtacaccatgtatcactccttctttgatcttcagcataaaattcaatgggcttgagatgctccacagagctggcccacatttaatgtcacagaccctttatgacacacactatgtctatttcaggggtcagtttttgcagagtgattttctggaaaagtgccatgcccttccatgagccaagaatttcagtgtctcataaatggtggacagacaggaccttggggccatctctccagctaacagaagatactaagtaaggcccaggggaagtttaagaaacaaacttcttgtgtttgttctattgattttcttgccaacaagaagtgtaacaaattgtgatgtttccaaataaaaagcatcaggaataagctccaattttattgagtgatttcctggacacacatgcaggtgcattttggaagaggctggatatagtcagacacaggtaacaaagccaggtcacttaacaaagcaggaaagataagggccacggttgcaaatcattatttataatcaaacaaaatggtaattttgccaacactcccttctcaaatataagatcatcatcatggtaatcaaactattactctgacacagtttacttatcaggagaacaatctgagattgatgacctgaaaatggaggttgtctttcaattcatttgaaatgcaaaccgagtggacaacctatacctactgtggcatatttttaaagcaaaatcaggcacctacattgacctcctatttacatttctttgagaagaaaagaaaatcacataaaagctatcaagaaacacatttcacagcaggcaaattaattggttttacagtatttgaatggagggtttgtcaaataaaacatgccatgacagttaatagtgtcatttagagccagaaaattattggcttatttgttattggataaaaggaaggcaaacattttgtattagaaagttttaatgtgtttaaaatcctcattagggattaatggacatgcttgcttagcatagcgcctcattaatttgaggctaaacagttacttctgtgtttcaatctcagtgttgtttcttaacattttttttttacttctctttaattagatcttgcatttgagtttggtctctacaccattggagatgtagatttaattaatgagatttataaatctaatgaaagtgagttattcttagctatcgtttcattttagtgagcagttaaaccacatgtaagtgggcgcagatctaagagatttcagaagtacagaaaaaatgtgaacttccctgaatatatttagctgtgtcacttggcattaatagataaaagtgttttaattagagtcataaataataggggagctggcgaggattcagttcccatgcacatggcttgttctttaggatcatcactgtcaaagaagagcaattgtaactctgtttctgtggaatttcagtgtcatccactggcaattaagacaatcctaagtgcggagtatagagagtcaataaggcgccaagttcgttagaggttagtacaaaagtagagccactttctatcaagtgtattctgttgtcactgttttattgagggcatctgtgggtacgatttataaagtctattccatttacattgctttaagaggaatttagttaaaggaaaaactgatatctgagtttttggttttcaaaaagacgtttaaatcattagttatttatttgtaagaagaccattgtagtttctttagggcgagggattgtgaatgtcaaggtaagtccttttttttctaaaagattttcaaaaaataagagccaaaggtacatatttaaaagcttcttttttaaacggggttatggaacttaatttaagaccccataatatacctgtggcaatgccttcagaaattaccagaaaaaactgaactcccactttttttttcccatgaggaagtccttgtatcttagacactgtaaatgatttgaagaacttgtcagtccaagacacataaaagataatcgtattttaaaatactacatgatagcaatcacatattaaatgtgtaaaatgcttgcttgaatacaaaatatttcaatgattaaaaatagctcttctttaaacaattcagaaactccgtctaatgttctaaaggaatgatttctctcaggaggatatgagttaatcgagttctctgtgctcccaaagagacagagtagcattcagttaggcccaggggagatcctcaagccttggggcttaaatttggccctgggcttaatttcatctggccttctggataatattacaggagtcactacggtggagtcctggtcattagtcctactcctgcgctttctgcttattgcagtcagaatgaagcctcttctagattagagcatttggagaactgtgaactatggttaattaatcagtgttggaaaaagcagaagctaacagtgaggagcagtgtcaccttcttccaaatcatcagagctacttggcctccaactcccttctttctccccgcctccttatcccttctattatacttccctagcaagtctatgatccatgtttctgttttcgaagacaactattccaacctttcttttctcttccaatttccagtaaccacaccccactctcagctgatgatcttgccgcatacttcatagagaaaaataagatacaatcagacaagtaccatgtcatcttctcatctttaatttctccaacccagctgcttatgtacctaggcactctgccttccctcctgttacaatggaagaagtgtacagaagtgtccatgttcctatttcaggccaacctcttcagttgtgtcttgatcgactccctccttatcaaggactttgcttttacaatcatccagtttctcttttgccacactttttccctcttcactgagttctacgcatcaagtatataaatatatcttaatatcatccctcttataaaaacaaaaccaaacaaaaaccttgactccacatcaccactttatattatttcatttctccacctcctttcacagtaggaattgtttattcactctctccacctctgccccttccactctctcctcaatacacaatcaggtttacatccccaccatgctgctgaaacagctatgatcgaggatacaaatcacctagatattgctaaagccaatggcctattctgcagcctcatccttatttaatgaccagtttttcctggaagcactttttcttctaggctattgtgaccccatgcttgcttccatacacactttaagaattcatttttggctttggaatacatgacatgtcatagataatatgctatgctatgcggagtgtggcctcctggcaaaaggactactacatatagcaaaatacataaaataggaaagaataaagcagagtgttaataaaatcgtagaatccaaaagatgtgtgaaagatcgcataacccggtgaccagcccaaagtgaaagtgttgttattctgtggcaacataagaaaagtaagataatgatgtgtgtgtgtgtgtgccagtatgtttgatgttagcataaatttaactgttctgtattttgaacaaactggcctttattctgagattatgccttattaaccttttggatgttataatgttcttttacaaaataatagtgccaatggtggattttgttttgtaatgcccttattgataaaagaaaaagttagtaatcttatacatatccctcattatttttgtactgttatgtgaaatacaaaacactgggtactcggaatatattctcatgccttcactgtataggctgtttaggctgcaggctggcgagtgaagaagtgaattgtcccaaattacacagctaattagtggtggagcttggacacataactactgtttcctgtcaggttttttcgctactttataagatttgttacctgaaagtgagatcactgctttgtaattgtttactttctctatattatgagagtgtgctatgatctttgaagaggtcaagagcatactacaactttaaaaactctaacatttactctttaattgacagaattcaaaggtgaacttgcctcctgatatatcttttttatatatttagataatgtattagttcaatctagtttgtacatctctagttttgcagtcttctcttttattatgagagattattatgcacctgcacacaagacagtcattaccattaatggcagtacactaagtagggattaagtggaatctagattttgatcctaaatggtctttggttgcagtactaggactttgggacagaagtgggtatcctgtaggccctgaggagttggctgcttacctaggaatttcaaaaggaaaggaccagggccagaagatctgaggattgtagggcaggcaccaaaagaagaaagaaggtcaggaagagcataggcaagagagggcaagcaagtggggtcagagtcacggaggctggcaaagagaagtaggagacagcttgagtctgatcccagaatgatggaatcatagcaagaagcctagagactctaagttggagatctgtccctgtggaaccgggctggaagaccctactcagctggggtatgagtctgggtagctgcagcaacagtaaccagaatggcctcactgactagcccaggggacttgagacagggcatccttgagggaatgtgagccaggcagcaaggtgcttccagataggttcttgatttctaacagtaatatttctagatgtttaccttgtttttgtcgaagactgtaatataccctcattccccccatctccttttatagctcacttttctatcgaaactagttattagaccaaataaatgaacagtgagttaatggctattcagagcccactgaattaagtactcttcacttgaaattccatctgccattaggtactctcagctgatgatgggcctttctgcatatgcattccaccgttgcccatacctaatgtaatcactgaagagatgtcctcataatgaagcatgtcacccacccctcctccacccttctcattcccactctcccttatctctgttgtcatatccacttaagtcccatctccagcctcctttttcacctttaatgagagccagcagatggaaaagcagcctgagactctttacacactgggaccctgaataggattcagtaattagcaacattcataagatgtcatgggagccagtttacaaggcaaccaaactatctcctcagtggttccaaggctcagagtgctgacacccttctaaggacttttgagagaacttagcatacaaagtgctgatggagacttaacatgcaccccctactaggctaaggtacttttataaacctcacttcatttcaacatcacaaaaatcctagaagtggatttttaaaactttttcttacataggtagggatacagaggctcaaacaagttcgagtggcttgcccaaggtcataaagcaagttgaacttcagaaataggattgaaatccagttctatggagcctcaaagaccaggctctttccactgccccttggagcccccagaaaacacagtaaattatctcattcatttgctcaaagaaataaaagttcatggttaccttttagttttatgttcatgtatgattccaaacaaagggtcatttcctgtatttggcttaaaaagacatgtgttaaattattttgatcttcatgctctactttttgttctttttgtacttttctggtgcatattaccttgttttacatgaagtattttgaccaggagacttacttaaaaactggccagaagcagtattttaaagtaaacaccagctctttggatgcccaggatttttgctgtattgaaatgaaattggaagatgagctggttagctggaccatgtaactgttgtgaaatcgtttttgttttgattaaagttatattacccgaggacttctgtctacagcttatgcaatattaactgttcccgtttaatcatagactcatgaatacaaactagaatagggacggttaaggtgaggcaggaagcaagggacagacagatcctaatgtgaactgagtttgtagttttccaaattcattttggaaaactgggactccctggatagagacataggggatttcataatgcatgcaaataagaacttcagaggctgctgtcctctgtttttacaaattaccaacgatgggaattacaaattttaaaaagattgaaaactcatttggtagtacagtatcataacctgagtttttattttattagtaattctgcatcaggggacttctgtgtaccataaatcaatcatggggataaatggggaagtttgttaatgaaagtacaaacggaattagtttggaagccgccatcagtgtctgttgtggatattggttaactgggcccagttatttaatttgcaattaaacttttgatttttaagttttactttgagaaagtgtttgtcaaggtggaatatgcctagactagtggactatgattgccagctttgtgggaccgccctcaggatgattttatgggaaaaaatgacctgtcttctctcacaatcccttggtaataatatactcagaggcatgcattgagctcctctggattaaccatgtgttgatcattattctattaatgttttacgttaatctccatgttttctattagtgatggctgctgcttatgtctctcaatgccactatcagggtgtttttgatatcttgtattaccctaatcgctaagaagtatgctccaaactgattaattccagaatgattaaaacatcctatgcaattcatttattgttgctgcagttaattgaatatttgatgatttaaaggtaccctgattatttcataagatatgtatttatcaccaggcagataatttgtgtgtggtctctctgtggctacatggggtggcagcctgcactgtcagatgcagagagggtaggcacttgtgagggttctcagtaaactcaccacctgcctgatgtgcacctcccttccctggccctcagaggaccacatccgtgcccagcacaagagggtcgtctggggccaggagtgagagcacagcctcccctgtgtgtcgtgcagcttgctttctgctccaggaggagggggcggagagggggaatgagaaaggacgctgcagctctgagtggctaacttgcgctttgtggactatctgaatactcaagagtggatttaaagagaggagaaggtgcctcgggaattaagcagcagcttggcaactcaacgggcagcagttctaatcccagtgccaccactagctctctttctcagtctctgtctttcacacctgtccgagtaactcctccagaattactgcgaagacgtgtgggtgtgtgtgagagagaaagagaaagagagtgcaagagaatagcatttggggccgagccccagccttagctcagctttcttccagtgtgcagagtgaccctggtgcatctccgcagggggctcagtgactgaagtggcctcaggtggccccatcacttctcagccatgtcgaatccttggcctctcactcccatatggagcgaggactacggtggggacctcaacggctgggagcttctgtctgacatggcagtgtcggtgaacccggtaggtaccctttccctggcacttaaatcagacctcctgtttggtcttgtctgtttccccgtaaatgttgtctcctcaatttgcatggagtcttgaaggcagaaatgatgctgcctccagtgtctttaaatcctccctcttggcaccatcctgagcacagtgtgagctcaatcaggatttgttgtctaaagaaataaatgggagagctgatgaataggcggacaggcgaatgaatgcgatcctattacccttgtcatgactaccttacaatgtatgtcccagtgggtttctaattgtttgttttcctatcccatctagacatttaactctgagagaaagaacctgagactccgagtgatttgtattaccaactctccatgctttgcactgtgctaggcacgtaggaaatatttgctggttaattaaaaagcacttgcaggaaggaaaagcacttgcggttcaaatgtggttgtcttacggagaaaacagcagtgggcccgggctagatgaatttgcggaactagtaacttcatgagaatgctggattttagtgttttctaaagaaaaatatctaatcactgagtgtgaatgcatatttatttgactgctcttgcctttagagttctctgtctgtcctgagtgctgccgactccaatagtcagtcattattagatgtgctgcaaagctccagagtccacaactctttctcttctgacagtatttcctcccataaagaagtggatatttatatttcaaagagtagagatgatattttcagttggcaagagtgagtcaaatcttagtttgaaaagacgagaagacaggacttaagaaaagtaaggagaacaacaggacaaggggtaataacttaattcattgtattgggctttgcggattacaaagcacattcacatcacttatttcacaggatgctcacagaaaccctgtgagatttaaaaaggatgggtattactattattctttccttttcttttacatttggaaaaactagaactcagaaaggtacagttattaagtcctgttcccaagtggtagggccaggactccttcccaacccttttgactcatcagcaggtgctcttgctgtgtctgcatatcagtgatatattttcactgtgatttaaaaattaacactgatgtgtttgcgtgggaaaaggcgaacaaagaccttttcatgagactgggccatacatttttagcctaggctgcccactctaatacaatacaacaatgatattgaagatttaagcctttcttataatcctttgacctttgtatttggggaatgtatttgttagaagttcaagaactctcttggaaaatacagttgctgcagcactgaacaatggagtgggattgtatttgcagttgagaattaccagtttagttgtataatcatataaacatgttagaccagcatcttccagtatatattctgcaaacattcattgtgtggaataacagtagttattaattggaaaataaaacaagcaaacaaacaatcaaacaactaaaactaaaaacccaagactgaagccaaggaagttgggaatgtactttattaaaaattttagacaggtgtctcacagctttttatttgcatcatggatctccaaagggggatacaatatgggttgcagcatttcccatacttctttgaacacagaaccttccattttgcataactagtgtccatgggatggtcacctttttgtacttccccagagcttatagttgtgcattaactatgtgattcttcatattcaccttcctattgagcctgtaaactccatgagtgaggaaactgtgtctcctcttgcttcccattgtatctctgcctagcaccaagtggcacagcctttggctctccaaaattatttgttgaatgaatgaatgaattgtgctacaccaaatcaccagtggttctctatatgaaacctgtattttagattctttacaaggtatgcccagccaacttaagtcttttcttctactgtttcttctacctagtattagagtattattgttatcggaaggatgactgtataaatttgtcatccaaactggaggacatttttgagagggaaagggaatactatcaataattacacagataagaagtgtaacctggggctatactgggccatctagaattgatagcccttcattattggtgactgtctcaggctgtctcccctatttgggattttgggcctcttggagcagggacttttccatgtagaaggtcttcaataaatactggttgtaattaatgcatgtacagaagtgaccataatgctgtttgaagatttgctgtattgtttaacttgtagtttttacaggtgaggaaatctagtgccgtattctgttcttcatttacccaagtatagttgagtccatacttaagtctgttggggagttaataatcgtccttgcaagaggcctgggcaatgtcgatgtaacggcagtgctctcttaacaggattgggctttcatctttcaaggcagtgaatgagagacccactgttcttaccagagcaggcaggaagcagatgtgatcggattgcaatcctggagagggtgaaggtgtgaaggggagttaggaatgtttgggggatgcctaaaacctgcacagataatgtagtgatcagcagagatttttctagatggttgcctgactctcaagttcctgatcatgcactgtcttacagctggttgcttattttgttatctcgcttcttgctttcactgactataaagcacctgcaggaaagggctatgggcctgacatggagtaaaccctcagtacatttctgctagtgacttgaatcttgattcattaggaaggtgtcacactgggaaaaatgcatcatgggattcactgagtatacttctgagactttttctaactgccaaggcaagcatgcaatttacacaggccgttatccttagtgttttgtaggtgcctagttggactcccaagttcaaaaagaactcaatttaatcacaaaagtgtttcgtataggccttatatttttaatgaataatatacaaaagtatgtcagagggtcaaagatgccttaaagatcacgagatcaagctctctttggatagatgagcaaagagaagccccaggggatgggggatgggtcagtgcctgaaagcaaatcagtgacagaacaaggagtcactttatttctgcaccatgcactgcgatcttaccgcttcattaaagtaaaacaaaattagtcatttgcagatattcttttgtatttaataggaaaaaaatgatagctagattttcttgctttacagtttgtcctacagagtaaactattatacaagaagaagaagtagattgtgcctaatgttttctgtttattttgtttcaggtaagccttcccagtgatccaagctgtgttgaagaaatcttgcgggtgagtttaaacctttatttttgtgccttttaataatgaagcaatctatctgcttaagctgtttaaagtaattactgttctgtttcaaggagtttcatgatggggaatcctgatattctacttcaagacccttctgcttattccagtggcctcatttcttgcctgtcttctttccattttgtaatcaagctagtcttctaatatcactaagcttctgccctatccattcctacatccttctcagacagagacttaccaccttctttaggaaacgttccctgttcaagcaccataccctaaacctttgccttttacctttctgggatctcagctcaatctcactgctgccgcccactatgtggaacatggttaccgagattgattgtggcctataataaggggaagagatgtgggaatgggagaggaggagaagatgagagacttgaaaatgatggcatgttgtggaaagtgttacttatggaagtgagtgtatgtgtgtgaatgccttgagggcagaacaaagttgaaagaatggctataatctcttctgaagtaaacaatcaaaccaaaagaagaaaccaaagttaagcaagaaaaacatatctgtctgctctctctggccattggcatcataaggcagtatggaatctcaagaataggagtcatggtaatgagctcctgagctcctgtcctggctctaccatttgtcacttctgtgaccttggacagatgactttatctctctgaatctcctttcctcgtctgtaaaagaggacaataatacctgccctaactcccttataggctaccaagtggtatataaatgctggctattgtgataaatgatgaccagtgtagtcatgtaaaaaccatgaaggctttctatctgggaaagaaaataatctatgtgccagtgaaaatttggcaccccctttcctcagttaccaaagtcactccaactccctcctgatccccctctcccagtaagtgccttctcagcagcccagtgtttgaagcaagccctgagcaaatgcagccaaaggaatagtcaagagccaaaagctgtttaccattgaaatggcttgccacccggagtatacctgatgtacacattcgtgcacctgtttcagcccaagaacattgttcttgactattaaagagatgagccagtcatatcactttgatcaacgatgagactatatggattagggcaggggttcccaatcccaagtcaatggactggtaccatgtgttcctcgtgagaatgtaatgccttgatgatctcaggtggaacagtttcatccaaaaccaactccccacccctactcccactccctaccccctcatctgcggaaaaattgtcttccatgaaaccagtgcctggtgttaaaaaggttggggactgctagattaggactatgctgactactttggtaagataagaacccagcaacccctcagtcatctgtctcaggggcccgacgttttgggtggagacgaggcagctgttatgagcaccacaaaaggaatgcacactgggaactcaggcctttcccattgggaaaatacattcagtccttgctcacttgtcaacagccttccttaacagaaggtaataacattgaaagaaatgtcttactctgctctagatagtaaccttgttattcctttcttctccgagtcacaagcataaataaactcagtggcctttttataaactcccaaaggaatgccaggcatatctcaaaatctcactaatttgtcacaatcgaaattacatacttaaaagcaacccagccctggtgcctaggtggttatgtgactaaatgcaggaaggagggtgaacacctggctgaggctggcgacaccagtctcctaaaggagccacttagagaaacaacagaatttcacttacacatggaaagaaaagaagcaggttgccttaataggctcacaaaagataacatgctttgagaaagtaacaaaagtccttctgttattcttgaaagagaatctagagaaatgtctcttttttttgaagggctatagattgtatagaattctttttttttttttccaacaacgctgttaatgagtgggccttcctttattaaagaaagaatgtttcattccccatgcttcgaataaaaataagctttctgaaatttgcgtccccaattttatgactaattgttaaatttttatagaccaccttgcatgtcacaatagagcatgcttgttgggctttttgtcttaattacacattcatgttccttttggtttgagggccttagaggcctgtgacgggttccgcagtaaatttgtcacctcattccccataaacccctttcttagggaaaagtacattttatctttctccctacctctcctggccatgctcgctgcttttcaaactaagcagaggcccaaacaatgtcatctctcctcactgaggggagctatgcagaggaaggagcactagccccggagtggaggagctggcttccagttgctcatgagattcccttatttcctagctgtgttgcttttcagtttcttcatctagaagcatgcgctagttattaccccgcccatctctctacccacctccaatgaaggaatatttaaattatacacattgtttgcatctgcaccatgaaaatctgagtccatttgctctcccaactttcccacctccctgatcccccttttttccctccacagcctggcaagcaaacacatacaaacccacttcatctcacatggggacagacttcttttattaaccaaatgcaacacaaccagcctttccccactctcagcccctcaatcctccaggctatggaaatacttttgccttatgtgttttgttatggccccctttctcaaaatgctgtccaaattcaagccagttggtttctcttgaaagcccctctcaccattcatctggcaatgttctcagctccccttcaaaccagcaggtccacttttctttctttgcccccctgggcaaagtgctataatatgctggagcccaccttgtctggtcttccagcaattttcttcttgccctcatgctctcacagatgcaatcagattataacaggctaacttgacctgatgtgtcaaccttattttcctatagcaggtgacagattgtcaaagcacttgaacctcgttgtcttatttggtcataaggagtaaggtagtttcttattatttcatgaaatcgaagtccagagaggttaaatgacctgcagtccagggtggggctggtatgtggcagaagtaaaatggtatctggcctttgttttctaaatctagtgatctttgcactacacccaactctcaatcaccctctcacaaatctagagtgagaatctctggatgttaaacaaacttgcttcagacagtagctgacatttccagcaactttaagaataccagcaaaccaacataatttgaacagatcttagaaattaattcttcttttttgtcattctttaatattttgaatctcatttcaaataataataaaacaatagcaaattttcttctaataataaaacaactgataatagtaatgtgttgtctattgcatgtcaggcacagttcataagcacattatgtctttgaacctttacaataaccctcaaaaattgtattattagtcatgctttacagaatggtaaagagtgaaagtcagagaggtgaagtaatttgcctcaagtcacagttctccaagtctctgacaagagtcatactatccgttcttctggtcctgttggcttatctgaattcattcttatttaacaggctccagtctgctttatgattaacattatagtggattcaaccaccaattcatttcagcttctgttgtttcctcaatttgtacaaattcagttatgccagaataatttaagtagttttttgaacaaactagaattcactggcctacaacaccttttcaccaaactgaccttctcccacaaaatgagctgtacgaattcaggtgtctttgctccttttcaggcatattatcgcttattgtgaattttacaaatcagaaacttaaaggcagcaatctgtgcaatgcatcccagcttttacacttgcttccgtcagcatgctgtttactctttagagtcaagctaccctcacgtgcaaacggaaatgaaaaataataacagctctggccacagtgatggcattttgcagttacaattcatcaatcatctgagggattcctaggcagctcatctgtaataatatgggtaccagcagcagcttcttttctgagctctacggggttttatggatcctagagtaatcatttctggaagagttaagacaaggagagcagcatgctctaaatgctactagctaaggatggatgctcaatgattatttgttctacagtagtatgatttatttgttcatagaaagaatttactttaaaaaatcaagaaactatgaaatcctttctggaatcaaaaatgcagatagagcatttcttttagatttgatgctaaacagattgtctctcctagcaaagcaccttctgtggttgataatttcataggcaaacatctgtaagggtaattcagtgtttatgagggatgctgaatttgctagctaggatttagggaacttgatttgataaactgtatcttcttacagatttcttcctgccatatggatcaggttggtaaacacctacttggccacctctttttgattacagtatgatctgtgtttacagcattctaaattatggcaattctacttattaggcttgtgttttagttaacagttttagcatggaaaaaaattaccaaatatttacagggcagtgcttgttattttatttttattttttaacagggaaataaatgaaaaagcccatcttgcaagtaagaaaaaaaatggatcagggaacaaaattggtcggacaattatgtctgaaaggaaatttgattatattatcataactatgcagcataatcaagcacctttcagtagaatttcttttataaatttaaccaataattaggcaattgattttatatcctgtcaaattaatgtataaataatgttcaacttggattcatgcaaacgattttctatatagctgtcttaaataggaatccttctggaatgtttcagaaagcatgtatcttatttggatgtggacttttaaaattatagtttcttgaaatagtaatatagtgttccgcccaagaaagacaattcctaaatataatttagactataattaatgttaacattgatggagtcaaatgaatgaactaactaatgatagtgccctttgctaatctgatgactagttcttacctaatggcactgggaaatatgtaaatttgtcagcaggtgaaaatgcccttgactgggtaaattatgtgcagtattcccttttctgaagctaattcaaagcactaatggacttaatacgtagcatgcatatgtgaggtgagctattcatggaaccaaattagctcataagagatattatccattatatgcctcctagtaatcatttcctcttttctcaaacacaaaccaacccagaagaaagatgctaaatttaattataacaactttatgtgaacaatgcaggtaagccatccagtgtgcttccaaatgcacttagaacctgtcaagcagtttaaatatttttatatggaatctaggggtttgcagctaatatatgaggtgaattttaaatgattttacagatgtcattgggaaagtgagtaatatgagtaatgaggtgactgggccagtgaatcatgggaacctgtcaaacatggggagatgtcagggaagagatgatatcaaatagaagtaacttagcaacccagcatttagctgtccagagaatgagcaagagtagcccctttaaaatagctgagtaaatttatcagttcctgtatatcttaggtatgctataaaaataagtctgttctctgtcaacctgtttctttttgtgaatatggtgatttgtgattttctattgaattggatgaaagccggtgagaatttaggccatgtgtagaatttacacctgttttctgtatcttgggtgtaaggagagagtaatgaaacaacacattgttttgccaaaaagcattctaagcttatctgaaagaagtaacagcttccaactgttgtctaagaaccagcatttttgtactagctttgctagtgggattgggctggggaaaggagaagtaatgcaaggaagttaaccattccacttgcatctgtgtaaaggtgaaactcgtgtctctgcaaaacacattgaggaagtagcctcttggaatccatttggtaggcatctcccagttttgaaatgaaagaaagaaggaaagaataaaacaaggcttgtcccttctctcgtttgtcattagaagcattcaggagaatgagaaaaataaactgaaactccatgattgatgtaaccaaagggtatccataagcctgactcacaatttattttgtgaaggtcaaacagggaagaagccaataagtgattcccatggtcttggatttgtggcatagtagatgtaagaaacactgattttcagaataagtggaacatggtgaaaagcaataacagtattagaataatgagaatgggcattaaagttggagatgggagcttccatggaccaagtttgggacacagtctcgagaagtagggaaggcaggactgaatgagaaattacataaatgatccatatttgtggaaggcactttgttagtgaggcaaggtggatgaatgagatgctgctttgcaagtagcctgtagggctgatgtttattgataacagagaagtaaagcctgaaagcatttgggcacacagccttgtattccgaagagaattcctgctagtctggaattcagccacagccctgactggtcctggaagaactcttgacatgaaaaaaaaaatagtaataaaaaagaatcaccacaagatctatgcaaaaaaaaaaaaatacacaaaaaagcatgtgagaaaagtgtaccagaaaaacaatatttttatggaaaaattaaagctgtgaccaacatagtggcatgaatttgttaaaaccatgaagcaattttatctgaaaagacaagaacaaaatcagtgatacaggaacttaaagatgctatttaaaaaatagataaatcaggaggtgtgaattaatgaattatgaacagaaaatcattataattaattaattcaagatccttttcccaaataaaacaataatacaataaaatagatacttggttacttaacgccatcaagaaaaaagggaaaacactaatacataaaacaagaactaataaacagaaataacctcagatacagagaaaactaagagaataatgagtagcaattttctcagctctgtacaaataaatataaaccggtggatgaaatggatggtttttctagtgaaatgtaattgacagagattaactccagaaaacacagaaaatctaaacaggcttatagccatcaatgaaatgaagactctccccaccccttaacaaaagcgtcactcccagatgggatttcgtgaggaaattaaactaaactttcacaaaatatgacagtataacttttacacgacatagaacaaaaagaaaaatttgcaaagtactttttagaaaagccaatctagcttttattttgatactaaaatctgacaaaaatagaacacaaaaaagaaaattgcataatagtatcatttatgattattgttgcaaagctccttaatgaaatactaacaaacagaatcagacagcactttaaaggatatacaatatcaccaagtgggttttattccaggagtgtaaaactggttcagtgttaagaaatccatttgtataatgccttttacaaagagaataaaaaaagaaaaattacacagtcatcttcatttagatgataaaagacacttgacaaaactgaatacacattcttgataaaatagaaataagtggaaacatatttaatgtgataaaatatatccaccttaacccaaaggctagtatcacatttcatggagaaactctcaaagcattctcattatagtcaagaaaaagactagatgttctttataccactatcattttatgtttttctggaggttagccaagacaattaaatatgtaaagaataagaggcattaaagtgagagataatgcttaaaatggttactatttgtacattatacatatattgttttcctggaaaccagaaacaaattaactgaaaacactattatgaataatacacaaattcagccaagttgctctgtgcaaaataaatgtatggcaaaaaatagtctttacatataaagcaagcaactataagatgtaatgggcaaaaaaatccttttacaccttatgaattgatgtaacaagaattgtgtcagagctgtataaacaaactaagtcactatgagagatgccaaagaatacttcaataaaaaggcatacaattcctgaaaaggaagacaatgtcacagacgtttgtgttctccctaagttaatcttggatccttacctcacgccatacaaaaacattacttctagatgtattaaagattaaaaacaaaaacataaaatattagaagtatatatggaagattttaatttatttttaattttccgatcaagtctcataattagatggcagggataagaagcagtcaggggaaagttcagaggttagaggagactggagaatgaaagagtaattgaaagagagagaagtctctcactctaagggaatatagtaagattatgaggcaacatcaaggctccaggtgatattgaagatattatatttatacaggtttcaatctgtagattatataatttcctccagcagtgcttatttcattacccagagaccacaggctaatgggtcgatgacagcctggaggccttagagaggttgaaaattgccccgaatcatatattcatatggttatgaagcagctaacacagaattggaactcatgttggcctgaacccaaagtacatactaatagtagtaccacttacctagcatttttttgtacctggcactgttagaagaatttcacatatagtaactcatataatcactatatcaatgccgagaagcaagtactattatcatccccttgttagataatgatgtggaagtactctgagcttaagtgactttctaagtttgacagctaaccagtggcagagccaaaatttcaaaccaagcagtttttggtgattatgaataatgtgggtattaataattatatacagatttttgcatgaacacatgttttcatttatctttggaatatacctaggagtgggatcgcagagtcatatgcttagagtatgtttaaatttataaaaaccatactaaattgcttttagagtggctgtaccattttgcacttacaccagccaagtatgaaagaccacttactcagcatgtacttatttcccatttgtatatcttttttgatgaagtgtctgttcaaatcatttactcatttactaaatcaggttgtctattaccttataaatgaatcttgagagcttttattgtttctggacataagtcatttgtcagatatgtgatttgcaaatattttctctcgggctgtggcttgtcttttcattctcttggtgatatccttctaagagaaaaatttcttaattttgataaaatccaatttatctttgtttcatgttatggattattattttgctgtcaagtcgaagaacttttgggttaattcaaggtcaaaaaaattctcccatgttttattctaagagttttatttaagtcttcattttggattaatttttatgtgtgatgtgaggtataggttgagatttacattatgttccagcacgatttattgaaaagattgtatttaatctttctccattgaattgcttttgcatttttgtaaaaagtcaattgaccatatttgtgtgggtctacttcttgactctccagtctcttctacttgtctgtgtccttgacctttcactaataccataatgtcttaatttctgtagatattgtaagtctgaaaatagcataatgtgaatcttccaactttgttcttttcctaaaatggtttagctatcctagttccttttcctttccatatgaattttagatatattatttatatttacaaagaattctgcttaaatgttggctagtattgcattacatctataaatcaattttgagggaattaacacctttactgtgtgcatctttcatctcatggatgtggtcaatgtgcctctccatttatttgggttggctactctatttttagagggacactggtaatttataatcccactttagaaaattcatgctatgagaaaaatccaagctcctagaaaaactatgtgaacaaaattattcattacacaattctttgtaatagcaaaaaatgctactatatatttaacagtgggagaatagttaagcaaactcagatttatacattcagaatcataaccaaccattaaaaagatggctttgccggtgatgtaacaacatgaggaaaaattatgagataatgtttactgaaataagcagaatataacattttatgtacttaagtattatatctctataaaaaatgactaaaaagaaactgaaggaaaatattttgaaatgatagttcttattttgttagagttagaattatgggtgagtttcttcttttttatattttctcaatttctataatttatattactttcataaaaatatttaagaggcaatttactcatgtaacaaacatgcatgtttaccccctgaacttaaataaaaatgaaaaaacaatttaagagttatattgctgaactaaaatgcacttagcaaagagtaaccaggatagtgggtagtttccaaactggaacgtctaaagagatagactagattaaacagcagaaaattgaactagaagagggagcaggctgtggctgcctgagagactaccctgtggaagcaagagactcagaggctgcatttgggatagaaggcctcaaatggtggaatccaacttttgaggggcacttatagagggataagtattagggcaatacaagcaagaatgttctggggggtggggcatcatggttaagacagtagagctcagctcttctcccttgctgaatgtttttgggtaaattaaccttttcgtacctcatttacaaaagtgagataatatgccctaattctcagaattatagggacaattaaatgagatgatgcatatgaaacctctggaatagtgcttggagcactcaattagatccttcctttctcccctgttctaattggtagatctgtccaagggtagaaggaggtgaggtctttgtcactgaaagtgttcaatagaggcactgtgctcccccagtacctagaggataaacttccaaacccagatcttggcagtcaaagtccttcctttatgtcaccactcatgcctacctcacatattgccaattctcccaactgtgtgcccttttccacatccactgcagacttctccccctttatcaaatgtgccatctcctcctctgcctctgtgtgctgccccctccctctgcctgtgatctcatccactcctgtctttgtctggtgacctcctatctacaccatgtaagatccaccacagagatcacagatattaatgaattaatttctctatctgtcttctaggtccccatagcaatttttatatatctacacttggcctttgtatgtgtgtatgttggggagttgcctcttatggtagaatgtgaggtccattaggtcatagtctgtgtggaaatccttattctgtctctttggccaattccagaaggcccccccacatacatgcacacaaaggtgacaagtgtaggtgcataaaaagtgcatagattagatgtaatgtgtttattaaatgacttaaatttttagaggaatggttagagaaaatgacctcatagtgttatttccacccaaggtacaataatgatttgattttccatgaaaatattacaagttaataagcagataatagtgcttattgagtagaataattatacaaatattaggcattttaatgactccatttcttatttctccaaatgatatattatcaccatttgtgtgctttttccattgccaatttctttttaagaagggcaaaatgccgcatgcagctccaatcgtttagatgtgtctggattcttggaaacttgactaccctatgttctcctagaaatggaccgtgagagcttgcttggaggttgtagcagggaagcacagctgctcctatacctttgacctaagaaggattcaactctatagataagcagtggtaagagcgagaaatgacacccatctagccagccagatcagttgaatcaaacctgacgttcagtggggtaacagatgtcgcagccagatagtcatcacatcctcaattgcaaattattatttaataccattgttatagtccatttttaatattgttcctcaaaatacaataatgctagcattatcagtgtaaacaaggtactgaataaagacagggccccatatgctactacaatgggagagattttcaaatctctcaaataatgttttggcactattcactgtgcttattatcactgtgatcacaagaaaagagcttccacaagatgtgttttcttccctaaagtgattcctccagggtgtgtgtgtgtgtgtgtgtgtgtgtgtgtgtgtggctgatagcctgtaagttgcttccattaaacactccattccccaaagcctttcattattggaatgaacacactaacacgaacagactcatcctgctcttttcctggcaacatgttaactggaaattgcagaatcataaaataaataactaaggccaatctaaaaccaaggtgtaaaaacagcatcctggctgtctgggcctctgattattttctattgaactcccttactacttctcaggacctgttgcgttcagaggatacccgaaaagctagtctatcctccaactttgcagcctcctcactgctctttaatccaggagctcccagcacatcctcacacccctagtgcttttgatgcaaaagtgaatagcaggtctgacacctggagaatccaccctgatgttagagcctggtctgctcctgtcctgtgttacagagtggagaccatgcagcatcggcctttgaaagaactgggattaagatgaaaacaatgtgccagtgacactggaccagacatcaagagacctcagagctagttctgaccctgccactaccttattctgtgacccttggctagtctcttaaccattgtgtgcttcaggttctccatctgtaaagtgttgaattttttgcactctccagtacagaaacaccaaccacatgtggctggctatttgaatttaaattaattaaattttaacaaaataaaagttcagttcctcatccatttcaagttctcattagttacatgtggccagtgtttgccatattagacaacacaaaactcagtatttccatcactgtagaaagatacagtgaacagaactgccccagatatctcttcagatttgctctaggtttttattctgagttttatcataaaataaaatcaaatattgttttaccttctagactgtgtattctagactgtgtttagagtatatctgattaatttatttcctcctgagtcttatatacaatacattgatcaaattcaactctggttctgagcagtgcccctactatataagacagaacaaaaaataagtctgagtaggtagaaaaagatacagcaagtattcccacaaaagagagaagaccagagaagtttcaggcatacgcctggtttgttgggcaatgcagggacccatgtactcctaactcaggcctcagacaaagtgtctttccctatgttcaataacattaataatgctttcatccctaggctctggaaataagagggtacatcagaccgttgaatggcccttttaggagagaaatggtactataaaaacccaggaattgattcatatttgcttcctctctctctctctctctctctcttcctctctcactctctcttccctgcactcttcagcttttccatctctttagacatccacctaaggtgcatcattaaaggaagtaccacagcagcacttggacagctccagtggctttaattgccccatttcttcattaaggggagttgcttacctacaccttgcacaggggcttgagatctggattattaacgttaaaatggactgagtcctgagaaaagccattcattgtacaaactttcagttatgtagggtaaataaattctgaagatgtactgtattatatactcaaaatttactaaaagagtggaccttaaatattctcacaacatttaaacaacaaataaaggtagctatgtgagttggtggacatattaattagcttgattatggcaatcattttacaatgtatacatacatcagaaactcacattgtataccataaatatatattaataatttattttgtcagttatacctccataaagttcgagaataaaaagccattacttggaatgcattctggtgacaagggaaatttaataaattcgtgcctctccttagggatcggcttatttttactgacttgccatttggattgtgtgaccctcacacttgccattgggttgcgtgtggcatgagtaagggcagtggtttcaaaacaattataagttgggttctgtggttcatgcctgtaatcccagcactttgggaggctgaggtgagaggactgcttgagaccaggagttcaagaccagcctggggcaacaaaaggagacccacatgtctataaaaataagttaattggctgggtgtggtggtgcacacctgtagtctcagctactcagggaggctgaggtaggaggattgcttgagcccaggagttggaggctgcagtgagccacgatcacaccattgcacactactcactctgaggtgacagacagagtgagacctcatctctaaaaccacacacacacacatacacacacacacacaaaatgatgataatgtacttcttataaccaccaaattataatggacttccagaaaggtgagggagctttgttcctgctacatgattggagttttcccttttggaaaacctgtcctatggagtatggtggtgcccaaagcctagagctcaaagccagacacctgggcagaggtccttgagctgcatgacattgtctccaaaactcagttatctgacctatgaaatgagaacaagaaaaactacttctctgtattattgagtggattaaatatggtaacataaatgaaacagtgaattctaacccccaaatacatacaagctcctattggattgttattgtgactcttcttgttattcagaaattccaaatattttcaaagggtcactttgaatttcatatttcgacccttcacagactctctatctgatttggccaaggagtttagattgcccctgtgattttcttgaatattaaatatgtaagctcctttcatgtctttaatagagtagtttttttttttcatttttgaccactccatagttcataaggcacattgcagcttttcaaattgtcaaatttgtttaattagcccagagaccctgcccggttggtttttgtcagctgtatagcagtctctgtgggtggcttgcaaatctctgaccagggttttttttttttttaaatcattttgcacatttctttccttctttaatacaaatcaaggagagactagatgagcaggaggcagtggtgggggtgggagtaggaaggcaacgtgctgtggcactggttgccaactggcttttggacaagagttacaaattgattacaagtaacagttggaatcccaggcctgagagatccaggtttgtgagtgtgttgcgggtggggtagagttctccttgagctatttatttacttcaagaccaatgtttcatttgcacactgaaaccttcctaggtaagggtttgacattgttccctttgaatcttctatttggtgctttgctaaatttatagccaggagtaaacgtattgatctggttacccaaaaagatgttttaggccaaaaaaaaggtagaggtttaaagaggatttagagacatccactggcagtggattctcagagggttattagggaagcttgcaaggggcggggggtgggggtaattggaatgcaccccttccttatggtgagtaaatgttttgaagtacaaatgtggatgccctaaaagatgtcaatgggaaactatcaataaaagaaacttttataatagtcttcttgtgtgattgttaccttttaattaaaaaaaaaaagacttggtagtgaaatccaataatcagattggattgatgtttaacaaatacttagtataaaatatcagatatgaatcaatagctacttgtagcttatgctggcaagtggctgtttatatcaaggcagagagggacctgctttcctgggtttaaaatagaattgaagctttatagcgtgcctgtggggccacatttttgtacataccactggcccccagtgttcatattgagtttagaaagttctccttcttcatcagtcaaatatccttttagaaaaagatatgcctctcacttgtgctgtgattttgccactgttaatatggaatacagatgctatttattttccgttatttggggaattgtagagaaaaacgaatctggggagaggagtccaggcattcagaaatactcaacctattaggggcttggaatacttggagggggctttctgaatcaatttcactgtgacttagtagtggttttgatgttgttaaattcagactactgcaaggaatttgatacctctgttggtttatttttatttttattgaggggtatctgtggatggggggcgggagagagggcctggtgttcagtagttagactgacatcttgtgatagatttgttagttaatttcatgtgaatgggacaaaccagttctctttcctgcccctggcactgtgattctaagattgaaatagctgtttcagaggaaagacaattccatgcaaatcatattggatggagtttcagctgtattagcggcctggtaccttatttttactgacctcaggaataatgagagaccaaagctatagccaagttcttaactggaggcttctttccacgaaaatagatattacttctttattccccagcaattgagcctttgtcccttctaaaagtagttgtcatgaactcctcattaccatttttcttaacgtgataagtgtaaactacaagaaagctatcatgtttgaaaagctacagcagcccttagaaatggaatactaacatgccttgtgtacttctttgaaaggacttagactgaggattgtgtgaaatgtatccttctgcccccctttgcctggagttgtcattctctagtacctttcacttatagcataagctggctttctaaaggactgctgtgttgttgcattgacaccgtatctctccaacaatgtgaaatcaacaaatccctttggcaatttctgaaacatataacaaattgtgcattattctctaaaaaaaatcaactttgatgggcttattttatttctacttcgaatggtaactggtaattgttattaccttactctcattccaattatcaatactctagctacagagagtaccaccagaccctgtaccgggacctagtctagcctcctggctgtcagataccttgcaaggagtagacactcaataaatgttttctgaatgaatgaaattaaatatagattattagaaatgctgctggaggagaagccaatgaaagtgtgtgagttttatcaagttggtttgcctgagctggtgctaaaggagcaaattggaaggtaaccattaagaaacatctcatgctgtgaggatatagcatgtcattccatcttttgaagtgactgtgaaaggaaaaaaaaaacatggctgtagtattatgaaagcctcgcgaattatctcaaatcagtatattttaagtgatggtcattggatgtagttgacggcaaaataatttgaaacagaagagctggaaattcaacattgcaattaaaaatcacttttgaaaagagttacaatgatctgatgtcaaaattagcttaagaatgtaagaaacaatttcaagggttagaaatgttaagaactggccctgaagaaaccccagaatcctcacatacctgaactggaccacttagaaaaagccctctaccttgattccctttttgatactgctctttgcagaacactttctcagtggccagttcttacatttctaagctttgatattgtgttaattttgcctgtaccaaacaaggcaaacaattcagtgttgttcaatctgataacatttcctagtggggtgttcagtcttctattctgactggttcaacctaatttagacaaagacaaaggtcttaataaagattaaaatttacaaggcaatcgtgtttagggaatcaaataccattagttggatgggccgtggcctgaggttgctgctgctgaaaccttttgctgaactaaaaaggtctggttgaattctgcccagtatatcactatagtgttctgttcccttgtatttacctttggagacctttctttgcagtgtttgaatgtagaatgcccgaggagtaactgggccaaaaaaagttgcatgaataggccctgcacatggtcatatatgttcctgttgtattcagtgggtgaaatggaattgattgcatctggcaatggcaagaagatggcttgattgattgcctgattgagtacacagtggagattcagaatactgatcactatacttcccaattgtacattataattagggctctttttcaatggaaccctggtttgggggctgccaggatgaaggcagccaatgtgagctgaactttttgcatgtacagattctcctcctggatccgaaggagaatatttccagattcccttaaacaactgccagcactaaagagtttgaatacagaattccattatttatttgaagaaacatcgccagggtttttataccatgccatttaaatcataagttagtgttagaaacttttaaaagaattgcattttgcattgacccattgttatgccatggccaagaagttatgtttaatgtaaccgttgattttacacttcctctctatgagcacttgcatggaaatcagaggagcaatctcaggagactgtcttaacagcattccaaatagaagaatattcattcaattgaatggaacagagttttgaccactagaaaagcttggcaggaatggctagtgatcaagcctaggaaagtctatggttccactgttgttagattttctaagagttcagcaaacaatcagacaaattgggctgttagctgtctcactgtgagacaataggctcccctcagcatgtttcccccaccccatccctgggagaatgacaaatttccttagtcaatttagtcagccgtgtttatatgtcatgcaaaacaactgctccagattcagttttgcatcttctcatatatatctttgactttacagaagtaaagtgtatgattatctgattaggtaaagcagtacagatgattcacaacacccactccgccaccttttaggaatcccttttcactgctctaggcagaggacatttcgccttcagagatgaactgctcactgccttctaagacagtaggctccatgattggaaacctcaaatgattggaaattctttagtagtttgagctaaaattggtcccctgataactttacccatacagccagtcctaaactcttggtccacaaagcaggtctcaaatctctttcatgtgaaagactttcatggatttaaagacactcctcactctcccttttctgtggactaaactttccctgtttctttaatgtctatgtatacatgagatgagctttccaagctcttaccattcagatagctgtcccttagaggtattgcagtattcccatgcccccactgagatgggacatccaggagagcactctgagagggccctgagaggaaaaagatcagtagttcttcccacatgccctacttccctctaagggaatttcgtttggaacagccaagctccctgaccctgagcaaagggcccctgtccttccgaagcctgcctgagggggcctagtaggagaaacaggtaagttcctgtgtctgtagaggctgcacagcagcctggctacattctggcacaccacactgggagcagcagcctgtgcagatcacatccagccccctgaatccttttacaaatggctgtgtggctccctccatgggcccatctattgggggaacctgcccccaataattcatcattatttcacataggttcttttctatttccgtaagtgtcggcctgtctgagaaataaagggaaagagtacaaagagagaagtttttaaagctgggtgtctggggcagacatcacatgtcggcaggttccgtgatgccccccaaactgcaaaaccagcaagtttttattagttattttcaaaagaggagggagtgtacaaatagggtgtgggtcacagagatcacatgcttcacaaggtaataaaatgtcacaaggcaaatggaggcagggcgagatcacaggaccagggtgaaattaaaattactatgaagtttcgggcatgcattgtcattgataacatcttatcaggtgacagggtttgagagcagacaactggtctgaccaaaatttattaagcgggaatttcctcatcctaataagcctgggagcgctatgggagacccgggcttatttcattccttatctacaactgtaaaaaaaaaagacagactttcccaaagaggccattttagaggcctccccttgggaatgcattctccttctcagggatgttccttgctgagaaaaagaattcagtgatattttcctatttgcttttgaaagaagagaaatatggctctgttgcacccggcccacaggtggccagactttaaggttatctcccttgttccttgaacatcgctgttatcctgttcttttttcaaggtgcccagatttcatattgttcaaacacacatgctctacaaacaatttgctcagttaacgcaatcatcacagggtcctgaggcgacattcatcctcagcttacgaagatgacaggattaagagattaaagtaaagacaggcataggaaatcacaagagtattgattggggaagtgataaatgtccattaaatcttcacaatttacgttcagagactgcagtaaagacaggcataagaaattataaaagtattaatttggggaactaataaatgtccatgaaatcttcacaatttatgttcttctgccatggcttcagctggtccctccatttggggtccctgacttcccacaacacccatcttaaccctactcctgctattgttgtccatttcctattaacacccccactgctgctgcagataagggtgctaatgccctgcctggctttgctctcctatcagggaggagcagagcatcctacaggctggttagcaattgatagcagattgaaggtcaaggaaggatttgtttgctgttctcctgaaccctagccccagggcagccctttctaggcatcctaagggcacttgcgccttattcccttgcatcctggtgcttagctgcttcattcccccttttctggctcctcacagaactgtcaggaaccatggatacaaagggtctaaatcattcattcaaacaaattaggtttttctggtaagtcattaacacctcctctatacacacacacatacacacacacacatatgtgtttttgtaaatgcataaggacctttagataaagaaacagattcagcagtctaataacaagacctcactcacataaatgttttcaggtttaatttagttttggtgacggaaagatgctgatgtttcttcatccttagtctgtggtgatttgtaaagctactcagtaggataccttttgggagtacactatctgtaaagcaaaactaaaaaataaaagaagaaaggaaaagaaaaactgaaggaaggaaggagggaggaaggaaggaagcaaggaagggagggcccctccaatggaagtcagacaccaaggttagttaccatgactcagttaccatgacttgtgagtcatttacttctgatttcctgtgaaaatattgataaacttgaacccgattttgcagatgtattcttctattcaaccatatttttatttgagccactcagctattcacgcttattcttaatcacaagaatttgtgaatacttccaaaattgcatttattacgttcttggtattttagtagagggaagggagaaaggtgtatgcaagctccatcttgagccttgggcagatcccaagctgcctggttgctaagccaaggcatgcaggctcatactgacaatgccatagccatacctgtggggctggtagcaatgagctttgaatgtgtacaacactatatggtttacaaagcccttacacaattattcatttgcttccccttatgccaagcctgtgaggtaggcagaacaggtagaatcagagatgaacggtattgctaactgggagaactagaagccatccaagtcaaagcccacatgttgtaagcaggaaagctgaggcccagaatggacaagcaacttgaccagggccacccacatagcttttggcagagctaggcttgagttaagttctccctatcttaatacttagtccatgttgcttttggggctctctctgactataacaacaacaatgaaatatgtgaactatcatcatcatttgcattcattaaggtggtcatttgaaaaatcgccctaatcatctcttcagtttgagctcttttacagtaagtaccttaatatttatgcttaacctaaacacactatttgagcagctactatgtgccaagtataatgatagcctgtaaaagggatacacacacacactcgcacacacataaacacacatgtgtgttcaaaaacactgctcctctcacttcaactattgaagccttttccaaatgcctagcacagtgactttccccaccaccttattctctgcacctttgctcattcccctctcaaggtgattcgcatgtcaggcagtgaacgcttcaaaaagaggtccttgactttatcatttccatgtcctagtgactggcttataatggctacacacgcctgtaatcccagcactttgggaggctgaggcagactgatcacaaggtcaggagtttgagactagcctggccaatatggtgaaaccctgtctctactaaaaaatacaaaaattagcctagcatggtggcacgcacctgtagtcccagctacttgggaggctgaggcaggagaatcgctggaacctgggaggcacaggttgcagtgagccaatatggcgccactgcactccagcctgggtgacagagtgagacgctgtctcaaaaaaaaaaaaaataaaaaataaaaaattagtagaacaaatgcaaagaatccaccaaacagatctgccatttgctgtgtgaccttggacaagtcactttacctctttgtgcttcaattccttgtctgtgaaaagggtgtgaggctaatccctgcctgtttagtttctggtacaaaaagaccaaccaattacttactacacactaggcaggagagatacaaaggtgaataaggtgaggcttgtgacaacatactagttacttgagataacagctattcaggtagctgtgtgttagatgagtacaggatccatttgagattagcaaagcctggaacacagactgtcttctgtccttcagcctgtggcatacccagctttcgtgtctaaattgggcaaagcaaggatacctgcaagtggttttggatttgttttgagtcctagccatgagctattgtttggataatatggtggaaaattgagccttttgtgattttgtggggtttgactttggagtcttcatatcacattaatataagtgtcttcctattattagaagttatgtagaatgctctatcacttatgaaatccattctttgccaaatactaaaagataaaacagtattccttagtcttttcttcattatccatgttagtcagtcttacagagggagacatatttgttatagtggaaagtgtgcactcttgtaccagtaatcaaacttcacttgctactaaatgtaaggctgtgtataagtgacctcacctcttggaacccccattacctcagttgcccgttgggaatatgaatccctgctttctgtctctctctgtctctctctcaaaggatcaaaggatcccaaacataaagcagtgcttccttgtggaagttcagaccagtctcagatgtgtgtgtgtgtgtgtgtgtgtgtgtgtgtgtgtgtgtgtgtatgtaacttatttttgttaaaagagaagtgattcttggtgttgtgtacaggtactcatcattggatcctgttataaagctgtggcaacattttgggagcaggggctcatccctacctgatgactgggtgaaggattagtaaagttgggtaagaatgcataggtgtcttatcttaggaatagcaagaacataaactagattaatatccttcaagtgttaatgaaaaggataacaatggaatatctgctgtgagtgtgccacactttacaagtctaattcattttgagaagtgaaagagcttgcttgctccaaagtcctttgaggaagatattctttcaggaaattatattcctttcaactacatcctgcctactgtaatcaaatgcatcagtggtaacatggactcagtgtgctgtttcatgaaatttcacattttcaaatacagtttgaaatcagttgtaattgaaaatgtagaagtttgtgcagttccatgtggattagctaacagggcagtgcactccactggtaattcaagataatcagattctgcctccgagtaaatacagaaaacctaggggaaaaggtacacttttgagaagtgactttattcttcccggtgtctgaaacaccttttaataaacccagaggcacacctctaaaatcagtggtgaaaggggataaaactaagcctctaatcaatttaggcatacccagtagttgctgaaaacagacaacactcctttttctggaagagacttacctgctgttttattgactctggctaaatatgaactatattttatttattttgagaaaaaaattattttaattgacaaaaattgtacatacttatggggtaaaacatgatgttttgatatgtatatacattgtggaatgattacatcaagttaatttacatatccatcacgtcacatactttttttttttttttttttgagatggagtctcgctctgtcaccaggatggagtgcagtggcacaatcttgacacactgcaacctccacctcccaggttcaagcgattctcctgcctcagcctcccgagtagctgggactataggcgcgcaccaccatgcccaactaatttttgtatttttagtagagacggggtttcactatgttggccaggatggtctcgatctcttgacctcgtgatccacccacctcgggctcccaaagtgttggaattacaggccaccatacccagtccacctcacatactttttttatggtgagaacattcaaactctgtcttagcaattttcaagtatacagtacattattactattaataactatagtcaccatgttatgcaaccgatcttcagaacttactccttcaaactgaaactttgtactcttataccaacagctcccccatcccaagctatatattttaaatgatctgactattttggagaccagtcttaatcaggaaaaaccatctaaattgtaaaagagatcactgagtatttttaaaactcagagtaattagaattactgttgtcacatatatttactttgcagccagttttgatgaatacatgagtaggatttgtcatgaatgttatcaactggatacaaatgcacaactcaaaaacacttggaagtagtctatctcttaagtaggttaagcatctcctctaaattgtgtatgcatttttaatgtagttacctcctcctttttaaatagtgctaggtaaaattcaatctttgtcagaataatacttacaaattctgcttcagcagtgccactgtgaatgaatctgtgaagtatctccttgcattacagctcttcatacatcaaagactctttttgaactgagtaattatagaaggaaaaaaaccttgttttagtgctacctgagagttcttattaatattacctttgaaatgactaattatgttacttataaagactggaaaaaaacaagtattatgtaacttactcattaaaaaagactttcataaattttgatcccctccatccttccccaaatccctactttatttctatcatgactttttttttaatgcttaatggttctatatgaaaatgatgactccaacacatgctgactccctcctgcttcacaaaacttatcatctttctgttgctgggattttgagcatgtgattcaattatccttgctcttagcgtaaagcatgttggccacatgccctaagactcaagtaagatttgaacagcacctctttcaaactgagtatttgaaagagctgagagggtgtccctgctgataacacagggtgggagcctaaggggcttttcctgttttgagacttgaactcacagatacactgtctatgtgtatggctgtgtggaaccgagctaccaatcacatagtaaccttctctatgaatgagaaagaattcccctcagcggcttcatctttgcatggaaaaacccacagtatgtgcatcatgggtcactaactgttgggctgtatcaagagaagatgagtatcagaaggcagcgacagtactgtcctcccttgagctgacagatcacacgtggaacaggataccatgagttacaagagccccaggcaatctggagttcctcctggaagcaccaacaatagtgacagtgtacagaaattgagcattagaagaaaagttgaaggttcccaataaatgaatgaacaagctgagaatgtctcagcctggagaagagacgatgccaggggataggattactatcttccaacaactgaaggcttgtcattcaaaagaaggagaagatgcattctgtgcagctccaaagtacagtctataagtagaagttcctgggggacaagtttttaactcacaaaaaaggaagaatagcctgatgatgctgtctcaacatggagcaggctacttcaagcagtagcaagctccctgtcactggcagtttgcaagcatctgctggatggtccaaatgactttaaattcaccttaagtattaggtcagttaagttaagttagtatttataaaggacctacactgtttagtgctaagaaagggcttgattttttaattgccctgaaataaagtttctttatttttcctcattaggagatgacccattcctggcctactcctctcacttccatgcatactgctggacactctgagcagagcaccttttccatcccaggacaggtcagttctcttccttcctgcatttttgtttgtcttattttaattataccaatcttccaactggattctcagtggcaaaaatggccttggtcttctagtgccataaaatctagactctcttgcccctcagaatagcaatataaaaataatttttattgaaagtgagtctttaaaacaaaatacacacagataccggcatgcgtgtcttactccatagggtgttgccactgtccaagtcgctgtgcctagaacagatgagacagagattgaataactcatcccttaagaaatatcaaatagatgatggaacagcaacgttcaagattttaaagttacaaaacctgtactctttaatgaactgattttcatttttatcaccttccagttcttgctcacaagcagacagatctttacaaaacaccacatcacactgacagagctttatcttctacagttctattgtcaaatgtttaatattatttttatttaccttctctcagcaagagttgctttattgccatcactttttaaaatgtctagacatggctattctaacatactttaaaaatatatataatgtcttcctttcttcctccattcctttcttccttccatccatttattcagaaatcatttactgagaagatacagtgggcttaaaggtaggggtgaagaaaaaccgtctacatgctatcacatagatcacaaaacaatgtagtaaatgtcttcatagagaagacaagactcagagtcgtatctaacactcccctggggagttgaggaagtgctcaccactgaggtggaaacatttaggggatgattaagactctgacaggtgaagaaggggccaagagaagaataccgcatgcataagactagtgtgagcaaggtcatgagagatgagggatcatgctgtagtgcatggtgatataaggtctcaagtggcaggattaaagtttgtgtgatggggagtggaaagagaggaaacctgggcaaataggtgcatatttggaaaacgccttggataccacctcaaggagtttggactttatttgtagaaggagaaacacccaaaggagaaacccttagattttagggtcatgattttgaaagtaacactgatctaaactttgcttaatgatcttccttcacctatgaaagaggtcagaactaaacgaacagctaatctcactgtcccagtatgggtgtgtgctattcctttttgcattcacacccaccctttttaggcttctgttctccttccccctggcatctccagcaaagggagttatccatccagttcaggtccaacacttgtacagcaattgcagtgttttcaggtgggttctccagttttgaagataatttgtgcaagttgcaattttgacatttgcaagtgtatacaatagaactgttgtttaaatgggcttttatagttaagtgcacactttgaaatcaggcacagtttgcattttctgccaattatctgtgctaccatcaaccccatgacaaaggtagaagcaagtggactaaaatggtgaaagcaagaagtctacacacccactcctgtctcatttgattcctgccaaaacgttggtttgaaagaaaagtacactttaaataacaaccaacacatacaatggcaccatgtgcctcacgtcattctaagcacttaatatatagtaaataatttaatccccactacaacccaaagagattggtaattttactaccccagtttacagaggaggaaacatggtagttaagtaatgtgctcaggattatccagttaataaataagggaaccagtacttagatccaggtgttcctggcaccagcggtcatactgtctctctgtatatcttttatcacacaggcccactgatgccccagttcaaattctatcttccaaaacatggccatccctatatgtaacaaaggtgatttccctttcctcagtgcttccaccagaattaggtgacagcatcctttcagaaagcatcagtttcttacatccatgacagagcttgcccagaggaaagagtgctgtcttaagagctgccttcccagctgcttttaatcctggcactgccatttgcttgctgtgtggtcctgttcaagttcctctaaacctctgtttccccatctgtgttggggcatggtgtgtgtgtgtgtgtgtgtgtgtgtgtgtgtgtgtgtgtgtatgtgtatacactatataatcccaatggattttctaggtaaaatagttgatgattctgtaagcttactaaaacaaatacagttgaaaattctcaacttacttaagcttacttatcagtttcaaattgaaaatgccatgttttctcatagacgatgaaaaacctcacaaggaagggagtaagtgcatgccaagtagaattgagagaataatcatatcctcaggagaagtttaataaagttttcctggaggtaaacatcctctagaacagaggttggcaaactatggcccataggtttttacatctttaaagggttaacattttcaaaagaaaaataacatgttattatgaataatattcacatgagtgtggaattcaaatgtcagtgtctataaatcaagctttcttggaacccagtcacacccacttatttacgcattgtccatgactgctttcacactacaatggcagagtccagttaattatgacaaagatggtatgtctcccaatgcctaaaacatctactgtctggccctttgcaggaaaagttagctgacccttgctctataatctagatcctttaggaacttctgattttaggattattgtcaaggctattgcttaaaagaacctcatataagtttgtgaaaagaacttggcatcattatattctactgcaaaaattacatatatgacatgtctatgaaagaaatgcataaagcaaagtcaggcatttaaaataaatttgtattatttgttgtgcattaacaattactgtgagaactgtgcagattatttctacaaccaagctatttccaactggggctggatatgtatgtaaagtaactttggtgatatacaaaggagtttcatttgttttgatttgatttgtagtttaagaaatgtgaaatccaatgcataatgatcaaaacatcatatgtacctcataaacatttacacctactatgtaccaaaaaattaaaaattaaaaaataaagtaaaaagaagtgtgaaattcagtttaacattaaaaattgtatcaagaataaatatcagttactccaattcagtgaataacacaatcttccagtttgctgtatgcattgttgcactgatggtctggaagaactgattgtttaggtgtaaagtccaaaacatttggaggaaggttaaaaattcaggcataagaccagtacaaagacggcctgcatgttttactctctgatcagatatttggcttaattgactttggaacttgtcatttaatttcctggaggtatacaagcccaaactcatcctgtacctttgtaatgaaatcccttaaatagtaacagataaaaatacttgtatatagttacagagatatacatggttaacaagtcatttatttgacactctggaaaatgagatgttctggataattaaaattattggataactgaaggttattattctataggaatcatgcagtataaattattttgaagtgtaattaatattttcctgacttcttttaaagattatatcaagcatgctttactctttcttgataacttatatattatgatgagtgtaagttattgtagtatgtgtaatattatactatgctgcaattatgttctcagggtctattaagacaggtgggaatgcttgcctctatattaaatgactgtagattcttgtgctttttaagttcagacttttctgtgtcatttttgtgggctcctttgctattggttttcacctgtcaattttctcagtgcctgtgcctctagaactatttccccttccttgccatctgtgatttgaaaatgagtgggaatcatttgagtcctttgtcaaaagacagttctctaccagggagagcacagaagcctctgagcagcaaactatatgggctttgtgacagacagttctttctctaagaggccttttctgcctcttgttgagtttgtggtaatcttctggagtggtgatcttgccagaagacaaatctcttgagcaacagaatcatactaaatagatgggaaatttcacttttgattaaagcaaagtgttatagttcttgcttactttttataaaagataatgctgtgagcctagttttcatctacagagggtcaatattaggcttaataaatagattacttggaacaatgattgatataactaattcttgtatttacttgaattcattgtctccagtttctggaatgcctgtattgcggtttgtaccatttctcttccatccacacagtgccatgtgtgccctgaacgttactgtaatgcttttgccttcaagttttgtcagtatccacacaggtgtgccacactccaagcaaggcagcatgtgcaaatctggatttctcaaaacagtgaatgaattgtgtatagtgtgactttcaaatcaaatttaaattcctttaaataacacagtccactaacatttcacattgctttctatacttcgacagacttgcaatgtagttttaagaacacttcttatatataaaatgaggtacatctgtgcacatgtgtcatagaaagttggatctgtttctataaaagggaaaaactgggcagatctattaattatcattttgtttacagttttacaaaaaacatgatcatctgtttgaaccaagtcctctttattcttttagaggcatcgttttccagctaagtgagaaattatacacttcaatttcacacatatgggtcatttgttcccatgttacacacatttccaaatagataccagtcttacttataattttgattaaatggcagttatgatcatgttgcataattttgattaaatggcagttatgatcatgttgcagcaggtttggctggcaaatgtttatccttcaaatagagctatagacaaaagcctaattaatggaattgttaacagcagcttcctatttgcaaacattagtcaactatatcttcagcaataattaatatacctcttactctccttgtgtcatttaactaatgtttgtgtcatatatattattccttataggaatcgcagcatctgaccccaggattcaccttacaaagtaagtggttttgaaaatccttcttagtccaaacatccatgtcctctgctccctcattttttcctttttcctacttaaaatcattaaaacatgaaagaacaacaataacaaaaagttattttaattgttaatttttagctctcagaaataagtgagaagatgtaaagtttgtctttctgtatctggcctttttcacttaacataatgacttccagtcccgtgatatatctaactggttcccccccttttttttttttaatctgttacttatctcaagaaggtaactcgggggactgcatgtttggagatcaatttaattcagaataatcatttgacagtaggaacatgaacagtaattgtttatatcttttcttttcagagtggaatgacccaaccaccagagcttctacaaagtcagtgtctttcaaatcgtgagtagttggatctccaaatcaggcctttttggggatatttggcaaggaaacagtgcctcaatgctgatctaatcttgttctctcctctgctccttgaaactatgaaccttgactcataataatatgtagtttggttggggtggggggagaatcaaatttcccattgtcttagtctacttggactgctataacaaatactataaacaacatggcttataaacaatagaaatttacttcccatagttttggagcctgagaagtttgagatcaatgcaccagcataaagggtatcttgtgagggaccatttcctcatagaaagctgttttcttactctaatcccacatggtagaaggggtgaggggtctctctcaggcctcctcttataagggcagtaatcccattcatgagggctcaactctcatgtcatgatcccctccccaaatacccatgtcctaatactatcaccttgggggtgaggattttagcatattaattttggagtaatacaaacagattataggacccataataaataaataacagtaaaagttaatgagatcaccattaagttctctaagtttgtaaatacagaccaggtcaatacctgggatacgaaaacaactgtgatttcagtgaaaaaataaatctctagatggcttgtttcccacattttaactagttcaaacactgtatagtatcagctaaagacattattttacacaatattcagtcaccactgactaggatggacgagggaatctaagcagccatgattggacatgaaatgttgagtggattgctatggccagtcagcccaagacctcactatttgcaggtcatcaggcacctgtatattaaagacaaacaagggcatccaggaagagccggaataagatattacatgatggtagtttgaagttcagaagccagggccctgcaattcattcagcactgtcttcattttttattaatgctaactgaaggaggggtttggagaaaccaatttcctcatattaactattgtagattttctaatatccatttgtccaagagagtatcaagggagtattatttctctcacaacttctttcatacctaataatagaaaatggaagtcgatttttttgtgtaataggcacatacttggaatttttcaaaatgaaataatttatgacattcaagtggcctaatggcacacttgaagtgaattgctcaccttttggaagatcatgaataattgcataaaaaaactgggaatgactcccaaatagactgaggatttgagaaagtaagtggcatttctacgttcttggtgcagtgcagtagcaaagccccaaagccctgaccccatcactggtccatttatttgcttttctagactgatctgtgccttctaattcaaagttcaatttcaacaaccaagaattctcaattttaagaagcaagaaaaaacaagagaaggggataataaaaccataatcccgatttaaggaccgaattatatgaaaacacaaaaatcaaaatcatctttgatgctgtatgttttagcttttccattaatcacattttgaattgccctcccccttgttattctaggaaacaatagatctaatcctccctgctttcactcctgcctcacttcatccccattaaaaagtcaataagattcacacacatacacatacacacacacacacacacacacacacacactcacatgcatttaggaaatcaacacaagtttccaaacttgaaaaaaatataaaaatagattttcctatgtaaaattatcttactcctaaagcaagagtattaggctcccactgtgaaatatgctgctttccatatataccatagaatgcaatgtttcagtagtttgtaactaacagaaataaactcgtcaattgtggtttatagttagaggctgcatttccagagaacagcacttcgtagcacagtaatatatagtgtagccaatacaactaaaatactctatatgaagcatcagtaaaactagaagacactgagtccattttatgaatgagctcctctctttttgtctgtttgatctaaagtccaagcaccatccatcagattttagctgcaataagttcccttcttactgtagggtatgggtttaacataggacagatcagaattgtaataaagttatttttatttttagcttccaacttatcggcttagccattactatcattctcccacatttaactacagtgtgctttttaaaccacctcctaggattttccatttggcagggtaatcctccaggtgattaagattattctgagtgcagacagactgctaatgcctgcgccttggtgagaagcagcccgtaagtcagccgtgatgcaggaaagacccaaggccagaaagtgtcccaagcacactcctgacacttagtgcagtaaagagagattagagtcttgtaaaacagaatcccttaattactgggacacttcattacttttcctcatcttggcctgttttccctagttgacaaaatgcagatcttccattggagtatgcattgtttataaggactatacacatgggcaccaggtctgaaaacattggccacagtgtgcctgagtataaacttgcaactagccagtctccctctttctttttgacaattactgctgtctctgagcctgaccccaacaatatgactggctttttggaaaactgggtattttccttctcagtatagtgcattggcatacagtgctttttatcagtgtccattcatgccatgacatcctacctgcttcagctggaactctgaatgcttatgaggcaagagtactgaattggggaagtttggagacctaggtttaatcccctcctttgtgtcagttgtgttattgtgggggaaagcactgacctagtatccagaagatatgaggttaaatcacaggagaatttatttttattttaaactatacagacagagtctgttaaagggaattaaacaaattaatgagtatatgtgtctacacatgcaggtacaccaacaaacacttgtcagtgttcaaatttaagcagttatactttttagtaattaaatctagcaacataaaaatacatttaactttaatcattaatactttctggaggagaaaagaccagaagttggtctcccacccctcagcctctatgattctgtgctatgttacagtcttggaacaggccccacctaggtcttcttaatcaaacggagtttctaatctcccccaaaaatgtctctgtcccaaaaaagagggtgaagcgtgggcataagaaggtgaaattgtagttctcagggctgtggagttgtatgtttacacagtaatatcatggctgtctattctgtctcaaagagatctttttatttcaatgacaggattcagactgtgaatggactcaccagacattgtgttgctttgtagtttctctttctttttctttgtttttccccaagatagagtctcgctctgtcccccaggctggagtgcagtggcaggatctcggctcactgcaagctccgcctcccgggttcacgccattctcctgcctcagcctcctgtgtagctgggactacaggtgcccgccacctgtagtttcttaatgaagttattaaagagcagtgagggagaaaacagaaaccaaggtgaagaacttggattttctttgttcagttggattgattcatctagtgtattataaatcttgccacttacctgtcagttcagtggccttcccaaatgcatgaccttgttggtcttttatgggacatcatacataggaatagataagatgttattaagttgccccgaaaaggactttcaggcaggttccatgaactcaagggtgtacatccagttagttcttaacttcagttttgtgaggactgttgaggagatggcagctccaaatatcaagctcctttgtaaaacttggttgttagcatttggactatgtccaggtggaaaccatccagacccccatttaactgagcagctcctgtgttttaaaccatgctgtcgagaatgcctggatagtttccataaaatcttaatatagccataatgttggttttttttaataaaaccagtttgccaacttatggtattaactatatgttttaaaacatccaaactctagatccagagagttgatggaaggtcttatggagacagattggttgaggccagcctgagtttacatgtgggtggttgttatgcatgtcacatgaagacatccttgattgtagcaatagttaggaagagagggcactatactatcacaggaatgacagacacaaataataattattgtgctgttgagaacaggtgccaggtgcttttatgtacattgccttattaaacttgccaggcatcgtggaggtgctccaaattattcccatcttacagatgagcaaagtaaagctagaataacagtccttcctcctgaagtgtacacagtccagtaggaagacagactggccatgcccacttattttgaatggatattttggctacaaacatacagaagagccctctgagtcataatgctcctcagtgagaaagtttgaatgcaggctaagggccctgtgagttcaaagctgtctctcatcctgctgagttgcctttcctcacgggatttgataagttcagggatttagtatgccaaagttttccttttgtacctggacacaacattcccacaacctggtgggatgtagtcccacaagaaattataccgctctgttttcgatgacacaaaactgggtcaaaattgttttatgtaatgaaaatgtcattatttctaaagttttctgtaagtgctatgaaaatttcattaccaaagagaatagaaagactgtgaggatgttttccagattgctataaccaatacaggaattacattatttttagatcaattttgaaaatatttttgctaaaaaacaattgatattcattacaaccctggccatccttttaccaaagccttcatcactggaaatgtttccttcgagattttgatttgaaatttaagaactgcaatgcattattgcagagcaataacccactttctagcaatttcatatattcttccccatgtagatgtttgatctgctacttggatgcaatttcggtagcaaattgactgtgtaatggggcaaggaagaaatgactgttattttcttaatcagattaattcttaatcagaatacatgatttggtacttggaatttaaaaatactgctaatcagtttgaggcttataaaagccaaactaactctcctgataaactggtaatcttggtaactttactagttgcagacattttggtttttaaatcaagaagtataccaactcttgcttttaacttgtcttgtatgccctgcatctctgagcttgccaaattttcctaaggacttaatatatttttggaagttctccactgcatcaggggcagccacctgggagcagagaaaacaaaatttggcagcctgttcaagctgtgaattaaaggtaattcacagtttgaaatgaatcagcgtgtggtccttgagaagagtaatcagacatcaagaggattttatgttgaggattgtatattggctaatgtgacaacaagcaatattggcatttggaatgtttgcatcaagaagcactgaagctgccggggcttgatgggtaccaagatctaaaatgggggctcccttcaaagagagctgtagatttacatttctatcacaaaagctgaaaacagagatgggttggctcagccatcatagttgaaagattagatctgatttttgtggtggtgttcatggacctaagtctatcataagatttgtgtatctcagatggcttttgagacacctctgtaatggaaagcaaatgtctctctctctcctcccccccccccccccccccccccccgctgaccacccctctctctccttctctcttttctgtctgggaaaaggcaaacatcgcttcctttctactagatttcattttttttttcaacaaatatgcattcagtatctactacatgtaaggttctgggctaaaacactggtaactcagggtgaaacactgcacatcattgtctcaaggaattcatggtctagtgaagataagactagcaccgacaatgccagcaacccaactaactcatacttattgagtgcctactatgtgccaggcacttcccatgcactttttctccttacaagcaatcccatgggtttcatcatcattatagtgtacagaagtagaaacccagctcagagacattgaatgagttgctcaaagtggcacagtaacaaagagggaggcagaacaggactgactccagaacatatgctcttaacttacactaaagccatcccatgagtcatttggaggtggctttactgatttgcagtcaggtgtgatcttgcccaggcattaggccaaaatggactaaccacaatgcaagccaaaatggcaatgccattttggtttaaatcaggggaagtattagatctaaatattataactgagttaggtcttgcatatactacacatgctgacatggacactgaagacagatctgtcctcaactcagggcctgcatccagattgtgtcaccaggactctagaatattcccttcagtgaggctgaaggatctattcctgcaagagacttagaccatcacaaaaataaaattcatataagattgattttggtggcatatcccttcagaaatgtccattgtgccacattaaagtgaagagaaaactaatatttgggtctatttttataagagactcatccattgcctttcatgcttaccaacttgtttgataattagaaagtggctttatatcctcatggtgaaataattttcaaaaatatccccatctgttatcaaccacagcggcatatttccaaattcttctcagcatttttaaacagtaactgggagtgaagcaaataatgctggtggaaggcactgaaattgataagcaagggaccaaagttaaaaaaaattcacttgtataattgaatgtaatgttgtgataacacacccccacacacacacacatgcatacatatgctctgtatcccagaacagtaggtcactctaatgtctgatctaatgagatgcacacatagacatatgcacactcttttttcagttattacattgtaaagtgctatgatcagagatacttttcatgtgcacagtgaatgataattttaacacactttcacacaatacattagcccatgtgagtggcacagcattcctgttagatagccaattgaaaagaaaccaggcgtagggaggggaagatattttcctaaagtcctccacctagggagtggcagggctgggactagaagccaggattctgcattctcagaatatgctgccttgtccccagattccccagatggctgcagggccagaactcatcagagtcctgacaagtcttccaggcccagatgaagaacatataacagcagtgtagacaagctccatggattatgcttagaatttataaagaaacaaacaaaatccaactgagactggagtagaagagaagaaatatctacttctgaactattcattttgtttttccctcctatcaagcatctcacaaacagccagatcctttaccacaattaggttactgggaatgttaggtttaaatagtctgctcttgacaccttctcagagttgcttaaagcccctccattttacactgacgagtagggagcagtgttggtagaatactgcagatgcacacaaaattacagctgtaaaatcagttgaagaatctgacaaatgcctttctttgtggttcatccacccactttaacaatgtggaccaaaaaaggaaaaggtctcaaagctatttgattgacatctacaaatatgctgccaagactggaacagagtaggtgggatggagtagatggggttggggtaggtcttctgaaaaccaaaagaataaaatttattttctttgctaccctgtggttttttgacactgaagatctacagtacaaccccatagtatactgccttgtccttgccaaaggttctagggtccctgagagagcaataagtgagagaaaagtatccagagaagagtagaagctaacgatttagcaacctataactctgacagctccattgcctaatttctggagttacttgttttggcataagaagcccactttataaaaattccagatggagatttcaattttgtaactacatagaatatttcttctttttttctttttttttaacttttattttaggtttgggggtgcatgtgacacgggggtttgttatacatattgtttcatcaacaagttataaagcccagtactcaatagttatcttttctgctcccctccctcctcacaccctctcctctcaagtagaccccagtatctgctgcttgattctgtgtgttcataagttgttaacatttagcttccacctgtaagtgagaacatgcagtatttggttttctgttcctgtgctagtttgctaaggataatagcctccagctccatccatgtttctgcagaagacatgatgtccttcttttatatggctgcatagcattccatgggatatatgtgccacattttctttatacaatctgtctttgatgggcatttaggttgattccatgactttggtattgtgaatagtgctgcaatgaacatacgtgtgcgtgtgtctttatggtacaatgatttatattcctctgggtatataaccagtaatgagattgctaggtcgaatggtagttctgcttttagttctttgaggaatcaccatactgctttccacaatggttgaactaatttacactcccaccagcagtgtgtaagtgttcccttttctccataacctcaccagcagctggttttttttttttttttttttacttttaaataatagccattctaactggtgtgagtacatagaatatttttctatttttcaaaagaaaaatcttttaaagtacctattcctcataatatatggaaattgtctaggccatctaaaaattgaaagggtcattctaggtttctccaaaataatttttgtatatcacatggtacagaaagaaacgaagaaaacaatctggatgtgagcagtattcttgggtaattgcaaccaccacttttggaacctactatatacctggcaccatgaaatattttataagcatcagctatttcatgctcacagcaacctcgtgagatagatttcgctatctccatcgccatcgtcaccactatcatcgctcccaggattgtactctcaagggctcagagagaatgccaaacacctgtggctgcacagccaatgctggtagtcatatttgaagtcaggcctgcttggtgctctttccactgtgcaatttcactggttcacttgtttaatcaccttctaggctcataatgtctctgagaggttgataagattaaactgattttatggagaaggaaatttcgtcccagaacagttaaatgacttgctcaagatcacacagctagttgttgagggagatgaaatttcactccaggattcttggattacaaaattcaaaccttttttaataccctgtttgcctcacccacataaagtttcaactgaaatcttattaattgttaaatacgaaggaaaaataacaaaataatcttaataatactactttctagttctttggcattatgtgttttctacacatattgttatataacacataatatatattgttatattgttaaatcttttagatttggtcttcactcaatttctggagcaaggagacaggggagggagccattattgtcctagagaggtcacagatgtggggcatccatttctgagtggcttaagttccagcgctctcactcccctgtcatgtgacttgatgaatttatttggtgcttttctgagcctttgtttcttcatataataaaacagagatgatatattactcagactctgtagcgaattgtgttgtcaacagatgagctcatgaatgagctttgcagtcacctgctctcattggttctctttccatgttagaagtgaggaaagtcatgcccaggtgacctaagtgaggcgtcccagctcacacaggtaatagtgttgccaaagctcagtcctgtttcttgactcctagttgagtgctatttttgctaatcttggccattatttttcaaaagtgttctgtcaatgcagtttaaatcaaaagatcaactgccaatgctgtcagagagcgatagacttaaaatcaataactatgtgtgccactcctctcctaattagatatccccagcatgtttctggatgtttcatgctgctgagaagagtgacggcatttttccactcaattatacccaaggaaacattgttcaatttagtaatagttttagcacttgtagaagaatttgaaaactttagaaaaatctcatacgttttacaatctcactgtcttagagaatgggatttgggactaggtctaccctttatcttcatgcttttatgcagcgctttaaaattttgatattgaagagggcctgaaactgggtgacctgtgttgccctttactactggattaaaatttcaggttgctactatggtaaccgtaccttgaaaattagatcctgacagagtcactaagaaatgtaaaagtgcactgctgccatgaactttgaagaaaggttgcatacaattgtcagcgacagcctcttaattgaaataatctgcctttcccatctgctagaaagagtttgtgtgtcttggggaggagggacaaaaagattatatcttgatggatttttaacacaaaaatggctgtagttcgaagcagagctgttttctgcatgagatttaaatcaacttcagctcaatttatgctattcagaaagaaatgtgatactcagtattcacggtggcaagaagccaagatacacagtaaagatgtaacgatactaagagaagatactgctggggatctatcccagaaaaaccccagtggccccagggtccaaatggcaacctttttcaaaccacagatttctgtgcccaggcttctgggaagttggggaatgcagagcagccgcatgacagactttcagatcaagagggccagcagtcactgatttgcttagtggcataaaagctgagatcatattgatgctcccagagccagggaaatgaaacaagcaacatagggtctcttggctttcaggaacatgagggtgagtggcacttgcaatttcaggaattcctttgtgcatgtctttcccaaggcaagcacatcacggtgtgtctggctttataattagttgtggctgtatctgtgtttccataacaggacttttgttgttgttgttattgggcctttttcttttctttatttttttcgacattcttataaaaggattttgatttgtgcttctaatgccacacatagaaaatgactctttaactctctgaaggtctcaaaaatttcagaccaaaagtgatgttctcactctgagaatgttggtatactattttgcacaaaacagatatcaaatattaaatctgttggacaatatcaagtagttgggactgagggatgtggagccataggaattctcaccacctagtggtgggacagtaccttgaggggtagttctatctaaagactttgggtagaatcgcctctcacctcatttgcgagtctcttcattttggtttggtcagcatgggtactaaggagactgtgatagtgacgactgaattgtgatatacttccaaacccaagcaatgcccatgaaagcccaacaaagacatatcaccagtcttctacctgtgaggactgtggaaccacaggtagcaggatgtttgactctcctgaacataatagtttcacaaatctatttacctgagtggaaggggtggtatccactcccctatttcttcagcagccggtacaggaagaacctactacacaacagataaccagaaaatattcttgagtgtaaagtgaaagaatgatccagaaggtgtcacttgctctgaagtaacttttttttaaatattgtattcttatatttgttaatccatattttaaaagtagtatcgtaagaagaaatataaatgcatgcatgtgtgcatatgtgtgctcatatgtatgtggctggaaagcaaatacaatgcagaacttgaagtggacaggctctgtgctggaatggctgggttcaaatcccagctccaccatcttttagccatgtgatcttggtcaagttacttaacctctctatcactcagtttcctcatctgtaaaatggtgagtagtaatagcacctacatgatacgattaaatgattgaagtgcttatcacagtgcctggtacgtaggaattttttgataaacacttttattaatcatgttcatgattattgcggtcatgatcactgagtcttttgagtgagtgctgtttgtactacattccaatcttcagtcacttgggaagcctttcactctcttccctgacttgtcccagaggtctccagttggagaaagacctctccagaaagagcaaacctggactacattgaacatttccttggctcacctgcctaccccagtcccagaggataaaaacaaagaatggctagaacgtcttaaatgtatagatatttggtactaggcacagtcttctcgttcttggagctcaacacagcatcttatcccagtcacaattgtactcttagtttgtagttatttctaaaaataaaagctaggacttattaagtgccaagcactatgctgagtgttttatatccactagctaattgactatttacaacccagtgagatgtaggcactaccgttacccacattttacaaatgaagaactgggtttcatgacttgaagctaaatttttatagccagtaatgatggattcattacttgaacttatgtctggttgactccagtaagagaccccttaaccctggccctcctgcctacccatggactctccaatctcagagtccacctggacttgattgtcttgggaaatggcaccacctcctcagaggtagtggagcaaatacaagaatacaagagggagaaaacaatggaggacaggaatttggccagagatattctctgctcctgagtcccaaaacatcctctcacattttgtaaaatcaccactggtataatttgctgagtcataatttttaattctgtggttcacatatatatgaaaaactgcttttgaaatatataacaagcatgttgtcaattttctaatcaggtggaacaaattcttttctttattcccagtttttgcatgcataaaggaagtcgtctgaataagaaaacatgtcaataaaatttcatggaatagcctctgccattctgtgaaataaacattccattcccttgcctgggcaaattgttcctgttgctgcatatctacttctgtttccttggtctaaaaagacacttcagactctgcctttaattacgataaggcttgactattaacccttgagaattaaccttatttttgctaggagggaaggtaaaataacatttaaattggttttaagagtaggaatggaatctcagaagacacactaatgtagaatacactgtatatcaaaatatataagtgcatagttgtaacagtggcttagtaaacatattgctgagtgaactatgaaaaataattcaccaaggtactgtttcccatactcgtaagcactaagttaagagagtaatgccataaagtacatatgcactgtttaaaaatatttgtgtgttttttaaagaatactttcttcaggcccaatagacgaatcattttttcttcccttgctaaaatgtacactgtaaggaatttaactaagtggtatattaagtgagggtctaaaatagttgtagaagataacaattctgagcaaagaaatgtctttagcaatttgattctgaatgcaacataaattaactttataaaatagaattaaaagaagttcagttatagctttccaatttttcatataatttagcatttcatactcattgtgtttgctactggcacttttattataaaagcctgaaactgcaggtcaaatgagtacttatgtggatataaatacactgatttttgtttttcagagagagatctttctctgaacaacatgatttatccaagttaagagactacctctgtggaagagcaactctcttgaaaaccattcttcacataaggttttatgcaaaactcctagaaacctgttcaaaaattatagaataataggaggtgttcctaagctttcaaccctccaatgctcttgcttaaattttagatctcaactaaagtaacttgacttttcaaattatgtttcaattcaggtttgttgtcttttaattccatattaaaaagtttgatgagattaggatgagaagagaggggagatgataaggcagttcattatgcacatcaaagcatttcaaaacatatctggtttaaagccattaaataatttcccaaatttgaacctgtggtataaaactctttttttagtctaattccaataacgtaaatgggatacatgaggaaagatttcaaagcaacgtttcttataaatagaatttcaatagcttctccttttaaaaggaaagcaaggggtaaagtggatgaatcatgtcagtctcccataatgagaaaacagagaaaatgcacattcacatgcccaccctattatggtgtagtttggctgcatgatggttattactgaatgattataatacacaattttacatgggagataaaaagaaaatcatatatagatgttttcccacttgaagcaaacctctcacagaaattctagcatatatttccatacagataaaaaggtagtttttcacccttaaaaagaatccttcactttgaaaatgattcaccatagtttccctctaaatagtaagctcatctcatgcatttacaatatggtttgattttcaaaacatcaatttacatgcactttccagtaacaaatctattgtgccatgtgatgcttacttgtataggataaaaaagcaaaagtattttttctaattaatacacaatattataatgtacaacatacaaatatcaattcgttttgttcaaactaataataagtacttggaaatggagatgcaagaaaaccccacttcattcacaacagttatatggatttacattaaaaaactataaaataacaccgaagtacataaacaaggtttgaaagaactagaaaggtatatatgttctcatagcagaagtgttatagtgttatttctcccaaaattaatttataatgcaattccaattagaattcctcaaaatgattctttttggcatgagacaaattattgtatagttcatatactaaaagggtaaatgctcaaccatagtaaatgaaaagaaagaacagtaggaaagattttcattactagatatatgaaaaaactacaatacgctttaacaaaatcaatacattattagcatgaaaatagatactagatcaacagaagagacaattcaatctctctccctatatatgtatgtaatatgtaacaacagcattacattgattcaaagagaaaaaaattgatatgtaatgatgatactggcactactagatctccatttagaagaaaacaaaggtagtttcctatcacatttaaatatattaaagtaggaagagaatgagaaaaaataactaatggttactgggcttaatatctggatgattaaataatctgtacaataaacccccatgacaggagtttacctacgtaacaaacctgcacttgtacccctgaaattaaaataaaagttaaaaaagatacaaatataaaatataaaacaacaacaatgaaaatacctttagtaaaaatgcttggaactctgtttctacaatctaggggagagggtccttcttaattaagtcagaaatccagaagttctaaaagatgaataactataaacaactgaaatataacatttgtattgaaaaagatgccatgtttctataaacaaatggaattttcctacatacaatgaaatgaaagtttgtatgaataaaaattaagtttttatgaagaataaaataaaaacagaaaaacaaatgtagacaaatatttgtttaaaaattattaaaatgtataattaaaaattaaaatatttaattaaaaattaaaaacactatatagcacatctgacatgccaagcagtattctaagctctttacctgttttatgtcgtttattcttttttaattaattgatttatttttttattatactctaagttctagggtacatgtgcacaatgtgcaggtttgatgcataggtatacatgtgccatgttggtttgctgcacccatcagctcatcatttacagtaggtatttctcctaatgctatcccatgcactttccagtaacaaatctatggtgccaagtgatgcttacttgtataggataaaaaaggagaagtatttttttaaaaaatttgagtcgatagtttatagtttgcttgtctttaatattaactatttatagtccagcagattttgctaacacaagttgagatggagatgccactggctgcctaaaagctaattctgtaaagctcattcttgattatcaaaatgccgtatttcagcagcagccgatcaaatacggccttgttcttgttctcatgggaatctaatccttgagtcccttctttccccttaaatttgtctggttcacagacacattccatgagctgaaaatctaacaataaattgagaaaattagatcagtttgcataacatttgaaaaggaatgtagcctttgtttgcacagccaaggtaaaatggacagatcagtaactggaagtgtggtgtagcacctcacagaacatgaattctctaaagaaccctggcaacccatgtgaaaatgttacgtggaatcatcattttgaatagagcaaaatgacgctggaaaagagctagggctgagctgtgcagcgtcatttgagatctgtgcatccagaaactataagcacatcttgaatacagaagacgcacctccctgctttcacggtaatattttaaatagtgtgctggctggctttgctttttaaaacaaatgtgtttaatctttgttagggtgagggtgaaaccacacaagaacatttacagcaatatgtaaattgacattatatggcttttctactctcctaagaaactttattaggggaagtcactttttttctgcatagaaatagcagcccctaaaatatatctaagcagttaaggcttcaccccaacagcttgagtaaacacatttttttaactttcccatggacttcaactttgaaggttttacataaggtaattctgaagtggttgtacagagttaatcctgggtcttttatttataaagcattaatttcagactttttaaaaaatgtaattttctcagataatgtctgagaacaaattgagcttctaagatttaaaaagaaaagatccaattgtgtttatttgtggccaccaagcaggtcagtgggagaatcatgtatgtgtcactaagtgattattttgagaaattgagtatactgactcatcttctaattgaaaattgcgttgctgctgtgcttttttaaaagttacttattaatatcagacaactttccttggaagcttaggctatatggtcttatttatgccatgcaaatgatgtgaatagttgaggcaaataaaatcagaggaaaagaaaataacctcatttttctatcaattatgtgtatgtgtgaggcaaaattattttaagtgtgaaatatttagattctctttttctaaatcctttatcatgaaatagttactatgaaatattaattggtattcagcaaaaaagggaattatatgatccaacatatttgggaaacagcgggttaaaaaaaactaacaagtcttttcattgtaggaattctttgagcctttaatatgcaaatgctcactgtgtttctacaagaggggtgtagaatatgaagtgtttttcaaactaacttggctatagaattttttttcccagaatctctaccaacatgatgtggaataatttgggcctctccaatctagataactacaccattatagagttctttgtgcataggtagactcagcttcaatatctacctggagtatggatgctcattatcttttatcttgccatcttcactccacctttactccagttgccccgccacatctgaaaatacattttaaatcaaatatcccttataggcagcttagtgaaattacagataatttgtatttcaaaattttgggggctttatttttgtattgataatatggagggtgttctgaaattccaccaactttcacccagatttcttttgtgaggagccttttgtctgtttttttttcccccctcagaccacctgcaactgtaagttgtctccggggtggctggctgggatcatcttccttcactgtgaagagaaaagctggctgaatagagacaaaaacactgcatactcactgaacattcttgggagataatttgctgccatgttttataaaaccagggactggatgtgcttaagagctttttattaaatattgccaagagagataatagtcctattatccaggtgacttttgagaccattctgaatgctagtattattgaaaatgcagtaatgaagtcaactctcaaatctaagcatgtggatcgtccacttcagactgtgtcttccctagctggcttgttgaggccactcagcccagctctgggctgccttcccctgccctctgtgggaatgtgttttgagaatgcaaacacgcataacattagactgagaaaaaatgcaattaagaagatattttttaaaaaatgatgggaggaggtgatgcgttatacacaatccagagtctaaaggaaaggacttcccattatgccctcattttctgtgcactgcttggctctattaacgccagtaatccagagctgatacagtccctctgaaacagccaaattatattttcaacaaggccaagaatgtgtcctttatttaagcactttcttgataactgatctattatgagaagcatttactacatagttaaactggcaagaactagaatttctggttttctgatctacacacttaaagcaaatacgtttctgtgtgcacagtacttcatttaattatcattttaattactttattgacttaaacattagtattgaacacattttacaacaacaatgaatacacaagcaatttataattttcattatttcttatctcattcacattatctgaagcttgatagcagataattatttgattgaatatgaaaacacccaaaatattgttgggtagcagatatgagctccaattagttgactctttcttccctcaccaattacatatttttttatatttatttctggtatatacttaatatttataatacgcatgtttggaatttgtacacagggagatggctcagtgattgtatttggactatattgtaacagctaccttatcatatctatgaagacaaatattgaaatttttatttctggaattaacattttactttagagtttctcattaatcattacttttgtttattttatgtatggtgttagagacatgatttgaaaatattttttctcagcaaactgggtagggttaaatttagaaacttgacaatagaagaactatctacagaaaataccaaagatgaaaatacaaaatgctgagaggctggtacaaaagtacagtttacaagactgtactctccttgaggttggaagttgctggagaaaagtggctgatggtctcacacctcatctagctaaactcactttccattatcttggttacctgcgctatgaagtggccattcaactttatttaatgtttgcaaaatctggctgattgattgcctattcactgaggtctggggaacctcagattgaaacattatccaggcagtagcaacatgtactttttcaagggcatttaaaggaatactagtaaacttctggtgggtattcctagtctagatttatggttattctttgaggaaataccaagagtaggtagagatacctggcttatcttgtaaaattgaggtaatcattttgcagggatgcttttcactgttagttgagccttctcttgctgttgcaattttatttgtccacagggagaaaatgggtagggtgggaacaatgctaggaatccgggtagcagtgtgtgaagaaatgtatattttcatctacaaagagaagataaattaaattcttagaagtcagaagattcttatgtttgctgtaagataaaattctgctgacaaatccacctcaggtggacctggctttggggaggaaggtccttaatttgcttttctccccaaattctgatgaaagccaagagaaaaatcaattaaccagtatcaaactagggctcaaagatgccctgatgtggcactgcgtgttcattggtaagcctcagtgtactgtgagcaagtcgtcatcatttggtgcgtggctgatgagagatatttaactcaaagagaagtggcataatcgttgaatttgactctgccagttgacttaccctgaaagcccagagtgtattggcttcaaatggttaactgacacaattttcaacagaatattctcctccaactggttggagatccaactcagtgacttgagattagctgaaaggtggaaaggcttctctgcctctgtaacttctgttttagcaatggataactaggagttttgttggtggtatggttaatatagataacaggcatttcttttgggcaggagagccttgctatttgaggtgaagaccaatggcttgactttcccccaaattccacaaacacaaccatataaacagatttttttcccatgaactccattctagtgtcctagaaacaggtagatttatgcagattaatttggcatagtacagcaaattgctgctgtgagatatatcatagaattacttcctagctcaggctagctaatggctagaatgaaataaaacataaaaatacatttacatagattgttttataagtctgataaagctttttgttacctaccactggaactggacgtgtttttgcaagcagcataagggttgttcatgtaatactttcattatttccagcaagtgtaaaacaaaataaaaacaagaacattgaatttagccgccattaactaccattaactgtaatttttcctgacaagctctctctcatctgatgatgagtgaaacgctgggaaaagtcgactgaaaaattgtataaacgttgatgaaatatgcccttgtattttaagcatgcccagttcagacatttaaaatcgagcaatttataatgtgttagcagtcagaactccatcatgttttaaataaatttatttttctacttcttgtgagactctaagtcactctaagaagactcatgacatttcactgtacaaggcaggtcacaaattgaataatgtgaaataactttattagagaactgaagaaaatgatatggcaataatgtgttttacagtaaaatttgatagccctctaaagatcaatgagtgtgtttgtttactttgaagtgaaaggacaaaggcttcataatggaattcagagaaatgcctgaattaaaggcatcattgccagataaaatggctttcctagtctgtggtgaattcagaaaacctaccacgtactttgcagtagaaagaatagcctaggtactgtctgtgataatatgtcattataaagctgccctagaatgaatgaaagtcctcttgtggccacacagaataaaacaagctgcaagtcacaaggttcttgtcctgtcccaaacattgattgaaagggcactttataaagggagaaagaaacagcgggggcaccctcatttgcatcaccaaaccctaatgatggaggcgcttttatggacacactgtgtacacagaataggttcaattaaaaagaagccattttacactggcctttaccccaccaggattttttcttaaagacaaaacaaagaccatttatctgggtaacaatacattactttaaaaaatgaggcagagtgtagaacatagggtaggcaagaggcgtgggtctcccatggttttatctttgccacttcttttcttagccagtgcactgtagatgtcatgaaagcatatctttgtcaaaataaggtaaatatgaatgacgattggagtaggcaggaatcttgtagctgaccctgactaggaagagcaagattcagaacttcacttgagtttaaaatgaagttccattagcagggaccaaaatgaattgctgtctgataattctggcctcgataaaacgagttgggcatttgagttcaatgcctatggacagatgttccacagacaaaaaacgaggctcttaattggcactaattagcacccttgttggcagggagagattgacaaggttatttctatggcacttcccctgctgactcccatagctgttctttccaggataaggggagagcaatgtaggtaaacttatgctcttagccttcaaggattatttgtgcccccaaacaaagacagtcttcgcatttctaagctgtcaacttagtaagattctttgcctaggatatacattggcttttatttttaattaaataaagtgtaattagtaggaaacaatcaatacggtagagtgacaagcacttttatgttggtttgtttgtccctgcttaaagaagcagaagcaaaaagaaaaaaagaaagaagctgtattaaggatgagaaaaacaatctaagcacattatagatgttaacactagtagcgaacaaagaaggtgttttatactggcacaaattcctgcaacctgctgtgcaatacatcttttcaatgctttgtttataatcaccttcatctgtaaaatggcaaaatgccaccagcctcctgagagggctaaagtctgtaaagaacctggatgtcctggggcataaaggtgtcttataattataagctatctctaaaatgagtagcatgctgaaggaactgtggctgcattctaatatacattaagcagagctatatggaagtatgctttaagtttctgcaaatgcttctctctctataattgcaaagttgagaattatgcaaaagtagttattttgcatttattcaatttagtgctaataaggaattcaaagaatggattaaagtcatttttagtaacttgacagatttttgtatactgtagcatgatggtgtacattgctgaagagctggagaggctcttaaatctagactaagcccatttatttttctaggaaaaccgagggattcgatatccagaactagattcaaagaatgctcatcaacaacgcacatgtggtagaaatcatgtgtgggaatggggcagctggatggcaggttcctgagaagcagagcctgacataggcattcctgtgaattaactctaaagaaaaagaaacctgtaaggaagtgaagagaacaagtgggatggtgggcttggctgcagcttgatcccatgaggagtcctagagcatgaaccaaatcacagagttgtcccacattgaggcaagatggggccagccgtttggctggatactggctgaacgcattcccgtcatttggataggggtttcccatccaagagcaaagtggctttccttctgccaagggcaagtatctggagaagggcccacctggaggtccctggagaaggacccacaatagctagagcatctgtgcaccagtctggtaaaagagatgagggaagggccatgctaccagccttcactacagggctaagtttggtagagccaggtagcttcctatctaagcaaggccttttgtttcctgagcaactttcagaagagcacagtgttgactgagcagaataaagcccatccttagatagtgaaatttttaaaaagtatcctttgataattagcaacagtatgcacatagatgagctaagcaatattttctttgatgcgaacagtccttcttgaagtacaagaaggcaacacagatgttcattcggcttcttatgtgttcagatactgtggaaacagaattcccagttcctcaaacaaaacatttcattcatacctgtccatacttgcatgtgcctcctgtgtcatgcctctctgcctgtggtactctggaatctttgtcttctattcacttctcaagattgcacaccagcataaattcctaggtgaagacttcctagaacacaggtccacacaatgaaaaagtcactacagaggctatgtaaatactccaagttccaaagacaaagggatttccagtacttcctcaaggccatctctcatagcttagatttcctgtccacaccctggaacctaaagcctaggctcctctcagtttactcacactctttgcccctgaaggcattttccttgtcaccaagcacctactacaattgaagagggtacagtcagtcccaagcagccctaccaggtttctcttacctcctcaccatggatgcctggtatcccttcctcatcagcattctctgatgctgacactggatcccatccaagagccatacactgtgctggtacatcacaatgccaaccaccctttttacatactcttaaaacaaccaccaccagattcccccagctcttcttcccccaaggccacaaaaatctgcagactccatgcatcccaatagtgattttcagagactgtgacttctgttgcccttgaagaatcctaattaggggaattgcctggccgaagttatgctttagaatgattactgaagccatagtgagagatcttgaaggcttgaaataggtagggatagagaagagaggacagactggagaaaggtatgatatctgtgttcccatcaatggatttgagtaactgacaagatgtgtgaagtgggaaagagaatagaagtgttaaaatgatcaagcttgcttgcttgataatttggataggtggtaatacaatagagatatcttagtcaatttgtactgctataacaaaatacctaagactgggtagtttataaagaagagaaattttatttcttcacagttctggaggctggaagtccaagaccaagacaccagcaggttcagttgtctggtgagcacgtgttatctgcttccaagataatgccttgttgctgcttccctaggagggatgaatgctgtgtccttacatgctagatagaacaaaatggcaaaaacggcttaacaagttccctccagccttttataaggcactaaccccatgtttaagggcagagccctcatggcctagtcacctcctaaagggtccaccttttaatactgttgcactggggattaggtttcaacatgaattttgaaggagacacaaacatgcaaaccatggcagatgcaaaagtaaagcagaggaattaacttctgacacattctacaacatggattacactcaaaaacattatgctaagtgaaatataatatgctaaaagccacatattatatgagtcccttcataagaaatatctagaataggcaaatcaatagagacagaaagcagattagaggttgcccagggatggagggtggaggggatagagggattgggagaatgatagctaaaagttacagggtttcattctggagtggtgaaaatgttcctgaactagatcatggtgatggctggacaacactgcaaagatactaaaaagcacagaatagtccattttaaaagataaatgttatatgtattttattacaaaataagtagatagattaaaaataaaacaaaataaatgaaggaatgcatacatacatacatacttaaaccagtaggagggacatgccagagatggtgagctcagttttagctttcttaggcttgaggcatttgtggaacattgtggtggaactggatttaggtgccaggagctcaaaagagcgttatagctgtcagggctgtaaatacattgcctcagcccacccattttggagagctgggaaggtaggaactggggcaaagccctgtattagtttcctggggctgctataacagagtaccacaagttggaaggcttaaagcaacaggaatgtcctgtcttcctaacttccagatgttagaagtccaataacaaggagttggttccttcttaggatgtaagagaaggatctgttccaggcctccctccttggcttgtagacatctgtcttctctctccctgagtctcttcacatactcatccttctatgggtgaccgtatgcaaattgcccctttttataaggacaccagtcatatcggattagggatcaccgtaaggacctcaagaccttatctccaaataagaccacattctgaaatactgggggttagggcttcaacgtatgagttttaggtaggaacgcaattcaccccctaacaagcccatttcctgaatttcccttttctgaatggcagcaattttaacgatcctccagttgcagtagtaatcagctgcacagttctgtcccatcctacgtagagggaatttaggggtacttacccccaaaaccactctggagcttccgtccattcttctgcaatctctcagaataacatggacttagggagctgactaagagtcatctgcctgcagtcattttcaaataacattgttattgcaattaccaagttgagaaaagcctgcccaaccactacttgggcaattgataaggtaatgaaaaaaacaaacagatttacttttttatgtgaagacaaaatgtttgtaggaagcagctctcacattctttgtaagcagctctgctctgtggattttctcagcatctttgaccaagcctggcttgtgaccatcttgttttcctatggtagttcattctctgtttctgtggtgggacactgtgccaagagaactcgctcaagaccaagagacagatcaggctgttgttccacattttctttccactaaatcacagttttctttcaagggaaggtggctgttgtgaagctgtcaaactagctgttaaatgggttgaagtgaaggctcctattaacaacagcagctatctctgtcacattcaagttctgcagacagttacaaggcaatttggtcctgataggtgggctattaaaaataacaaaaggcaagaagaatgagagaggaacaccctttttacttcctggtttcaaaactaagggggcaactgaatatttcacacatggacctagcctgcagttagtgtggccttcataatctcacagggacaaggcatcctccctccctgggtgttttcctttagccaggtctgggaatggaaggtggcagtgggggagacagcaacaaggtctctatcaagttcaaggtggccaaagagttctgaatgctgatcataattggaaacagtgtcactggtgagggcagtatgtgtgctgtgtgtgtgtggttgtggggagcgggtggggggcagtgatgatgccctctgcatgagaaaaagcagtgtggacagttttacagtgtcatatccaagactgtgaaggttagacgacagacaaccggaagagaattaaagggaaattatctctcagcttaagggagccccaacttaaattggatttgtgagttaacatttgccttactgtgggagttacatacccgtacagggccctgataggagcctggatacctaacccctcgtgtcatggtttggaaaatcaattagccagtgaaggacccggccttgcgtagactcagcagaggagaaactgctgcaacccaggcagtctgcacctctgaccagcaagaatggacacatttttcttctgttgaaatagattcagagtcccattttgcctgtgcttaatgaattcatatataacatgatccttaccccagcttcttctgtaatcactaaaatgtgagcctccttccatcagccctcacatcgtattagagcaactcatccaaattggcagcccacattaaccacatgcctgcctgtgggttttattgcgaatgggggcaggtgatttgtactgttgcgaggaacattgcacagacagattccttctttactaccctcaggtttggaaattccaaagtcagggaggaggagaagagtctttgcccacaggatcttggcttggtctccaccccatccagacagctgtctctttaatataatgctttgtctctcctggaaaagacaaagctcttttcccttggtgaggcttctgctggtcatatcaattgcagttttaatgtagggaaaaaatacagtgagaaagagattaggcaggaaaaaatagctctttttctctgtgtttttcttggcagatatgtctaggaatgcattggagaccttctgccgtacttcgttatgcaggacagtaagcagagtggttagggacatgggctttggaatcaggccactgtggattgccagaccagctctccgttcttctcttgtccagctgtgagacttttttttttaaaaaagacggctctatttagatgcatataacataaaacttaccattgtaaagtatacaattcagtgttttctagtatattcacagagttgtgaaaccatcaccactgtctaattctagaatatttttatcaccccgaaagaatcttcataacattagcagtcactccccttgccccatccccccaagccctggcaaccagtctctttcagtctctacagatttgcctgttttagacatttcatatgaaaggaatcatgtgatatgtggcctttggtgactggtttattgcacttggcataatattttcaaggcttattcatgttgtaccatgtgtcagtactttcttcctttttgtagctgaataatcattcatttcatggatctatcacatcatgtttatccattccatcagttcattgacatttgtgctgtttctactttatgtctattccgcgatggttaatgatgttgagcatcttttcatctgcttattggccatttgtctttctgtgtctgtcagtctgggctgctataacaagaatcccataggctgggtggcttaaacaacaaacacttgtttctcacgtaagtggtggttgggaagtccatgatcaggatgccagtatggttgggttctcgtaaaaaccctcatcctgatatcctcacatggtagaaagagaatgaaaggaagcaaggtctcttgggtctcttcttagaaggtctctaatcccatcatgagtattcaaccgttatgacccagtcacctcccaaagactccacctcctaatatcatcacattgtggattagagtttcaactctatatgactttgagggagggggacacacaaacattcagtccacagtggtatcttctgtggaaaaatgtctattcagatccttcagccctcacatcgtattagagcaactcatctaaattggcagcccacgttaaccacatgcctgccttcgggttttattgggaatggggacaggtgatttatactgttgagagggacattgcacagagagattccttctttactaccctcaggtttggaaattccaaagtcagggaggaggagaagagtctttgcccacaggatcttgccttactgcaggagttacacaccagtacagggccctgataggagcccggctatctaacctctcgtgtcatggtttggaaaatcaattagccagtgaaggactgggccttgcatagactcagcagaggagaaactgctgcaacccaggcagtctgcaatccaggcagtgtgcacctctgatcagcaagaatggacacctttttcttctgttgaaatagactcagactctttaattgggttacttatcattttattgctgagtttccagggttccttataaattctggatactagatccttatcagatatatgacccacagatattttctcccattctgtgtgttttcttcttaacttttttaaacctgaatttcctcacttgaacagagaaaataccagtataacctcccaaatttcatggagagagtcaatgaagtgatccattagcgcacttagagaaatgaatgtctggcacacattaagcttacctcaataagtcttagttattattagctagtattggctgacttggatttattgtgagacagagacaaggtgtaagccctcaagtcataattgtacatctgacaggtgtgatgtgaaaggttcaaagtgctttgattgaactaacatgttattcctaggatgattggagcaattttatttgagggactacatttttattctgaatagatttcctagttctagatattaaatactaagtcttggccagtattggggtctgctattctccacgtatctatatttacagttctttctgattctatctagacagctagttacctatctatcaagaaggtgagtctatgaataataggatagaaatagccaagttctggggcaagtactcagaattggcaccctcttacctgaagccaaatcaggaaagagtagagctccaatttcacaagatgttcatccactatatgtaaaacctactctcatgtctctctgttgttgcttaaactgctttcttcaaccagagacctggtgatttcctctacagtgattcttttaaggctgcttctaaatacattgatataagaaccaggctccagtttgccttaatatcagtaatagtggaagcagtggcatttatcaagtgctcacgacgaactcttttcacatattatttcagctaatctttgcaacaaccgtccaaagttgttataactagccttgttttagagacgaaaaaaaaaaatggcgactcagagaggtcaattagtttgcccagatttgtacacttggtaaatgcaagagcacaggctggacctgtagtctattcagctcccaaccctttgctatttcctttacacattgttacccctaaggaaattgaattacagagcccttgattgttagacaactgagttatctccgtgtttcagaattagaaagccaatcctgtctaattcattagtatatggtaatacagaacagtttagataagtgtgtcatttgttgacagtggccctcccttttcttgagaatcctcctctccggttcagtttttctttatgagtcagtggcagtgctaagatgatggccttacatgtgttcagcagggtcacaggaataagaaagactcatggtatattggtgagctacagagaattcatttgccgcaagttgaaatttggagagagatggccaaaatgactcaacatggttggctttccacatcaatgtaattgtgccatgtgctataatttatagtgtaaacaagtttcctgcaaaagctaaatatatcatgcaactcatttaacatgcacagaaggagccattaaattatttcagtcccgttactcaaaatgttcagaaaattcctctgtattagagccagtgcaggattggctctgcagccaagtgcatcaacataaatgttgaattctcagaaggaaatgcatgcctcatactgttacttagggaaaatatatgcccagacattgtggagccccttctaaaacaatcctcattttgttaaaacaatactatcaaattttcaatcaggttataaagcatctctgcatttataaagcttgcagacaattgtgaatatcaataaaaaggtgatgtgtttttaaaagattaataatttatgaaccatggaaatggaaactgaggctttttatgtcattttctaattttgtctacctacgtggagagaatgccttgtggaagccatatgtgatgccttaaaactgtttaaattggagtaattatcagaacaaatggtgtcattggatgatattagtctgtttgtgttccttctgtctacccaatgaatcaacattaatacatatttttaaaaacatttgaaacatggtcatctgtggtttcttttttgttttaaagtatatgtttaaaaattgatctaaccttccatacatactaaaatataccttagattgagagtttgcagttacatattccttatgcaaaaagggagtatccttctctacttagctgttaaagagtttgggtgagggatggatataaaattttgtcaagtatatttttggcctctattgaggtgatcatctggttttcatcattttatttgttgatgatgtgctttgttctacaaatagacatttcattatcaaaatgtttcagcactcctggaatgatactagattaatatttgatgatatatagttcagttgcattttaggtagatttgaattttcaagatttgaaaaagttgatatagtaatattaaaaaggttctcattattaaaaacatgatctacttctgtttctggcatgcaaaagctatttgtggcaaatatacagttattttccttctttcgatttttactttaacatgagaacacatttctctagtttgccttgtttccaaataaaatgacatctgatgtgtcaggataattcaagctcaactatcttgagccaataatcacagatgataaagattgggtgattcctacgtgctaggggtttgaagtgagatattgcatttaatagttatagcaattctataagacactcagaagttcaagggatttgatctgaggtgacacagatagtcagagtttgaacttgggtctatctgactgcagtgcaagctctattgctacactgagcttttcagtgcactcagtagccacacacaagtcaattagctttgcaaagtggaaagttactggtctctgaggactctgaatattggctagttcttatggatgtgtgtgcccttggacccaacatgttacatgatgagctctggctagcttagcatgcatgcatcaccccagcagagaaacaagtccattcgctattgttctgtttatggtaatgatactaccagcctttgttagaatttaaatgtggacagcacattcacaatgagaccttagtaaatgagagttatgttcagcaggtcaccaggatatgaaactcaggtcttgtaaggagtagttatcaacttacagggatgtctggtggtgtaggggagcacttttaccatggcaccctggagaacctgcaggtatccaaataggccacataagcagaggcttgaaccacagctaatctgagccttggtggaacatccattgatcctcccagaacaagagaggacaagaagattgtgagatgtactttaaggccatctcccactcacttccctatctcctttggaatgctatcatgagacagtttcccatcacctcccaggttctgttgaggagttttctgtcctgccctccactgaatagaactctagcctatacaactgctaagccaaagtctaaaattgactcctcagctacagtgtgtcctataacttggtcttcagtcatctggcctcttttggttggtatcctcctttttggtgtgtgggacaagagtcgggggtcagctggcacctttggcaattcttcttttattttatttcaagcctagtttagtaagtactaaactatctgtatctaaaagtggacctgcatctttattggttgaattagccaggccttggccttgaccttgccctgtcttctatgtgtgtgttaacaggaggtactcatactcatctgctggaatgctcacaggggtcctgggctacatgtgcccaagaaggtctatccagctctacagagttaaaatactgtcaatatgggttagaaagcaatctacctcttcccctaaaccagagtgtggagagtgattttgatgcagccaaaagagctgagcatacaaatcaggtgggatttttataaataactgagcaacaatgctgtcaacattttagttgggcctacattgtcagtcctgaatgttttgctaaaataatctgaaataaaatgtgaattctttatgcatcagcataagggaaatcctatttcctgtgtcaattcaggtagacaggccttcttgacaacctttctctggaaatgggtttgagaaatggtttaaagcactccaagctaaagtgttctgttatcagcagctgaaaatttgccatgcatcacataggactaagaattggtccttgcccccattgagtttaatgtaagacacaatggctgtcagcaggtatgagttgtagtgcacttaacagcgacttagtatttcagttgttttggacagcttccttagatagatattaatggaccaactccataaaggagttatttccttaatcatttgacaattaggagctgacgtgaagagatgagtaatgaagtaccctctgtgattgtactttggaggtagccacaggggttttttatatctaatctgctgtagttgctctaagaagctgaagggagactgagaggggcaattccaaaaggaattctgcctttcctcatcacttgagaatggaagctaaccagtgactgggtttgtctccaaagagaatgctgagtactagagacactcttctgcctgatagagaaagtcctcacttggcatctgagccttatcaaaatgaagagacatttgatagacaggcagcctagtgtgagggaaggctttgatgtctggtggaattcctgatttaaattcagtgttcttagacaaccttgaatgttaggatcatcagtgtccaaattcagttgactccaattctgaaatgtctctagaatctggtctccactatttttactgtctgtgccctgacccaggccaccaacctgtgttacctggagtactacgatggcagtctaactggtttccttgctgcctccttctttcagtcaatctatattctttacttcctgaaatctcaccggcaaataccaagcctcgtatatggtcttgaatgaattcctattcctccacttgaatgactttccatatcacccagtatgactcaaaggaaattctttcaagatgacttgtaccgccctaccaaagagcagaacatcagctatcagggtccatacttgaaattttttttaaagataaaagattctgtgttctcctttggaattatccccgcatttgttttcaggcccaggttgatctactgagttatggtcttctctggggaaattcactcttagatgttttaacacacacacttctaaaaaatgatacaagactgtttcgttgtgagtaacattttcttgaaagccatctgaattctattaggcactttgtcatttgcatgataacttgagttcccacattgggaggacattgtataacccagagaaatatactaagaaaatgaaaatcaaatccaaaatagtgacagtagagcagaaaattggtattgtgatgaatgtatgtgaccaattctaaggaattccaaggttgaagaggtgacagttgattgattcaagtcatatacgtcagggttcatactattagatttggcttgtgtatacaatatagacatagattcatatgtatcacatatgcacccagacaaaaggatagttactctactattctcctactgttgtttgagaactcagcactgtaggctgtcaggctatgtggcactttctgaatctctgagatacatattatttttattcccattgcatagaagagaaaactgaggttcagagagggtaggtaaattaagctcaagttctcttattaaatcctatgcaatatccatggagccacaaccatctccataaaatgaggaatcttaactagatgagttgtttttaagctttgttcctgcaaatccctgggagttaacaaaacaaactactttaatcttatttgaggtttcctgtaaggtttcatttggctacacaagaaaagattttttgagtttaagagtttgaaaatcattggcttaaagcaagggtcagcaaactctattttgataaagacctagatgataaatgttttaagccttcgtttggtagcaactactcaacctggccattgtagctcaaaagcagccgtggatgatatataatgaatgggagtggctgtagtccaataacactttatttatggataatgaaatctaagttccatataaatttttatgtgtcgtgaaatattattcttcttttgatttttttacacatttaaaaatgaaaaaaaaaaaactgttctaaaatcataagcagtacagagacagacggaaggctgctttgggctgaggccttcagttggccaatccctagactagatggcccctaagggaactcctagttctcacactaagaagcccaattaatcttatgaaatacctattttctgaaccccttggaaggccatcagctacagaagacaatctttatcaggcccacgtgcccatggcaggatgcatgtttagaccttgcctgtgggcacagtggttggcactgggctaggggtccacccctgatagatcttggagatttgttcctatagagtataatacagattttcaaactggttgtcactgccacagccctcagacagggattctgtaggattcccagtgaggtggtggccactgaatcaaagttttaagttaaaaccttaggaaaattaaatgtagctcctcctaaggggaaaaaacagcctgagcacctttactgcagggaagaagaatgaattccctgaaaaatatcacctcctcttccttatcacctgccttcctaccaacaaatgattcaatgctgtggagactacaaagcactagataggaaaatatataactctctgagtaattctaaaccagtcatgttttatttcttttaggttactttatgaagaggaagtgccctttaaggagtcaagagggctaagttactatcctagaagagggaccagagtaagactctgcctaatgagaacatgcaagccctctctaggctgtgttattatcctcaaagtcaattgtgtcattcatttgggccatcagaaacttactctgattgccatgaactctggggtatttagaaagacaatgataatttaaaccagtaaccggaagaccccaaactcactgggccagaagttatagctctatgttttagttaagagcttaaaacctgagtgtaataacctcctccctctcctatatgacagaggtagcaacactggttctgtctccaacatcattacaagtctagtctctgagtgtggactatagagagcaagactccagctgcaaggtagaaggtacaggaaagcacgtggcaactcctaactggcagatcattctcacaattaaaggtattgaacaatagaaaggtattgttagctacctatcagaaaaaaacatgtatgaccatatgttaggaatgttgcagttctctccactaggtgacacagtgacatggtgaaagagatagcactctcaagtacttccaactggaagagtacatctgagaatcagtcaccagcattgcagctagcaccatagataccttgaagctggaatctagccagtatcaagtgctgctgtctgccaagaggaacaccattttgtagttcacaaaaaggcactgtgtaggcttgcaagtcctgagaacaactcagtgtcccaacggttgtttctgagcaaggattctggatcaactaggagcctattatgcccagtcttacacgcaaacttcagagacagatgtgtgttggaacagcttcctgagagtgacaggcctaaagacacggtgctcaaggtgagcacaacttcaactggggggtcgcccttggttcatttctctggatcagcaggtagcttcccaggtataaaggtcagaacatcgggaccactcatttttttctgaactctcacttggtacggtctggatgtttcctcttgcaactgtctttcaaatttctgggataacttaagcactccaagaggatctaagaaaacccaagacagatctgatggatttaggccatttctagaagagtaaaccaaagctccgaaactttccaaactcctttatagtctttgaacctctccttatttggtcatggtttccaatgatgtgtggggcctgattcctctgccagcctctaggttaacacatcagcttttaaaaattattattcccacctctacaacaaaattcctttgacaataataataacaatatcaatagtaaccaagatgaaagtgatagctggtagctgtattggctcctaggcaatttgtataaactttattttctaattctaaaaattgtccagagtaggtattattattgcccattttaacatatagaaaattgagattcaaaaggtcttatttactgtattaaaaaaaaatccgttaggaattcctgtatttgaactcaggtctgtttggctctcgagaccttgctcttaagtccatgctgactcaaccaagggcttcttcctgccagccttctataataatgtttcaagccctctatttttccctcttcaaaatcatctaagcattccactatgtaaattggcaaggttttgggagagtgatcttatgattttctggttatcattcacatgggacctgtcatgtcatagtgcactagaatgtttcagtgcaaagagcccttggaggccactaggttcagcttgaagctcagaaaatcaaggacaaagatcttcttttggtccattccatctcatccaaatttcactatctgagcttttataggatcatctcctcagggcaagaacttggttttttgttcacagttttatagattattctatgtctcaatactacaaattataggtcacagtaaaactaaaaacagcatttttacaccaagatgaacattgtggatgactagaccctgaacagacaacagacttcactaaggaggtctaattggttctgttttcacctaattgaaaagttgaagaacaatgtctgttttttttaagatcacacacacaggcatacatttatatgagcaatttttttcacattatgtgtcatgaatttgtctatggaattataacctcatgaaaagagattaccatttttctgctgagacgaccttaactgcattgggtgtgaatggtgctgctataataattaaatctaatatctttcataatcctacgctttccctagagtaatgttcagcattagccaaggatgaaaatgcaaacaagtacatgtatattcaataataaagcttaataggtcagggaagaagtggaatgaaatgaatgcctagttcctccagagataactaatagtaatttgcttcctagttacttctttgacttgtgtttactgggacttaaatgtatgcatcagattttcctttattaacagccaaatccataccaagcttgttgcatggtggggatgtggggaggttgtttaatgtggatcgctgtgtagattggctgcctatttccagaactgtacattggagtgcatttcatctccatgttaaaaatcatataatgttgattggagagtaaaataactgctgagttcagacctctgtgctctgactctggatgtgctacttctacctgaaggagagaaaccggaagaccacaagcacatttctacatctggccttgagatgcccttagacatttcccaagtcatcatggattaccttcagattgttcagaaaattaaaaggagaggagcaaaggcacacagaaacttctgcttctgattactttttaatagtattaatgaagtccgttatttccaactgagatagctttccaaattaatggtgccccgcattattagttttgtgctttcataatgcactttcacatgcattagctcctgttatgctcaccaccaccctcctgtgatggaaccaaagtgttatcccattgaacagatgagggacacagatgaacctcagagctggtaagttaccccagatatcggggtttatgattagccagcaattgagtcccagtatcttgactccatgctaatgttttctgaggtttttgttattgctgtcaattttattgaatataccatcttttataagttgtacactctaggaaaaccttgtatactcccaattctagctggagatgatctaggttccatgtttgtctccgtgatttctagctgtgtgttcacaagcaagctccttaacctgtctaaacctcagagtctccatctgaaaaatgcagctgtaacatcatctccttcatagaagtattgtgaggaccaaattccgtgctgctggtcaaatacttaggactttctctgtctctgaaaattgaccctctaaatgcaggaattatttaccatttcttttgctgaatacttgaatataaattaacacatagacattccctagatgtattgagatacacacacacacacacacacacacacggaaagtaaagccatttataataacaagcataggtagtttgtaaatatttgagttctatagcttatgagaatgatacagtcttcatttcccacaatgtgttgtaaagaattatttgttcagagtcagaagtctgcaactgcaaaagaaataccaagatacattttttctccttctctaagatcttcaaaacatccattagtctcttgaaggacagtcataaatcctgcaaatttagtttatccgaaagccactctaacagttgtccttcccagcaatcatcctttatatcagtctttggtttgccgacctcagtgtacacattctagtgttatgtgactgagcatgaaagtgggggagctgtgctttttttggagagttattggatatccgctctgccctgactctcctttcaatatttgaacataacctctgaagtaactttccccctatttatcaaattagaagcttccttttcccttctggcttctcttctggaaaaacacccaagtgggattacagagatggaaattttaggagtggctccagcactaactattaatagctgggtgagcttcagcaaagcaattcacctctctgaatctttccttccttgtctgcaaaatgaggccagtagactctatcatttgtgggaagatgctgtgaagcacagtgaggtgaaaatgctgcaccctctgccctcatgggaattacggactagtggggagagattcagtggaaagctgtgctgtgatccagctggagctgagggttgggtagaggaaaaaaatattcttcctgagatgagagttctttctagaaagcttttgtacagaaagtgggatcactgggctacaaaggataaataggatttccagagttaagaaagagatttctagccctggagctgagcctgatgcagagcctagatgcaagaaagagcaatatatgcataggaaatggtcattggtccagagaggctgagactgtcccttcttgaagcctaaggatgaggtataaagttatatataataaataaaaatatgaacaccaataggtctttaaagacagtgtagctggaattttaagataataagctattcgtcctgctgtagctcacacttggagaggatgccactggaattaatatccctatagaaacaaaaggctttgtggctccataaacaatcttgaaagtgctagttcatcaccaaaatccagaccactcatttttcaggtgccttgccttaggagagaaagatttcttatccacatcatgggcttacatctctcagatcaaattttacaggaagagatcggtcatatatcagaaggttaatgactagccatttctctcccagctcttttgcggccacccagctacccagcagcagagggcactgaaaggcagtgcaggttcactgtgccttttacctccgtcatccagagagacccagcaggctttgacaacagcctccagagctagggatggttatcatgcccctcttctttcatgggaaactctgagcaccttgtcctgtagagatccagtgccacatcccacatacacagtgattgatcagtacatttattgcacttttagtagtaaaaatgtatagaatccagtcatctctggagatgctgaaatagtattttccccttgatttaggggaaggtagagagggaagatatgtgcaaatatgatataaatataagagctcaaatatctaattagctgaaacaatcttggttccctctacacctttgaaggatttgcagctgtcagattgtagctccaatactttattctcattgcaagatgtatccgaggatgatttagaaaatatgccttctaactcaaacaccactctgatctctttgtaggatgcttgaggatgacctgaagctgagcagtgatgaagatgaccttgagcctgtgaagaccttgaccactcagtgcactgccactgagctctaccaggttagaagagcttagggctttgttttgggatgaaggggggagcaggaggaactggaatggctttgacatgctttgacatgcgcaaacttccccatgctttatctctgggctttggagagagggaaagaagcaaagatgagcatagtgttctggaacaggtcaaatcagttcaaactttcattaaagctatagtaaggagatgcagagctctttaaaactgctttcaaccccctcccatctctctctctgttccatacacaaatgctggtcagtggtaagcaatagagattgtcttgccctctcttggactacttattgtcttgggtgaggtataattttcatttggtgactctggtgtgaggcttggaacccatactcattaatttagatataaatgtgatgcttcattcacctttcccagatgcaccatttcagaatgcagctgagaatcaatacgcaacatcttgccattaaatgaacctttaggcagaagacatttggcaaaaacttgtggctgcccttgtatccttctatcccacattttaagcatttacagtattttaccaccaaatgagatggcaggaatgtgtgttttcagcatttcaatgagactggactttatgatttgaaaaggccaagtatcatgtatgactcatgagaacggcaacctagtgtgtggtgtcaatgatgcttgcacattttctccttgagagagaactgtctcgaatgtggggtccttctgggtgtgcttatcacctcaagtgaggaatgcagaaggattgcctttctttaaatccagtacctgaccaagatcttcctacagtgaagtctgctacattataaaacagactgtttaaaggaatgctcatgcactcgtatttcaagagagttaacaaatatggaattccatgttcattgaacatttcatgaggaagagcctacaaagaaaagcttaggaaaaattatcaaggctcagctactctattctcatctacagctgtttaccacactagaactcctaccattctggtatactttaaaaataaaatccatcttcaacgttatgtggccaaaacttttgtctactttactttctccactttcttgtgcttgaattttaataatatgtaaaaaataattgcatctttgcaagtttagtgctttatcaagaacaaccacagggtaagtgcagactacatagtgctggcctaagccaatttcacaactgttccccaagggcttgctgtacatttactggatgcaagctgtctccctcctgcttgagttgggcttcatagcaaatgtaaaatgtacacttcatttccaaaaattgtcatttctccttcacacatttaatacgccaatagcaggagcatcatatttgtaagtaaaacaaaagcaaaaatgaaaacattctagatcattgattttgacagataaaaagttgccttttaatggaaatgtttaaagtagaattcaataataattgaaagtagattttgcacattgacttcctctttatgtaattatatgaatgtaatctactttttaacttataaagttattttctgtatttatctcaaaattggcaaagggtctgttagcctgaatcatctgagttttagggtatattcactgactttttgtaagtgctgagactctcagatgatcaggattggtgggttggaacctttttatgacatgttgccgctagtcatgatgtcttcctcaaaaaggcttaggttctcagtgaaaatttgatggggagattgaactaggggctctaaggtgaggcaaaatgacaacttattccctctagctgagtcctaggagcaagatgtaggcacaaggttataaacatttgcaaatgaaccctccttgtagagtttgaagatgagttacaaggcctggaaggctatagaccaaaagagaatgcttgtgcagtagtggcagcagtaatactagcaatgtttgcagagctctgcttttaggatgcataatgtctttttgtaaaagtaaatgggttgaaataattttctttttttattgcggcaaaattcgcataacataaaattaaccattttaaagtgttcaattctgtgacacttaatacaatcacaagactgtgcatccatcccagttccagaatttttcatcactccaagtggaaactccatacccattaaacagttcctccccatttccccctccccctaaccccgacaactgctaatctactttttgtctgtatggatttgtctgtttcatgtaactggaatcctataatatgtgaccttttttgtctggcttctttcacttaccataatattttcttggttgttcgatgtcatgtatcagtacttcattttgttttatggctaagtagcattccattgtatgaataaaccacattttctttatctactcatcatttgatggacattttggttgtttccaacttttggctactgtgaatagtgctacggtgaagatttgtatataagtttcacatggacatgttttctttctggtgtgtacctagaagtggaattgatgagtcacatggtaattctacagttaacttatagaggaatcaccaaaatcattttgttttagataatatagtgccatgcatataacatagtactgttcactcatctttgaattgggacagtcatacctccagcaccatcataaggaggagtactgagactaccatttttggaaccactcttgctctatgccaggcacaagctaggtgtggtgtctcatttgaaccttacagcaaaccttagcagtaggtttgggcctcctggctgagcaaaagaattgcggagtcattccatttgtggcagaatgattggggagaaagcatacagacaaatgaattggtccataaaactgtgctcaagagcccagacaacactgctggtttcagctgacataatagttagaaatggctcagaacccagtggctgcattcgtgcagacatagtccaataaaaaagccatttactttctggagacgtccccaaatcatctcatccataatcatcacaccttgactcatttgaagaaactcaaattatccaggtgtagtgagtacacagcaatctttttcaaacagtatctaagagcttataatgtgggcttagagcataagcatccccaagagaatacatttcaaatacatgtatgaaaatgaaacacaggatcaagttgtgtcagcctctaaactggcatttgggtaccgagtatcttacaatcagaacagcctcccctttttctgctacttctaccttccacagcagtgttagccatgctgagccaggtgacaggtcatgtgcacaaacacaagcagagcaagtagggtatgtttaaatgctaaatattattccctcaaatgggaaaatggaacatgagtccagaatgggggaattataatatataaattaaagatgccaaatggtcagccatagagactcatgatcataagaaaacatttttaacagaagattttaccttcaaatgactctttaaagtcagagatatgtaatcacacatgtacatggcttcaatgaagacacgatagtgattgcagcctgaaaatacctgttaaaactttgtgttttctctccagtcctctactgcatttgactttcttggttgggactatttgggcagcagacatatgcatgctgttttctaaggtggtgggacaatgctgggacagtgtaggagagcgtgtgagagtatagctgtatagttacacggacatggctttgaattctagctctgccactctgaaactggttgaccttgggcaaagacctaagtacctataaaatagaggtaaaaatagcaccttcttcattgggtcatactggggattcaatgattaggtcaatcaatacaggcaaaagcacctgatgctatgcttagcacatagtaagtactcaccactttacgtgataataatcatcattgttatgggtgctactaatgatctaaaaagcttcacattctttgagatgctacatatatttactttcccttttcttgtaaggaatgggatgttaaagacagctgctgggttttctatcctgtatatggcaaacttgaatgaaaatgtctgtcatcctaaagtttattagctgtgtgcctggccatgagtaattttaaatgtagatattaagaacatagtttttggaataaagaagcctggggtttaatcccaggcctcaaatactagctgtatactagctgtatggcattgggaaagttgtttaacatctctaagtctcagatctcttaccagtagactggaataaaccagccttgtctaactcatggagtactgtaaggatcaagtgaagacagtgtataagaaaatgccttgaactacaaaataggtggttactcttccttgtggtccttttaaacattaactggcagccctctctttaggatccatagggaaatagacatagcccttcattttggcctaggtatccatagggatctgttaggaactgcattgcatgtcttaactggcccccaaaggcagccatcagatatgaatgaccttaactttcctttaagccctgacaacttttaaactagagatcccagaaagaaaggctaggttgccaatgatctgcaccaagtcctccaggaaattatgtgtctccaaaagagtttttcttccaaggattggcgtgggtggagagttgattcatacccttctattgcagttcttaccttctctttctgagctcatgctgtcccctagagaaaggcttgaaggctcttctaggatgctatactcaccttggctgtctctcaggagctgtccctgaatgggagataaataactatttgaagttgacattagacattgcaaacatccagaacagtgttggaattagacatagtgctatgtacttagtgtctgaataaacatatgtgctgcaatgtattttttaagtttgatatcaatggcatggttgagatttgggggccacatgatgtctattacctggctgactgcattttttgcttctcagctgccactgttggcatcatagatataaaatccagccctggccttccccatgaaacacttattgaatttccattttcaagccagtcctccagggtaggcagagatggccactggggtttggctagggagtggcctgacccaggaggacagacgttttgggagtgggaatatgttatgttctctgtatgccctgcctcataccactaaacctctggtttttctttttgtcagtttttcttttcatttttctcggggttaaaggaacccctgaaaatcaggagttaaacctggaatcaattttcatttacagctgagaagcagttattgatgctatgcttgcagttcaataaaagatctaaagatatagaccttgtgcttctctttcaatataagcagcctaatcagtctcaaaggtttttttaacaaagaaattgtatggacaggtttattaaaattgctgtctttaaagttttaaactatccgcaatttgacttattccaaaggcttctagaatgtgtggcgggcaaactccaaagctccctccagcacatgttcttagagccaggtaaacatctgcttaatgtctaattgagtgatattatgatgtctgatttccacagccctaaacatgtagtctggtgtccacaggtagcgggatggcttgtgatgcctgggttctgaagcctagttagatctggccatggctgtctcatgccccagttagctcacattggcattagaagcagcagactttagaaatctaaaagccataaaagagatgggtcttgttagaaacttcctttagggcattataacattagtaacatcttattaatatgaattagattgaaatattagatgacttcatttagcacagttagaagttcagaaaacatttgatatgactgaaaatgttcaattagtgaccaggttcactaaaagaccctacttaaagcttggagtagtatgctagtgctttaaaaacagaactgaaccattaaaattttctttgaacacaaaacattctaatgtgttgtgtctgggcatgtgattgtgagtagctccagtgtacccaattttatttaaccccatcttatttctttttctgccaaagaagtatgctggtattctgtgaaatgttcacttaattgaaagcatattaattactggagatgtatggactttccaactagacactagtagcagagtcgcaccttaagcatatgagcatttacagaaaacaataatcttcttagatcttcccctccacttcatagttttgttttttctttttttaaatcttcagattactaattaccgaacacaaaaaagttgcttttaatccagtttctttaatccaggtcttatatttgatccattttgatttgtttgttgtttggtggtggtcatggtcatggttgttgttcttgttgagcgagcttactggcctggttgctatttgagaatttcaaatgaaataattacatagccaccgaagacccaaacattctgtcagctttgggatgtgttcctgatacctgtgatgcacactgaactttcagaacctagtagccacattaaattgaaagcccgcatttatattttaagtttgctaatgaaaaagatgcaatgaattttactcctgctatcagctggctcttttgaagttggtgtgctgtatagaatacattagttgtgacaacagatactcttccctgctgtaatcggtcctattttgtagccacagttctccctcgtcatactgaacaagttgttacctccccaaggtttctctgcatttctatttactttgttatcagcagaaaggctggggaaagcctcttcagtaatgacatcgatacgacacacacagcaagagaggtcagcctgtcagagctctagaaacagcagatggattaggatgaaactgggtgcaaaataactttgatagagtcttttaatgtaaacagtttatctgtcattgcctttcattgaaatccctcacagaatgatagcatttgggccgttaaggttacagaatgtagctgaataaaacccatacattgtcatgctcaaactctccaccaattagagaatgagaggacattttaatttattcattaaagacaggagagtaaataggataacatataaggttaatagaataacattggccttcatattcccaagattgtatttcccatttggctatattagcacagagactagattaataagaaactgcttagggcttgtatgatgtggtttttaatatgcttgagacaagtctgtgactgtttagaaacctgtgtgctgaatttttttattacaattaggtcttctccttcagtaccaatttttttgacttgtaatctatatacaatagaatgctttgagcatacagagatgcatagaagtgtaatgtttttatgtattgtgcttatctcatggtcagtaatgaccaaatactggctagtgtttaataaactttatgaattatccaactatgagcatttcagttgcaaagccaatagctcttttgcttagcttagcacttttccacaatgaccttaagtcagacactggtgagggtatgttgtttgccccaagatccaaacagaaacaaaaatggatatgatctgtcatttcaaaatagataatgctcatatgtgacagggatgaccacagccttttcacccacaaagagcacacagcacatatatggttctgtaaagagtgtggcagtgagagagcagccacctctggaaagctggggaccactaagtacagacttcagttgaagtgcctggagaaaagagtcctcatcatgttgccctttctgggctggaggaagtgactggacatcactggtcctttcttcactcaaaccccaccctctgtttggtccaagcacattcttttccttaagtctcttcatcatcccaattagggtcctaatccattcttgcagcctggaagtttcactctggagtcatccataagtaagtcccaggaaatgcaccatgtgtgcctaacttcattggtagtttccaagccttgagtttaatcagggttctagaatatacctagaacagtatgcacatctcaagcaaaagttatataatgaaacactttgccactttgaaaaagtaagattttgaaatttatattctgtcttgaacaatttactggggctttggtttagggctcaagaatgcttaactctaccccctcccccccagatatctgccatctgctaaaaaagtcaccaggcaggctgaaaacaccaaggaccttgttctgcctggaaaactgaattgatattttcttaagcagctatatttacttttatctttatttatcaagagcaaagagcataagcattgtaagtgcacagaagagtttccaaatttgagattaaccaatccaacattaaccattcaaaatacaggtggatgggcggaaaaaagaaacaaaactttccaaaatgtatggggccacataactcgtatttcacacagcaaaaatttcataggagtctttggaacattttactaaaaatgtataaacttgctaaagctagtttattgttaatggaggtcgactaaagcttcatatttaaccctgaatcatatatatgtgtgtgtttctcaaaaaactaaaaatagaactactatatgacccaacaatctcactactgggtagttttccaaagtaaagaaaatcagtatattaaaggaatacttgcaccaccatgtttattgctgcacaagtcacaatagctaagatatggaatcaatctaaatgttcatcaacagacaaatggttaaaatgtgagatagatagatatatatatatatacacaaaattgattactatttagccataaaagagtataaaatcctgtcatttctggcaacattgctgcaaaagcaagtagggctttagttcttccccctcctgtggagtctgcagtccggattcatgcccttccccaagttctggccaggagatttctcaatgggttcaaattgttacaaagttcagctggaggtttccttctccctgtagccttttccgagtgcctctagcagccctcctaaaggacctctgtgaggcaaagctgaaattgcttactgggggggccagcaagcccacagggcttttcccactgcttcctctacccctgtattttgctagcaggggtattgtgcttacaataaaaatggctacatttttattgtagggatacagggaaccaagttacaattggcaacattaaattcacacagacaatgagggaaagagagtaaaagtgtacagtccaagtgtgttaatacccatgtaattttatttgaatattgacataagtgacacccacccaccaccttaaacacacacatataaatgaagtctgcaataacatccttttgtcttattgacaacaagtatggccatgctactatatgactgtatttgtgatgttctggctgtgaacagtgtactctgtgagtgagtgagtgtgtgtgtgtgtgtgtgtgtgtgtgtaagagagggagggggaggggagagagagagagagatacagagataccgaaacaaatagaaattctgtgcattactgattggcacaccactgccctcacctatggatgtgtctgttccaatcccatatgctctgttgtgttcctctgtgaagagtagtgcagtggtacttgtgataattcctcagaaaagtggaagaacctggcctcttatatcctcattttccctcttcttctcccctctgtatcttctcacctctcctgcccaaccattcttacctctctaatatttcttctcccagccctcacttggagcagaatcacagcatgagctcaggttcttaaagacagcgattaggttcaccttcaagcctctgagccacgagcctgcctggtaaagtggagaaaactttatagtgagtgagagcatccctatgaccaggcatgtcccagaatccccaagcctagccttcagaatcctctgggcataaacatggactcgagggtcattaagtcttagtaagtctttattcctctttactgcatctgcagagaaacaacgtgctagatacaactccttagctcaggggagcaggtgtgttatgaaatgaggggaagggcactatcctgaagagggaggaatctgtttgggggatgatattaattcagcttccctcgggagccatgaaaacattgattttgtaccattaagtcttcacagtgtgaccatgaaactgttctcagcaacttttctgttttaatatatttgtgtaaatcctgacgtagtttcacaactgttacaattgaggcttcaaaagatgaaggagaagacatctaaaatagacacattagactctgtggcacaactctgtttattggcagtgtgcatgcctgcagataatggcagcaactatcttccaacccagcaagattctccttctcagtctataactaatggtgaacagatacagtatttggagagaggtttgcatgtgtttcagctcttttggcagaaagtgaagaaaattccacattttttttctgataaaacatattatattgtcccttccagccagagcagaagtagtgtttcctgagaggctcccttcctgaatgatgatagggtggacctgatagtactaccaggacatgctacagagcctggttttcctgactagagttaaaaatagactgagggaaaatttagtacattagacaattagatggtattttttgcctcctagttcagactattttgagttgttagcacagaaatagtaatgctgtctgtggtccaagagacattctgctttgatctgccatgttctcgtgttcattacttctcttttgattaatgagaaagtaactccctagcttcctgtttctccctcattgtgtccatcttccttattgtatccacatttatcttcccacatcaagtctgactctatccagtttctgcttaaaattccttcccttgaaccctacattctccattgcatactacagactttatgtaataaagggcaaacaccattgttgccaaggacattgttgccaagtccttcactcaatattcaatcacacatatatatgattcagggctaaatatgaagccttagtccactatatatatatatatatatatatatatatatatatatatatatatatatatgtatatgaaaaatatatatatccatatgtgtgtatatatataaatacatatatatatccatatgtatataatccttttagatatatgtgaaatactcctgtgtgtgtattaaaatatagaataccagaccttaaaatgaccatagagagtttttactctagctttctaattttctcaataaggaaactgagatacaaagcagtcagttagtatttagtatataaataaaaatgtagtctcattacccacagtataatgtgttccaaagggataggaagccttatcacactagcaggttaatgataaagatattttatcagtatttcctgccaattaggtttttgaatatgtaactgagtacctactatgtactaataatacacttcccatttcttctggttatgaatggtagggagaaaacctctattaggcattgattgtctctcactaaaagatacatgtcattttatgaggtgtgcccccttagcatcaggggcaagagggctcagattggttagggggaagaaaattgaattttcaaacccacaaaccccaggggaacagagtgaccaagtgccacttacattgggcctcctgactgggaaaaaataaacacctcaatgcaatactgaagtgcttggctggcatctgcatatttactccacttagagaatgattagtgtcaacagatgactttgtgggtgaaacatgcttcttcaccaaagacagtacatttttcattaagttacaataaaccaaaccttagttataaaggaaatttccaattgacaaatggatcttgccaaaggattttctatccagcaacatagccagagtgaagggagcaagtctttatggagtgcaggcacttctgaatgctgttatcacgtcatctttgggctggatgctcacaaaactctggcttccatggtagtgaaatgcacatgcaggtacaagtagtacctgctattcagtggctgttcaactggctgtggcagggtctagaatggcagtgtgagtgaaattgatatttactcaatgagcaatgggaagccatgaaggattatgacaatgagagcaatgtgatcaaagtggagccttaggaggattcatcttgaagtagaacataaaatagatttagaatagggagaccagtagagaagtgaggtggcagtggccatagtcctggtgagaggcaatagaaatcaagttagcagtagttgcaggaagagtgaggaaggcacaggtagctacaagccttcttccagaaagtgggatgggaaattcaccctgtgaatgctgctccagactccctcctcttcggagtgtaaacaagagccttacattcagttgcaggatgaattgagatgcacatcagcctggagctcagctcttcctccagaggcttattttttccctccatacagagcttactgtcctctggcacattttcatgcccagagcataatgtccaggcctatgagtttgcctagtcattcttgattcatttatctcatcaatgtttaagtgactattaagtgcaagacatagttctatccactgagaacaaattttccccaacctctgcctgtcaaaagtatgttcctgcccctgttacgtatagcaaagacctatttcattgattattagaaaagaatgaataaagttaaaatgtggaaagcccagtgatctaaagataggtaacatgtttttgcttcctagaggttcaaggttcaaatacagaatgtttccatgcacgttttcaggcatccataataatggttagtgttttcctgaagattataatccccgtatgacaagtcagaaattcaggcatccaggtgttgcaaaatcttgagtgacattttgtcctcttaatctgccacccttggctgtgtgtgcttaatgccagctggggtttagcctacaggatacattgtcttttgccattttactcattccagtgaaatctatttaaatgctgtaattaagcgattcatttttatatttaagcaagtgctgtcagtatatgtctcttcaattgttttagccaattctgttggtattgattttaggccatctgaataccctaatgatgagttcatttgttaatggaagagtttctcttctgaacttaagcaatcgatgcaatttaccaatacatgctgctaggttagggtatagctgtgccccacagaacaatcatgtgaaaaaaaattaaatccaaaacaaaacaaagaaacacaaaaccaatgcaattaattgtttttctgtctttttccatgttgttgaatacccagttatttgaaattatctgaatgattggattttcccttttgattaagaaatgtaaaaacccagtttggatgtatctgctagtagaatgaaaggaaaatgcatatgaaatggaaatgtaaaaggcatatagagcaatactaataaaatcacattttatgcttgactgacagtattattattgattatggaagaaatgaatacctgagtccactgccacaatatctctaggccatccaaatgttcactttgacagtctcaacatacaggaaacatattgcattagatttgttttctgtaaaaggagggggataatgtcataagtctgactgttcagagcatgcttcttataacccccaaaagattctcacattttctataaatatatatatatataacccccaaaagattctctacattttctataaatatgtatttttagtccaatagacatgtctatttatacatgtctattggactagaatagcaattaattgagtataatctctgagacagaattaccttgctaaagaattttgaagaagtgttatcattataaagaaaatggctggcaagttttctaagcaccttttatgtcatattttatccttaaggaaatgtgataccatgtatgccacgtggatgggactcaagagacagcaactgtctttccttccttccttctttctttctacctatttttttgtaatagtgctatatgatatggtttttgtaattcaacatggttcctgggttacttgagctttagtgcagcacaaggattctctatataaaagaaagacaagcttcttattttcaggaacataggtttagcgagtgagcaaatctgagcctgtctgtagccacatcatccctccaaaggaaataaatgtgctgataatgagagaggagtcacctcagaaatgctccttggaatcagagaagttccttcttccttgcatttaatttctcaagataccccatgacagaggtggcccatgtagaataggagcttcagggcttccccatcctcagggtccaatgttaataaaaaagtaaagagcccatctgatggagtgaagtgtggaaggaggggctactaaaggagagatcaactggaaaatatggaatcatcctaggcttccttggaaacacagagaaagagagagaaaagagagaaagaaaagtagagagaaagagaggtctgtagaatctaaacatatcaaagtcttctgtgaatagcactttccagacagaagcattctattcactccagaaccactactgatatggagagtagaagatagtggttcctataatcctcattggaataactacgtaggtttcataccacaatgtggcctctactcagtaagcccatagactatctggctgtaaaaatctatgcatgaacaactgtgtagaaagcagtcacaatcaaggtgcactgcatttgcatatcatgttgcagcttccagagcactgttgtcaatgttggctactcacaaccaccgttgctgtagaaaaggcaggaattattatcttcatttttaaaatgaagaaactgatgctcaaaggtgtttagtacttgccaatagggtaagtggcaaatctgggactagaacccaggtttttaacatttctggcacagcactctctccactctagcctattacctctcatcacaccatactggagtacattctctaacattttaatttcttttattgtttttttcttatactagagcttcctcaattgtgagataaatatcatgatagggaaccatggcacaaaataaggagaatataggtttttaaaagcatatagacgttataaattaaagcagcataactgttaactctccagcctccattttccaatcagtttaaattactttaatgtatgtttttaaatttaaaattagctgcaatcccaatatgtaactgtcttgatgtttggtgaattgtgctatgtcacttccttttaattttcctccttttgcagtgtgtctcacattctggcaagtgtatctggaacttgggatggtcttcttatgtcccatcatttcaaaagagaaattctctctttgtgtatcttgtagaataattcacatatcatttgcacataaataattcacttaaaattttttcctcaaagtctcttaatgtaataattcctcatagcatacctaaaacaacatcaaattacagtgaaagcatagtaacacattgcgagctttttctcatatggcaaggttctctgccatcatttactctaccatcatttacttgccatcatttacttgagagattcaaggtgatgagcacacaagaggatgacatgaggacatctgactagagctgttgggacatcagaatgatcacaagttaatttccaaagaaaagagaacctctcagcatagacattttcaatcaatagccaggcaacccagaaaaaataatttgaaggaagttattttcctatgttggctctataaaaagatgtatgtttcaaagaaactggcctcaaacatgatcacgttcctcctgatcagagaaaaataactgggtctaattgacagttccaaagcatagagcagagagggtattttcaaaaaacatgcctccgaatcaaagggaggataagcaatgtcactttgatttttccctcttcctgtctcctgccagtggcaagctcatcctatcacatccagcatgctttaaaaggaaaccacttgaacacagcacccattactttgtgataacctaagtcttctagaacagacttatctggattctaagggattgaaaaaagtggattcacatgatttccacagtgacatgtcttcagcctactagtatatcttattgcaaaccagccaggcttgggagagaaaagggttttttaaaaaaaaggcagatgtgagtgtgcatgtatgtacagactgggtcctgctgctgtaggaaagctgcatggcagtccccacttcttgccagcaccacttctccctttgttcttctgacatgggagaatctgcaggatgagtgaggttcacatcctctgtacatggactgcaaatggacagcaaatggacaagttttcatgtccaagatacatgtgacagatgagttgggccagccagacacatatttcttgttttctcattttcacctcttacctcattccttagcttttttcctattctagcacttgccaaaattcaacctcaggcacagatggtgagaaaatgatttttgcctaccaagccaaagaaagtgcccaaatattaatggttatttatctagaaacagaacctgagacttagtaaatggaagcatggatttccagcactaacatctaaaatttggaagtgttttattcagttgttatgcatagaggtcttcagtatgttgaatatcacttgtcaccgagaatgtcaagtccagagttagattatatgttgtctctgctaaaagtggttgcctctgtattctaatttacagcagtattctcttctctgtagcccttacccacctccaagattcacaaagatccccaaacagatacttttttaaaggatctgaacaaccctgaggttgtcaaatagctgcttcaatgctctttttatcaaacataacgtctatagcctgaaaaagtctatgggagtacaagtttggttctgattacataattatgctacagaaatatgaaaaaaaaatcatcactaaaaccctccaggtgcttaaacagtttgatagactgtagccattctgccatcagcacccccagctgtgttgcttagcaacattttaattccagaagaatcgaaggagatgaaatccctgtggagaaggaaacagaaataagagggctgttgacagatgatctgagttgtttcttctaatatactgtgaagatcactagctcttttcatgaatgataaatggactgtacacagatcaatgggttcagcactaaactggaaccgggctccatgtctaaggcaatgcaggccgagaggcccagagatttcctcatttctatgatttggtgtatattttcttaaaggttccacaggaggaaattgatctgagtattcagtcattccttgcccttctgtggtgtcggctaataaaaatgattttagaaagggacactcgactttctatcatggtggaagtatggccagatgtcagtagtagtgctagggtgagcagttccctaccacaaatctaaaaatccaggatatgcccatgaccattccgtctgcatctgtttccctaacctgtcgttacaacccaagcaggtccaaacacggtaagattagagtgaaaggtgggaagagagggaccctagttatgcacccagaagtccacttttatggtccctgatgaactttctaggcagccctcacaatatccacctcacaatttccacctgtattggaaagctgcacttggacaggtaaccatgtttcccaggagaagaaaattgctttctgagtctccagtctgcttatctacagcaccctgtttcggttagctccttatgtttctgaagagcattttatattgcttattgttttggtagctagttgcaatgattatgcctgctaatattgtctaattgcattttttcttctgtttacaggctgttgaaaaggcaaaacctaggaataatcctgtgaagtaagttattatttttattagttgcaaatgttaattttaacggactcgatgcatgtgaaaaaataaggtcataaaagagaccttggattttgagttaatctctattcatgacaatttaa

SEQ ID NO: 5141 - DNA, 493726 bp, human
ccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtggtaggtgttgatttttgccttctcctttgatgagcgagtctcctggcgaagtctgaggttttcgcctttgttaagaggagctgaagctgtcgtggggggcgccccggactccctcccacttgctctcagccacctctggccccggccgcgctgactcctaggtcggatgccggggtggggggaggtgcgggaagagggagggatgcggacccgaaagcgtcgctttgcgctccaagtctaaagagttgcatttggctcacatcgaattcggtgccgcccgagggctgaaccgcacgacctcccaggagcttttctctcggagcggcttgccggtctggcctccttgagccccggatgccgcccgcccgaaatgtctcaactttccaggtgcccaacgcccgcggcgggccatgggggaaaggcaacggccaggtgcggccagcagccctctgcttccttggtggccaccgcccccgctgccgccacctccatccctgcgctgcgcggcgcgcacacctttccttctgccgactcagcccaagttccctgcactcccgggtggagcagcggctttgggggccaccactcaggggaccttggttcgaggccgacttcggcgcttggctttcaagactgagggttttcggagttggccccccaaatccgcagctctgatgtcaatgcacatttaattaccggatggacccccttcggcctcccactgggaggcagccgtagttttttgtaagggacctccagctcagattcaaaggttgagtcagctcttcacaaaataccctaaacttgtcgctgagacattttgaaagatggtagaaaggtgactggggacctggaaagttgttaactctcttagagatgtgcgtgcgcgtgtgcataaatactgatatacatatctattaacttttcaaaaacttcacctactacaaacattatcacagtttatttgtcataatacttaaacgtatcagattccccccgcagtctaaggaattagatggggagggggcgcagtggtaaccgcttaaaattgcattcttggttattgccttttaaaatgtatttagaatgatctgtagtacctaccaatagtgcgaaatcttttgcaatgttaaactactagcggccgttggttatgaatgctgtgtatttttacaaggatttcccctgttgatgtgatattttaggcaatttccttctttaaaaaagggtcatatgcttagccaacagcttcattatgccaatcatgcctcctttagttgcaaatccaagatagtcagaacttaaatacattttattttacagcaattccggataaatccttgaagcgcaaattatgctgtatcagtattaatctataaggcgttttggataccacggttttatcagctctgtagaaatacattgttacattaaaaaatgctgttatttgaaagtaaaaattactataaaattattgctcaattagatattatgcttctgcacacagcctttactctgcttcactaatttattttgcagacaactgataaccatagcactctatttgcatacaatttgcctaatatgtggtgtgggttacatcgttaatttaacagacattgttataattaatttcatgggtatagttcaaatgttaaacatatacaaggtattaggtttttagaaacatgttttttatattaattccggtttaatcttatgcatatgcaattgcatatttaaagggaatggactcttttatgtttgatttctttaaaaaaaatgataggctccctcacccctgtgggaggctttctttttcttatcttaaggaaaatgcaaaacctttttttcctccagatccctaactgagacacatcagttaagaagcatagacttggacacttcgtgaatattatgtgaaatactgattaattagtgtaacgcatctgcataaataagcctgtcctttccctctgtacatgatccaggaaaatttctccttcttactgctcgtgagtggcacacttcgtgatgcatctctgtttataaacatttgtaatgtggttgtgcttttgtgttttgtatagctccacagagaaaaggaacataaatgtgacaatagtggatgaactaaaaagcttgacattgtcttgagtggaaattggtacctttcccacttctctttggaagtccagagcatgccagttacgtgttcattatatgtttacttccattccttgggagtaaatagctacttaaagtgatggcctccactccccacgcccccaagcccccaggagggccaagaaaggaaaaaagaccagcaaagttaacgatcttatttaccttgaatttattcttaacattcacttatggaacagtaagctctgagctgtctctactgcaaccctagatgtctgacaataaatggatcaggacagcttaaaaacaaactcattttcctagacataatgaagaaagactttacatacacaggcatatgtgttatttgcaaacacttgactgtagtaaacaaaaagtgtgtgcccatttataaacacacacatttgttagggcaaatgcaaatggaaaggatggggtactaatgatgctgcagtgtgcatgttatgtgcagtgttttggaatgctcacatgcctaatggaacataccactggatttcacaaactgcaagaataacttaatgggtcatgctctggactcgattaaagggccaaagctcaagttctttaagattcttggatgaatgagcaatgttcacctgagtctgaatttaatataaaccattctgtgaaagaaaaagatggcacagatgtctgtctgtgtgcatgaaagacatcacttgctcttaaagaaaaagataaattaaaaaaaaatcaaatttcttcatttaaatcattccatagacttgtttttggtaaccaagtaaatgaatacttgaggtgactgaagatcaggtaatgatgtcattaatccccatttaagagggaaaaaaagcaaattcagagggcctacaaaatgtacagcctttcagttctgtaagcacctcccacccagtattgattaggtattgctttgtgacaagccaaggttctttgtggggatgcttaccttttcttcattggaaggaaggaaaggaaagaaaagaaagaaaatacagaaagggacacattcttaaaaaaaagaaaagaaaagaaaagaaaaccaccgtgatagcaaaatcagaacgttcaaaagcctagttaaaatcgtagttaagtgactgtgacagtggctggcttctcaccgcaagggacagcatcaattgtttgtagtttttatgtgatgtctcacaaatagcctaattagaggcaagcttgcaaacgggcagttatacaggaagagacttaaactcactaaactgttatataaatagaaagttcaaaggtctgtgtggggctgtcaaggctgagaaggggccatgtgccggccaggcctctcctcctccggtaaaggcagcccccagggcctgccccagcagtccgaactgcactttccccagttttcttcgaccttgcgagggcggggcagtgccggagaaggggcggggggctgctttctagacaaaagtgaactgtttcagctccagccgggcatggcccatgcactgcagcaacccggctgcctcctcctgttctgtgcgcacaggtcttccgaggcctcgttagctacaatcctccagaagagcggaacaggactgtttatggatgggaaggtgtgggagatggggggaacacaacctttgccaacttggagatactagggctgtggtggggtggggggaggggaagtcctgttttgaataaggcctagagattcccagcatttcttgttctctacctccatccatttatctttcccgttttccctctgtggtctcttaaaagggagactgcctatggtctgttttctttgctagtacagtatgcattctcccgtgtgtttgagcattcattcaacaaaccattttaggttgtgtttcttaagggaatgtgtgggtaggagaaatttaagttggtgaaattcactagtaaggtctcctccgcaactccccaaaccctccaaagaataaaagctatctcagtacatcttaagaggcacatctattggacacggaagaaaattatctcatggtagaaatcagtttaatgatacatgaattgttttgctaatgattcagtcaagcatttaacaactttaaaatatacaaatcaaggtagaaaatgactgcctggaaaatgagtccatcattatagacatgaatgagattccatacatttaagcatcctgtagatggatacaaattatattgtatttaaacatgctaattattgttgaatagaaatggctttaatgtactaacctttaacatgtaataaatgcccatgattcttagctaagattattttgccatgcaaaatttgcacttatttaacataatttcaaaattgtagaagtccaatgaaatggccttctctggaacaatttagagctgtggccttaagagcttgtaactgtaggtcatacctcaaagcggaaaactgccatatacttgattagcctgtcacgtagacaaaacaatttttgctgcagtgactgcatttttcacttgtaattttgtttttctttttctgattgctgttggataaagagagatttcaaaaacttgcttactgataaatggaaagaaatgttactgattaaagaactcaagaccaaacttgaagaaacctttttgagtgtgtgtgtctgtgtgtgtgtgtgtgtgtgtgtgtgtgtgttacctgtggtagaactcaacattatcattgctactataatttgagtgtttactctgtgccacaagcttggactaaattctgtaaagactcaatttcgtttaatccttccaacaactttctgagataggacctgttatgatccctgttttacagatgaagcaatgaaatcacacaggtactcactcagtgatgcaatccaggtttcagcatagatggagctgactccagagcctgcatcatcaacaactgacgttttgtctgagcctttccaacatgtggaatgctcttccacatgctatctcatttgatcattgtgagttagaatgttcaggggttcttgccattttattgaatggcaaattcattcattttttgtgtggatccgaatatttatttagccgtcactgaaacaaatggattggattgtgtatattgtacttgtggaagaaatctgtggaattaccatgtaatttgaccagccatggaactctgctttttccttttaattagaaagagaacagtctatatactgatacaatctcttagcatgtcatttatggatgcccccttcatgaaaatgtgagaatggaaaattatatatatatatataaaggagacaaatctcaagtccttgagaattgttcatttaaatctgaatgctcaaattttgaagatttgatacttgaacataaagaagaccatggtatattttttggctcatttggagcctcaaaactggaggtgggaagttggtaacatttctttccaaagctttctaatcttaccatatgtattaattgattggaccctcacaataaccttaaagatttgttaggattgatattttagcttcattttgtagataataaaacggaagttcagagaggttaagttacttgcctgaatttgcacagtaggtgaatagtcttaggatatgtgtttgttgctcttttcgctgcatcaccactggtgcattaagttgttaatatttaaatatccacgttgcttcctagagaatggtgtgtcaccctctggcatcatttagcacagtgtttttccatcagaggtactcaataaacatctgttgattgatgttacagtcacattcgactcaaagactgttccatgcaaatgcaggtctctttcaaggatagttacttactaaatcctagtgataatactgtccctctgcctgtgtgattgtatattagttatttgtaattcttttcatgtctcttagccagtctgatctttttgcagaaaataaagagaataaccaatggatacagaagaagattaataggaaaaggcaaaaatagtatccatgtaattggcatgtttttaagaaacagaatttctatgaattccaagatatgtttagcccaaaagaaaaacaagaggaaagaatatcttttaaggtacagcattataggaattaacggactggtattgtgtctcaatctgcattgagaacattaataaagaatgtgtaacaaaaatctgaggaaaatatgagtggtcggagggttgggattcctccagctttccttgagtttcagtctttatgacttgtatttcatcatgagaaggctgtttttctacttaactgtagcagatccacaccataaattatcatgactgttaaacaaaggtccagccctgggttcttctaatgtaaaacttttatgttacactttaatgaaattttatatgcatgttcaaagcaaggcacactttacaccgtagagagggtgatgcactgaattgttgaatttattttgaagtaaatcttttagatgaccttagcgtctaacatctacctacttactgagctgaaaaaaagttatctgagagctgaaaaaaatgacatgatttaagcagagctgacaatagcactatagctagaatgtgattttgattatggattgcttactttatgggatgctgtttttcaaacatacctgtgtattttgcttcatttgaaaaataaaatcagctaatgtttcaaagtaatcttcgatttggttcttcagtaggtacgttctcttatatgaaggtgtaaaagccacactttgaggattaagctaaggaaacaagctttgttttcattacaaaatcaaaatcactcatctgtttatttttccaatgcttcgtttgttggagaaataaaagacattacttccatcctatggagaacagtttgttttgttagatttccaaataatagttctctgcatcatctaccatcttcaatgaaaaccagatctcagtagcagatactggttcacttggtgacctttattaaaccattttcctggagtcagtttttgtgttttgtaggcaacgtatctcctggaaataaatagctttgaaatggtttcttttttgtataagtaaaaaataatatgctacttgttttgtagtggtgctgaaattgaaatctcagctttaacaatcattggaagaagttgcttgctaaaattgtgatgtcttcttggtgtttgggtttctagtatggtttgatcaaaccaaccaagcagatggaatgtgttgttataaggtcattttaacctgtagactacggcaatatgtacatgacaacctgactatctgttgaacaatgaaaaatgcaattacgtaggctttatttcccccttcaggatgtcagccaacaaattttttaatgaattaattttccaaaggactgattgttttcatgccaggtcggcacaaccacagtgactaaattagactcagtgtgatggatgtttctgatgaagtgccgtggagaggtctcatcaatttgctattatttatttgctgccaaagtgcttggctttggtgtgtagacgttaatcaggtcgtagaagctagagttttaaggctggagggcccctttggatcatgtgatccaaactcctcattgtacagataaggagactgaggcccaggatgggaaaatgacttgcccaaggacatccagtcagtaattggcaaagccgggtcaggagcccttgtaccctggttcagtgtttgtcatctctcaagaactgtttgtattgcctacctactctgtgcccaacactctgctagtcagtcatttttagggagagatgaaaggaccgtagaagatgacctctggcctcacagaatttacattggaaagtataattagaattagggaaatactatgacatggactgtaagtaaaacaggaattctgggagagagagagaatgcaagctaagtaggcaaaacagtcctggtcaaggcccatgaaactcttttattactattagtgcacttcagagtgaaatggaaatccagaaatttttattgtttaggggacccggagcattgaatactcaacataagacaattgactttggaccctgaattatctggtttgacagtagctcacattcatcacataattgcctgagtcctcttttgctgtgtgaatggagtattctcattaacacagaccaacatttgctgagggacaaccacaaaagtctcccaagaagagctttggaaacatttgtgcaaacattcttcaaagaaataccaaatgaaaatgtgttttttttctgaaataattgaaacaagtgtttgtaaattggtacaattgctagcaaaatggccatttttcaaaagaagggtatactgtagctcttgagatgttcacaaatacattgtttcttttgctctttctccttttctaaaaatataattaactgttttgtttgttaggtgtgtaccaacattttaccattagaatttcttttttcctaaaaagggagttggtgccttcgtactgtgtgaattgtgttgacatctgtgtttacgattagctgtttggccaccaagtaattctttgcctggctatgtcattgttcaaatctcaactctatctctgggaagctgctagtgagcagcaggacctcctgcttcctccgtccctcaaactcccatactcctacccagtctgttcagatgcctctcctctgtgctttcataccttcctgagctgacttccacctgggctggatcctgctttctcccttccccaactcttcccatgcaactttgttgttgtgaaagatgagaatgtgtcttttatttttgtgttcccagtccctggcccagaataataacctaatgctgccagttcagagtgcagcatcattcatttattcagttcattcaggcactatgctagttcttcaaaatattaaatctagctgagaagacctaaaaacggtattaatagtaataatttaagctaataattacaggtaacatttcctatgttacaggttctgatttgtgttatccgatttctctattaacagagcaggaaactgggacagaagggttcagcgacttgcccaaggccatactggtagtatgttgctgagcttgaattaatccacaggccatgtgaatccttagcttctctgctaatctataaggataccctaggatagatgctatactagtggcaagccctgcttgtgcttgggctctatagtagactgggctaatgaggactttaccactcatccttagtatttacaaattgggtctaagttcattatcaaatatgaggcatgactttccagatatctactccaacaagagacacacaagtctgttcctctttggtgtaagtggcagattctgatcttgggaggaaggtatactggttcaaaaacctgaacctaattcaaacttgacaagaatgtgagctcattaagggtggagagttttgttggttttattcactgctgacactgcaatgcttagaacagtgtgtggtgcacagtaggtgctcagttattttttggtgaataggtagatggaatgatagacaaaaacctgcttaatactttgtgtgattaaatttgtgaagagatagctcaagaggtgtaagaatgaggaccaagagaagtgctaaaatcacaatgagcagacaggtgggtacaggtaggtgtgttgccttgccttctgtacatacttttctgaaataggatgcttatagaaatgttataaattaaatgttctttatgtgcatcttacttgccaggaataccgtagggaagtctttgttgatgagcaaaatctctcccaaacagccctaaacttatcagatttgtgtacagcattttgagattttagatttttgtgtacagcattttcttgtcatgaggtatacctacatttaatatctgcaacagtgctttaagggtaattgggcagccttaaaaaaaaaaggtgtagtaacttgttaccatccctgaattgtagctttcatctagtacaaaggggggataacagacttcaacatttgctgagtatttttctccgcgcttttgtaacgttgtctcctcttagctagatgcccgtttgcttaatagttcccgctttggaggctaacctgggatttgaattttcctaacatatatttttacattgaacacattttctatttatgcctctggaggattcaaattacaatttcatcccaaggatgtgcagaaaagtttccacacgtgctgattttaaagaaatctataagataatttggtagggaaagaggattagcatttacagagcattatggcatatactttacaaacatcacctcattgaacaaggaccctaaaaaataagggttttcacccccattttacagacaagaaagatgagaatcagaggggtacacccctaactttctcaaagtcacatgattagccaacagcagagccccaagtccaactcaggtttcttgggcccaaagaccacatcccttctgctataacctgccttcacagagttgaagatgagctgataatagagtttgttgggtaccttcaatgtactaaaagtaatgtggaaaaacacccctgaacattattttattattttcaaattgcaaaattaaaggtgtcaggatgcaggtcaggaagacagacagaaacatgagatgacaaagaaatttaggaaattttagtgggagtgaaacacccagccagttaaatgaagcagactttaagctacatattaggaggacagactgtagataattaatgggtctttaataaattgggtctcataatcagaaatgaaacttatctgaatattaattacagatccagaaaaaatgcaagagccatgatggacctttttaaaaaaaataacagttaaatgttaactatatctcttttgctacaattaggcattttggccatttagttttgaagttctgtaacagtttaaacttcaacagtgcaaatatattcagactgtaagtggtaaaacttcctgtcaagaatgatgaagactgttttcattgtattctgattagcatcatacttagaaactacagtgaaatgccaatgagcactctaatgccattgaaaaaggacacccacgacacacgtctgccatacatactttggtaaacaattgcagtgactcatataccttgaacaaaaaatagaaatttgatccaacctatttcaaaaggcttgaaagttaaagcgaattctaaatgtagattagtagcaaatgatgacagccaagccagcattacctcagttgattaatttataaggatattggtcaatgattttacccaacagctacgcatagtagaatcctaatgggatctgtctgttaaaattacataaagtagggcatttgatttatttcatagtttctcagagctcaattttaacttcatacaaataatgcattagtcacccaggataaatgacatgctgaatacagttgtgattttgtctgcttctcataatcagatttagcaaaggattacatctgtctttgtagtttattcctatcctaaacatttgtaggtagagtgggatcttttctcttgtttcatatctcgttagatgacatcggaccatccagccctttccctgcctctgggtttctggagtgtgtaaggaagattcactgatttaggggtagtactaagaactaccacatctacagtgaggcacatagaagggtttaaagacgttgctactctaaatatatcattaggagtatatcactatctatttatatattgctgaacgattttatttcatttttaagatttggttacattcttaaacctggagtacatattattataaagcaaattcagtaaaataacactaaaatcattcaaatgcgctaaagcaggtgaaaatgtggggatcaccaaactttgcctacgtgcctatactccaaaccatcatctccctcacccttgaccctggggttgggagagtcttttctttgtgctgtgaatgctgcagtagctgctccagggatgtacctctctgagccttacagtgtcaacccaaatgtgatttcaatgccaagacctggctgacttttacactctgatcaccattatttctgtcttttagtagcttcattgccttaatggaggacggaaaggtgagtttgcccaactgaaaaactttgaaatctgttcggcctacacttgcacaccaaaattagaagaagggggaggttttaaattcgtggctggctggaaatatgtgggtttatatttttaagatgtaaaaaatatgattaggagaaagttctcagaacttcatggacatcatgtaactcttagaaagtaaggtaaattataaaatatgggataagttttcttaaattgaacataatcataaaaattcaaggcaaagcaacatattctgcaaaatttatgagatttgagggtgggggaagagtttgcaaagcttgacaacctccagtgcatctgacctggcacattcctgttggtaatgagaaccttatggggtgctgggcctcggttttcttaggcagggcctgctccccaagggtatcataaatgatacgcgagtcaggaacttcatggctcatggtatttctcagggatattttagttaagctgtcccacccagctacagtggcagaagttgggaagagggcccactcataaatctttattgaactttaattaattaattaattatttgccattgttcataggaatttgaaagggaaagacatattgaataaccatgcctatctgactttatagaaatggtccaggttcttggggttaatgtgacttttattatttgataggcacgcatttgtttaacaatgacaataaccggaaaaccacagaagtataaataccagtaatgaaaagttcaatgcaaagaggaaaaaaaagaagaagaaaaagtgcaatgccaaagttagggctatttcttctggtgttttcttatgttttgtctttccttttctttccttttattcccacatgccgtgaaagtttggagttggccacaatctcatttgtgaatttgggccttccactgtaggatgtgtagggtggtcagtcatgaaatgtgtatttgtaaatacgtgtttgttcaaagcagtcttagcacccggatttcctgaacatagttctgatatggctttattctcaaaggacttctagcagtgatgctacattttggtgttgaccgttggaggcaaggaaatgtccaagttgaattggtctatgtgatgttgatcctttaactatgagtgtttactgccttccctgggaacttggagcttagccgactttaacagccatagaagacaagcctgatgttacttctaaatacacaaccctcagttctctatcacctaccctcctctttcactatcttttaaattcctgacatttattcatataaacagttcagtagttactgttttatttggttccttgaataggtctgacagcatttggaaaaagacagcttatgatgtgggcatcatggtcttatttcactgtcatccttttaattgtattacttacatctgataaattttcagattattttctaccttttattactgatctaggatacttatggcagtgttttgaaaggtgagaaacacaacactgctttctgaattttttctaaagactatggtgcattttatgagataaatgtttaaaaggttgttatgaatgagacagcctacactgaatgactgaggagactggacagaatgaaaccttattttaaaggaaaaataagccatttttaccttccgtaagtttactttgaaaggtaataaacaaattgtttcctcactggaaaaaagggaggaaataacatattcgggaggcagaggcctttaatatcttgcaggctgtttgactgtattctgaatttcatgtccaaaactgtcgttgctaatgtagacttatgaaccatcatttaaaaaaatccaaggaggcatcttgcatttaaattgtagaattattagaccttaattttcaatgaaatgaaaagacactagcaattctagctgttttgctttagctaataaagccatacttgtttctatttccagtgtcttatttccaggaagactgaattttcataaataggcaatggataagcaagccttcttagctttagtactgatactttgtatccctccattatttattaactggacaattaaggccctctgtgagatacattttttttcataatgatagtctcccatttaaaaatagagttgtaaaaatcataaaagctataacgatataaaaagaaatgtgatcaatttttatgaatcagtgtgaactaatttcagtggtgtgcaggcaaaatggtgaatgcagctatggctcagttctcgtgcaatgtatgatgtgtaaagaagaaaggagaatctcccattggttctttgcaatggttgctcctgattcatgtcccagcagtggtataggatcttagaacttcagatctgtaaaggtccttaagggggatgagagtgaggccaaccccttgttcagtctccccacaagtaatcatccagcttctgctagccaaaaaacaaaaacaaaaacataatgagaatgaaactgcctcctatggtagcaaatttcttcttttttggataggtcagaacaaattccattgtatgtgggcaaagaagccttctttgaacttccagcccttggttgcagttctgccctggagaccacacaaaatagtctaagctcttcagttcacgtcagccctcccaaggtcaaaggacagcttgcctatctgtgttcgctgtgttctcattttttagggcaaaacgtcccaagccaagcttggagagacttcaagaaactctgtctagatatgcaggtgggaggtgactgggccctaaaggctctaactctatttttaggttacatagagcagggagaggcgtctttatctcctgcatataaacttttttgagggaacatgggctgagaagcagatattcaacatccttttcccaggaaaacacccctccggatatcctctctaattgccacaatatgagaaccccaaaagatcaaaaggctaacaggaacgtttccaggaggaatcaaataactaatgttgaagcctgatgcttcctgtgaaaccatacatctctcactgtcaccatattggcatatacttggcagatgacaatggccctcagagttgagcaactactgcacgtcagacactcatctgaacactttccatacataaactattaatacttccagtaaccttgagaagtagtaggcaagcttattgccatttttatgatggggaaattgaggcccaaagaggttgagtcacttgcttaagatcacataagtaagtagtagagctgggatttgaaccctggcactgtaacactgaactgtgatacagcttctcagagataagtcttgagatgttgctcaacgttggccccctctgaacaagctactacttggaagttatgaaaagccactcttctggctgtgaccatcgtttcatcctgtaagggggagattgggtcctagtattattcattccactctaatactacatcattgaatagctacattctctttgcagtctatttggtagccgagcaccagctttgtgatgagtgaaatcttaagtatagtgcctcctgaagagaggaataggcattcattcattcgttcattcaacaaatatattctgggtgtctaccattagccaggcactggggatatcatagtgatatttgtataaatggcccctggagtcagaccattaaatacttaaagtagaacaagcagtgggaaaaagtccaatgtttttctaagatgccctagatcatatctgaaaatccttctggtggcagagattgtggcactttaagatgacaaaaacagatacccattgcccaatcctacccagccttctcttcagtaccactgccctcgttgcttcatgctggagatttatgtgaatgagatcagcataggagatggaattggtcaaaaccacagcaaatccaatttcaatgaaagggcttgagtcatctgtcatataaggaaatgcatggcacagggcatctggctttctttgtggctgccaggatgccaagcggacccaacactcccttgaatgattttttgtgtctagtactcatttttttcacttgttgtacaagaggcatcttaagtcaaaatctaacccttagtacattgtaccacattgttgattactgcaacctttcagtcattattcaacaaatcatttcttgtactgcactattgattagttattataaaaccctgaattcaactgtacagtattggttctttttgccaaagggactctaaattagaaaataattttgatggctgggcgtggtggctcacgcctgtaatcccagcactttgggaggccgaggcaggcggatcacgaggtcaggagatcgagaccatcctggctaacacggtgaaaccccgtttctactaaaaatacaaaaaaaaaaaatgagccaggcatggtggcgggcgcctgtagtcccagctactcaggaggctgaggcaggagaatgttgtgaacctgggaggcggggcttgcagtgagccaagatcgcgccactgcactccagcctgggcgacagtgcatgactccgtctcaaaaaaaaaaaaaaaaagaaaataattttgtcaaatactattgtcacagctattaatggggcatcccaagatgaatagtttcttgctaccaaataccttttataaatattgcgtttagaattgagtctagagattcatcttgacttggggggaaaggtctattaaaaggactttatattccattttgctttggtctggtcttggcacgggagtgtggattttgctaaaaaaaccaaacagagccagctgttttcttccagagagccaccttgactatcagtgtgggtgtcagataacagcctttgtggtgagaagtttattgtatttacttgggcggtggtctctagtatttgcagtgcttcattggcatagtgtctcacttctgcaagagaagttatccacgaccatgggtcatttactgtctgtcaggcgagacatttataaaccaatgtcctttgtgttctgccctgagcaatgacccctcatgggactgagctttgatggagaaaggaaaaagtggtgtgttgtgtttggtcactttccgcttgagtggcagttacctggtaaaatttaaggtggaggagtatgcatgtcttgtgtttaagcaaagactggatgacccttattaggaatgttgcagaaggaattccagcattagataaaggttgaactagatgacctttgaggttgtttcagctgctgagtttttatgatgctttaaaatcccttaggagaaaagctgcagtgtagaccattggctgtgaatcccaagcttgaaattgttggaaaatgatgctcaaatcaaatcacattaaattcactttaaagtttagaaatatatgacttaacaatattttgtctgttgttggttggggtaaaggggagaataggaggaagattattgcaacataaaatacaacaaaccatgaaaacagcatcatacatcaaaattaaaatttttttctcaaaaaattaaaaggattgggaatgactgacctatatattgccttatttttctttttgtctcatttgtgagctcaacaactccagcgtattaattactgttgcctcctattgtcattttaatggcaccttatataaatagaggcagtgaagctagttgctactctcccaacacaccccattttttgcatttctgacgtagtgcagggacccttctccatttggttattggcctgcttgttacagaagtcagttaactattcttcaggtcagaagtgagatgttagcattctcacaatgaagaatatatggtattctccctcttatctactcactttctgtgtgtttttaaaataaaacctaagcatcttctttgttcatagcataatggaataaatattacagtctttgaacacattcttcgtgaaatcacttgcagcaatttctagtgtttggtttgtactagacatctcccactcacgtagacatgaaaataatacgaagcggaagaaactacaaatgaaaaaagaaaaccagaaagagtgtttacaaattcagagaagaatctaaactattcttgtgcttatgcattaagggcacatactatgcatgtgacatcatttaatgacattagaatgtgccattcggagacccgaggaaataagttaataagaatgtttacctgtgcatatatacagtgtgtatatatacatacatatgtacgtatacatacacactgtatatacaaacatatatataagctagttgtagagtctaggcttttgtgaaacttaaactcttaagatatgtggtcctaataccccataccacctctccccactccatatatacaaataacctttcttactctgttagcctttttgtctggttgaaggctgttgtgtctaaacatattatgacattttgttttaaacatttttttagaataaaataattaatgctagctgccctgaagatttgtgcatttaaaagtaaaataaaagtatataaatctagtttacatctgagatgtttcaaagagggactttaactatctaacaatttaaaaacttgcaaaatcccttaatgtccaagatggacacacccagctgtattctgggcctgctgcttgtctagaactattttcaaatgcttttggattcagtgaaacccgaaatgcatattgcctcaagccctttttccctctttaactttgagacccctgtgtatttggaaggaaatgaaatacatgtgtttctgatttatttacactcatcaaaatgttttgtaagagcatttgatgttctagaagcttttgtgaatttttgaaaataaacttttgcaaaccttcatcaccactctcactgccgctttccatgaaaaagtcatatttagctgagggtaaacaaattgaaatgcccaccagggttgagttcaattctttgtagcttaggcagagtgtcctgggggctccaggtggtaggcacccggctcccacgtttttgtgctggcgtaactgggctcagcaggttgcaatactcttctggttcttcttaacactggcccagctgttctttcttttggatgcaatagaaagaatttccaaatagatttaaactgaacagagaattgactcctgtaaccagaactttcactgaactctgtagaagaaaggcctttatccttatttgttatgtgaaataaaatgtcttaagtgggaataacttccatatctcacagtgccttttacttcagactttagagctgtgttaataattttaatcactatacctacagttcctttttctaaaaaaaatattaaggaatctgatatacagtaatcagaaacagttttgatcaatctctttcattgtggctggtggctctagccttttttgtaaagtaatttgtttatgcttacaattacaaagtgctctaatagccttattctataatgacccagacagtgcctctgagaagaagtctttgtgtggaagtcaaacagtttagtggagcataaagacggcagacattgccaaggccaggaaagccatttatcagtgcatggcctactatgcactgaaaatgaacttggatagaagctaccttaagtctacttccttctcacaggggtttggcttgagggaagcaggctttcagggttgcagtcatatcagtgcatcagtgggtcaccaggtaccatttgtgtggaggctctgataatgtcactgtcaccattcttgcaccctgtgacaacacagaggactggccaattacaaacccaggaaagctcctagtaattattcaaattcatggtacattcaggtataacttacaaactgaatgtaccacattcaggttccacaggtacctgaaaagcacgtgcatgcacacacacacacacacacacacacacacacacacactcactgagacttttgcctggatcttgcaaaaaagttaccctaaaaaataatatgtctacctttggtggtaactaacactgcagcacatttcgtaggaggtagtttttgttatcaagatatacttcccctctatctcataaaccttaagaaggtattagaaacaaattacattgcatagtttatatatccatatctccaaggatttctatatgtcaataaaatgccaatcatcagatttgtcctgatgtgaaagtcagggacaaaatgaccacctagcttctcagttgaggctacatggaattacgtatgaatatttcagataagatcagatctgatcataaactcttatttttgtagcatgcaagtgtgtggataatgtgtaaaaaggaagacataagtcaaatgtgtcacatctgagactctcttgcactgagattgaaaaggcattgcgtccatgaaacagcccttgtgccgtccaaaagcactgctcctttctcctcagttgcatcaaatttctgtggaactcataccattgccagattagggcaatcaacaggggcagagaacttcaaatgaaacttccgccacagtgcaagcatttgtcaccatattgtcggtgagccaaaatctttcccctttgtgctgatggctaaacaagaatactctcacaatctcccctgttgttctttttctaagtgtgccctgaaaaagttctgatgcaaaatagtcaaatcacggctgttacttgcttgccacctgtcctgacgacaagaggaaacatgggttgcacctactggacctaaagtcttcacttcttctccaaggattgcaggtgtacagctcactatatttaactatgcgggctgtcccagagggggcttgtgcatgcatttgcatggggcagaatgatcagctcttgcctccagtccatctggtgatagggacagtttcacattatatgtgtattttcgggaacattttgtattaagaggtgagagtggactttctgggcatggaattgtttgtttatggaaacaggcatacattgtgtctacaaagcaatagggaaaaggctttgcgggaaaacttcagtcccttcctgcttagggaacatgctgtgggaaccttttaagtttttctattcactattttactgttctaggtctgcattgagtgggagttaaattttaaatgctcatcgggtctttgcaaagccttttagtatacaattgctggtacagttgcttatacaattgtacagttgcacaacgattacttatgattgatgtgtatttagattggctttggctaggcaagagtggtatcacaaaaccctgctccagttttgaaaaaaaactactttattaatatattcctatcttgttgatattgtcatatttatacgttcatttcttgcaactaaagccttctggcacatccatttataaactattccaataacttagtataaagatctgctctacgtgatcacacatgtgggcatgcaaacactaataaaaggagaaactgaggcaaggaaatcatgcaaatttcctgaggtcaaattttgtattgtgatagtactgagaatacgtccttgaaacaggaattcgactccagtgactaaaacacttgctctctgtagcatctttgtgaaatgcaggggtgagatatatgcatatatatcatcttcattaagaggaaagtgagatatttatggtagctgctaatgttaatatcaattttcaacattaataataaaatgagcagaatgaagccaatagatccaggtcctgtatatgattaaatttatttattttcatttttaagtgaaaatgttaaatcaattgcatgatttcctttgaatttgtaataatgacattataaaacatatacatgtacatataccccattcatgtaattaaacagattcatcaaacatattgttgaaaaatcttggaaatgtgtgggacagaggattaattaactcagaagcatgtaaactctaaaaagtttgttaatctattttcattatacatatgctctccatgtatgatttgtgacagcttaaggacagatggccgagtaatttacaactctgacttcaattatataccgtgttgttcaaatgaaaatagctctcttgcagcatagatagagatgttagcaaccatttataagaagtgtttggaaattaggatgaaagacaaagcctgctttgtttgatttcatgcaaaaaaatttagaatgcctgttcataaaataatttccaaatattagtctttagttcttgacagtttcaaaattgtgcaagtgtaaaatggaattttaactgcttttcttttctctttcatgtagttcatagcagatatttcaacactgtcgctgctccagaaaatccttggatccagttcctccagattgagaaaggaatgacatactctttagggtaatcgtgtaggcagggatgaggagaatggttgaagagagaattctgtgttttgacttggaaaggcacccactccacccttgtattttcaaagtggctcttagatgtcgggcagtatgattctcattcaaagcctggaacaccaaagaagaaactctgcatcttgccacttaaacttactgttagcacttcggtactgatgtacagctttggttgaagcctctctctctctctctttctctctctctctctctctctctctctgtgtgtgtgtgtgtgtgtgtgtgtgtgtgtgtggtttgaaaattgtatcccccttcagactataacctagtcttttaatgtgcatgagaagggtaaaagtaaatatatgcccctatagagaaaaggaggtaatttatttattgcttttccatttttaatttgcccattctaaacaatgttccagaaggatttgtatgacttaatactttccagaaaatattctgtttttgtaggctaatggttcagtttacttctcatttcttcattgcctttcagataagtacttccacaggaacttagcattaaaatttgccttttcaaatgtaccatatggaattcccaaaggaaataatttttaaagtaccagtctcactcaatttggctgtagagctgagttctcttcctctcacaacccccttccccaatttaaaacattttcataaactcagaaacagaggagctaacaagaatctctggatccattaacattcagtcatgtagaatttctcagaatattcccatcttaaagaggatgtggagacaacatttgaatggatgacattatgtgtgtttcagaagccaggtgtaaagagcacttttccatacattttatatctgagttaccaatgcctcatcttccagagagcaggcagtaggcggcatgtgtgtcctgggacactgagcttgccttcctttactaagggctgtaactgccacatcaccatttggagtcatgacttgtaaagtactcagtcttatttgttgacaactgttgtgggcacctctcccttttaagtgttctaaaggaacaagttttgagaaattaggtcagttgaattttctaatatttttggaatgtaaattaactgtacaaaaagcttcaactgcagttgtaattgtagcttgttaaaaatgaaaaacagagatgtcagaattctattaggaaaaaataattatagtaatattttcctgctatattgaccctgctaattgtataaaagaaagtacattcaaaatttaacttatgtgtacgtgtgtgtgtgtgcatgtgcaggagagagagagaggtgttagagccaccagtttgctgaagtaataactttccttttcttcttttctataaccaagcataatatataaagagagctttgacataacatttaaagtctaaactccagccaatgtcaatattatatagcaaatattgactttaatcaaaaaggtctgactgatgttacagcttataagaacaaacaaaattgtaacacttatcattaaattaccactatagaaatatgtagatgataatctcagcccagtgaatgagctgattctcaatagataatggtcccattagtcagatattatcatttagcttatctatattacttagaaatagtttatatttaaataaccagaatagaagacttcataaatacacattaggttgtgggctatagatttcaacactatctatctatagataaagctataaatagatgaatattgaatatagtaatttaacacttaagtaattttatagtatcattaaaaggaatcacacttgagccattaattgtaaggatttgaaatgttagaaaaaacagttgtgaaattcacagagaaagacaggaagaacattctaaacatcatctattttggagatggaaaacaacatttgatttcatgtatatataatgtatcccatagtagggactcagtgtcagtaggctgagataacatacgagaaatctgaaagttctgactgctctgtgtgcttaggacctccacagggtaccagactttaccaacttcaggacttccactagtctgagtagccagggcacaccagtcacagctcagagagacacatccttaggtttgctgaaaacacctgtttctgagagcaatcatagtataatagctttgactcaataaagtgatcttccgtgagcaagaagatcagttggcagaaaaggaaaaggaaatgtggcacaaaaaacttggcactccactataagaaataactttacctttgttaattcatttagtcggtggattcttattttatttaatgagttataatccattactatcatcatttatttatttattgctaaaatttgaggtaattttagattcacacatagttgcaagaaagaatatacagaagtcctgtgtacttttatccagttttccacagtggtaatatcttgcgaaactatagtacaatacaatcttgttttttttttttttttttttttgatgcacaaattttcccagacttgaccagtgggagctgtttctagctggctcctatgtccttttgattatgaatcacttccttaatttctggaacaaaatacttcaggttcacctggtactttctctgcttcagccctggattcatctctcttagaagcctaatttcctttattggaaaatggtacttatagaacaagatatagaacaaaatggtacttatagaaaaggggataggtatacctttactaccggagtgccattatttctaggccatctcagcaaatagagctaggaaatatatacacgtacatgcacatacacatacatgaacacacatctatctctatttctatatctgttcatctgtatatacagcatattaaaatatcatgatgttataatgatctcaccaattccaataaaacaccacattccagtctttccccttttcttaccggtaactcccttctctaaaattgagaaatttagctcacatgatccacaatatacttagttatttagtcaatccaaatgtgctaacccctagcactgtgaaaaatcagttcaggtaagagtcatcaatggatcataaaagcagtgggtgaaagtttgaggagtaatgaaatatttacataatttctaagtatttccctacaaaatatttattaattgcaaggggaagaagtagcaaattggcagtggagaaacctggcagacaccaccttaagcaagtgaccaaagtgagcatcatcaggaatgagacatggagacctcctgtgcctcctgatgaaatgcactgaggggaacacaagatcacttttgtggcatttctgccaatagtacataatctggatttaactatgaggaaacatcagacaataaacccaaattgaggcacattctacaaaataagtgccccttttcttaaaaaaatgtcaagatagtgaaaaatagaactggagaagtgctccagggtaaaggaggctacagaaacatgaaaactaaatgcaaggcatgaatttagattggatcttggaccctttctttctttctttttttctataaagtatattattgagacagttggtgaaatctaaataaagtttgtaggttagataacagtagaatatcaacatcaatttcctgattttgataatcatattgtggttatgtaggagaatgttctttttttaggcgatacacaatgttgggtttacaggtagggggctatcatgactgccaattaacactacgtgaaagatatataggctattttaatgttcttacagcttttctggaagtctgaattttttttcaaaataaaaatgtttcaaaaaaacaaatgagaaatgttcccccgccacctcatcctcattctatgcattgacctttgtcatttcctggaccagtaattgggtcccttctaagtcacctgaaaccatcttgtttgcttgccctaactctagtactggctcagatgagcctgcctctgtacctctgtatcccatttctcctgttgatttctttcttctcctgacatcagaaaaccatttgaaggacagtatacacattatcctttccttgactctttttagcagctctccaatgaccatttgcctttagctgacccaagaaagtgatgcgctgctaaccataggtagtgtcctgtaattgcagatttcaactgttttcatatgcttagagtagcctaaggcaagtaacaatctgtgctaggagaagagcaaagactactgtaattcactttactttttaaatttacctctggaaaagaaagaacaagagagccaataaaacttgagggatttgttaatttgttaatttggtatttgatttgcccttacagctgtacctcaccttttagatatttttctactttgggaaaactttagcacactagtcaattatatattattttaacttctcgaggtgagcttctcatttaaagggaaactgagatcaattcttttgtaaaatcagtcatcacttcctactcttgttaaaggaatttttttctgtgttgatatgtcttcagttgtgaagtgcacatatatgttatagaaattctcatggcgttcctggtgttcagccttagacctttgacaaactcctggtaacatggtctcttgaaaggcagagtggaaattggggctaggcatgatgttatggcaatcatctggctcaggaaagcttctggaactagggagagaagtgccttcccatttacattttggattcactccagttcacattttggattcatttcagttcattaatttttttcataagcactataatactttaaaataataaatatttctaaaagaaacaatccgttctcaactcacttaaaccaatgtattcaaaaagccatatgaatgttattttcattcagaaaattacacatctgggtatggaatttgcttcaacttcaccatgttgagtataagtggtccctatttttttttaataaagggcttttctgtagttatctgagaacattcatacaaatttctttcaggtcattaaagtaaaaattttgatttaatgcggataagttattttaaagattttccttaagaaacatcttctgttttcctactgtgctcataaagttgataatcataacttaagttatattgatacaaattttgtcccagattccagatctgaaatatcatcaatcataaagatttataaacaagccagtaaaaataagcccatctgttttctactccaagggtgctaatggaggtgcacaccagtgtgatgtccaggacattttgtctgcctccttagttaatgagaaaatctgtggtagcccagtgctggctttggtaggttgagggagtggactgccatgcatgaccccatgacccttcccattccattgaagtttttcttcacccatgatgacatgaggcagtgtgttatcattaaaggaacactgagagcatctatcaggcaccttttttgttcctatgcaatggggcctttatgtacaaaaacaaagtataggtcaacacagctacagcaactggctaatcagtaaatgagtagattgtgcttgtgttgacatttctgttgtcaacctagtcatttgtttgtttaaatgatggttgttaacatatcaaaactaagcttgagaaagtgataaattggatgcgtgtttgtccaatggtttctgatgcaacatgatattttagcaaaaaccttctgatgtgcgcagattctccgatgaggttcaaggagtaaataaattattctgagggtaggagtactcccaccacatggcaacctgctttgaggcttctagcaccctcatcaccagctttccaaaccaaagaatgaggcttctggaaaacccacccatattttactaagtatcaccagatggttgtaacgattattaaaacaaaattggaaatggttttcctctgttgttgggaatgaagtgacataagtggctctcttggaatggctaaaatgataagcagcaagtgggtagtcaggagtttctggaggtgccctgttgcccatttgaatcttagcttaaccatgtaatcctgcgactttgggcaagtcccttcccctcttggtgccctggtttccttatctgtaaaaaagggtggttgtgcttatcagacaggttaatatgtgaaggggctgagaagagtgcctggcatgtggcaatacctgtgcctacttcatggggaagtcaggagcattagatgacttcatgtgtgtcaattatccaggatggtgtctgactcatattgagcacccaagaaatgttatatcgctactgttatcattattgtcattctcaggtcatctgtgggcagatttgccagccttttccattgaagagcagatactcaatatatggtagctattgttaatattatataatattatgcctggcacataagtgctaaaaaatgtcagtgtcactactatttaaaattgttatcacatcatgaaaatgtccaggaatcttccatttggttgaattaaaacattttccaagttaggtgacttggcaagtgttgccttggggtgatttttgcagactgttcataactccagtctttcattcccatcccatgccttcctcttttgatatgaattaattctatgcgttgagatttcctaagtctggtggcaattcttgtaaatttgctccttttttttttcttgcttgcaatgtcttatatagttaagctgcaattccccacatcaccagcaggtgctgaggactaacacaaaatatgtttcattctcgaattttttaagattgggaagcttggaatttagggaaaaaatagtgttatacttaggaaatgagaatattggaaattatataaaataagttggactacaacaagtatatcctataggtatggtaccctgactattcttgagagagaattgaaagcttaagaccatcctgtttttgtctgtttaatcatttacatttagcacatgtttgggtggctctgccaggtgttcagctgagtgctgtgggaccaatgatgaggaaaaaatggaaaacagacattaactttgccctggctttttctcttttttaggcatacagacaggaaaaatggccagtgaattgttcattaagaaaaatataacttctgtttattaaaatggactttattaaaatatatcagaaaaatgaaagcaaaaaatatatggtaaaagtatgaacataacattcaaatgcatcttgggatgatgaggtagaggcaaacacaagtcttccccatcccccatctgacacagtcttcacaaagcactgtatttgccaggaggactgaatattcgccttcacaaaagaaggcaatgaaatttagtactgatccaaataaaatgaaatcccatgttccagaattctgaatatttattttaggtacaaggtaaagggcaggttggaaaaatgtggcttgtttatcatcatttcatagaagatacagtaggaaaacattcagcattatggaacacgagatttcatcttcaggaaagttgccccgagttctactgaggcaagaggaattcaaatatgcattcatttgtgcatgactatttattataggtaatgcatgaagtagaaggaggagcatgggacctctctgagcctcagtgtcttcatctgtgtaatggggttgttgtgaggccctagggcatagtgtaggtgaaaacgtttgtagactattaagcagcatacaaatgtggaagatggttaaggggttaacgttttcccaaatattgaatttatgtttgtaaatgtatacagcatctatctgtctatatgttaagttggaagtatttgtatttttattaccaggaatcagatatttgactattttaacagctacacaagtcagctggatttcctcagcttttatttttatgtatttgtttattttagaatatttgtatatacatatgagaagaataagtattgatagaagattaattatcttttttttaaaaaaaaagcaaaatattgaactagctccttcctgtcttatttgttcaagtgttgttaacattctttaatgggggtttttaatcagttcatcatcatcaccaaaagtacatcactgaaatctagatttagtaagccctactaagacagaacatacaaattgatatttgtatgttttcttgattcccattttgtgcaaggctaacttaagatgccagtgactcacaaaacatattgtttaaacatgttcagattgctaacagaccgtactgttatgccttttagattccaataaaccatatgaaaatgctaattattgagtctacattaatttgtataaattatgcaaattgagtagcaattaagtattactgtagttgaggtggattccatgccattttttaacttaatgttggactgacacagactccattcactaaaacaaattgttttattgttgagtgtttacaaagcaattgctgatggtaattggttgtagatgacactattgtgcatttcagtaagatttatttaaccatatgcaccacaaccaaaacacacaaacacaggaagaatggtcaaggaatgactttatgacagttcattcagaaaaaacagtttctgtccatgaaaataggcattctttaagaaagttattttagaaacagacaaataagataaaggaaatcacttggagagatgtagttaaagaacaattgaaagaagtagcatttagcaagaagtcaaggcatcacattcagtgttttaagcaggatattgggaagtaattataatttgagctgcttccacagtatatggatgagaaattcagccctgatttgttcaaactaattgtgtatacttttgccatggtgcacaatgattctatccaaattacttagacataaacaaatattgtaaccaaattgtgagcctggatgtgtgtgtatgtgtgtgtgtgtgtgtatgtatttaacagtcggtcaaacagtgtcttcatactttatcaaacattaattagctaagttatgaagtgttggcatcttgggagcagcttagccaatttttagtgatgtttcatagaaggctaattctggaagagatcatctcaatccattatgtggaaaccaggaatttgcagtcacgctctatcaccactgaacagaactcaaggtcaattatcttctgtctctgggattcagagtggcttttgcaaatgtaaaggttatgcacattgatgcaataattatgaaaggaaaacaaatctttcctttcaccaaaaagtgttgtgttaaagcgtgcataaattatgattcacaaatatagtaatggctttaaggttgaaatatggtatccaggtgattagtagattgtgttaacctttgattattatttttttttttgagacggagtcttgctctgttgcccaggctggagtgcagtggtgcgaccttggcttaatgcaagctgtgactcccgggttcacgacattctcctgcctcagcctcccgagtagctgggactacaggcacccaccaccaagcccggctaattttttgtatttttagtagagatggggttgcaccgtgttagccaggatggtcttgatctcctgacctcgtgatccgcctgcatcggcctcccaaagtgctgggattacaggcatgagccactgcacctggcccgataatttgttttatgttagtttctctaatcggcggtggatttggagaatctagattgatgacaagtgatcttcctgaaaattgaaccaaaataaagagaatatgttatgaaatttctgccagggtcatatttatgccattattctaataagaactttaataaggcaaatctagaaattggttttactggcttcataaatttgtctttcatagtctccaactcaattttcatttgctttgacttaaaatatatcagcattctgaaaattttgaagagtgaatcattaaattcaatatttattacttaatatcttaataataaatgttaaatctcttaatggactgtatttcaaatacagctcactaagtcctctcgttttcttttaaaaaccatacttcaatgtaattcccattgccacttttgccagacatcctatttccctggcaaatctattgaggaaaaatgaagttttaaagcaaggtctgtgcttggaaaatctaattcactctaactcactaggtcacttagaaccaaatgattcaaatagaattctacctatagcaaaacaatggaagctgtacatagggatgtgagtgaaagccttgctgcttttctcagatagggtgattggatgcaacagtggcccagcacttagccacaagtctgaagacccctgcctaggaccagcttcatggctctcggcaagctgtcaaactctgtgcctgagtgtcctcatctgtgactaccatgaagatcaaatgatacacataggtgaaagttctttggaatatgaaaaggatgtaaaaatgacaagaattcagacttagttaatagagcaaggcatttaaaagttggcatcacatgtttattttggctcaaactgtggcactgcatagtctgcatttgaattccagaactatccatgttgagctatgcaaccatggacatgtcacatagttttgtaggccccaattcccacagctgtgaaatcgtgaaaataacactatccacctcataaggttgttgtaaaggttgaataaagtaatgtctggcacaaaaaaagactcttaataaaggttagatgttactactgggatacattgtattaatgatgacagaaagaaaaaccactattcttattttgcaagtaatagaagatgtctgactaagctttatttctttttgtattcattatcttccttccagaagttttgatcctcaaaactttattgaattgtcctgagtatcccacatttgtccatgtagttttgtttcatttctaaatcacatatccaatcttgttacctgcttgctcaatagaataggatggctcctcaaatgacaccctgagctgtcgtataaggaaatgataaaaggtgtggctttgtggtcagagagacatggatttgaatgctaactcttctccttactcatcatgtggcctgggtaaagttacttaaattctccatgcctcaatttcatcatttggaaaatggaggaaatcatagcacctaagtcatagggtacttgactgtgaggtaatttacacaaggacttggcgaataatagtcactcaatatgagagctgctaccaccatcattgtggttattatgatgtgattattatgattattaaaaattaaatccaaactcttgaggctgacatttagaagccctctataatgcgatctacctttattcttttcattccttacaaaacagttttttttggtattagtatggcccaaatattgcatgaggcatacttatattagctaatcattcactatgtgtctgaaattcaaatttaactgggcgtcctgtgttttcattgactaaatctgtccaccctactcacacatctatacctcccaccagtacctccaccttacttcctgccaggggacagaaagacttccagaaaggcagagtttcctaaatttacccatttctgaagtctctactcaaggcggcattcaggccctgtgccgggcattgtaacaagaaatattttttattatttttctttatttatttttattaacatttgttaattcttacttcccaaatatgtagtgtatagaagattggtgggcctactcactttccccatggctatagccttagttaccccaatcactatcctgctctgcagccccctaactgtcatggtggttctctgccctggcttcatcgtagctagtggcaacagattttatgatggtgtgactcagcattggcatgttgtacaaagctcctctaggcaatgccgatgtgcagccagggtgctgaataattgctaggcttctgcttcaggctgttccttctgcctagagtgcccccctcattcccattcccacattttttctttaagaattcgcactttgggagaccaaggcaggcggatcaccaggtcaagagattgagaccatctggccaacatggtgaaaccccgtatctactaaaaatacaaaaattagccgggcatggtggtgcgcccctgctactcgggaggctgaggcaagagaatcgcttgaacccaggaggtggaggttgcagtgggccaaagattgtaccactacactccagcctggtgacaagagcaagactctgtctcaaaaaaaaaaaaaagaattcgaccatccatttagaccctaaaccatatcactttattcatcttccccagactcaacactatctgccttccatcagcaggcaatcttgtgcctggttgtgggtcctgcaagattgggaagcctggagggctgggggtgcctggttggattcagtgtcccttgccccagttcccagcacagtcccctcagcattgctgacaagccattgatagctgcccaattgaaatgactgcgatatagaggcccaaactttctatgaagctaatagagacagaaactcattataacttttctaagtacttgtttatgaagaaacctatgcagatatctagtaatcattttatcccaaattgagataactgtcaactacctgtgttgaaactttaataaagagaataataaatatcttcatagaaaacattaactattatcaagctttgatttttagttttacgttgctatcctaagtccggtaaggttatttcaaaacccatagaggagacattgaagtggcttaattatttaattagcagtagtgaactttgggaattttggtctctgtatgtgactcctagacacccattgtgatatctgcatttttgcttaaaatagattaataagccaataggtttttttttagaaaatcttttcccatttcagtgaacagtgaaatctgaatctatagcttgcaactgaaactatttttccccaaagccattgagggcttttactcagtctgttgtaaacaatttattggtaaagtcttagaatatttgcattttaattaaagaaaattttaattaaattctaaactttgctcagaaaaggcaagtttgggcagctaatgcatggtaagatgcctattcagagatgacttaaacttcaggaattctgtgtttggtgccatttaaatagcaaaggaatgtgtgtctttcttgcttaaaaatatttcccagctgcctttggggaccctccccaggagcatacaagaggtttggaaaagctacagactggttagatgttgagatgttttagacagacagagatggatacaacaaatctgattgtcgtagaggtggggaaagggttggtgaaagatgttgcttaggagagaggtacatattaataggtacaaacatttactaaacaccttctatgtgctgggcaccaagttaccctgaattcaaagatgagttttgccaagatgatttacgtggtccaggtataagttgatgagagagcctgctctgtgatgggagctgtgggaatggaaaggaaaggaggagaaatttgtttctaaattttgattttttaagttttttttttttctttctagctaatgcttatataattggagcctctcggatcctgccgttatgctctagggcatatagtttgcagtgtatgtttttgtttatttccaggaccttttaccgagatccattcactgtcaatcccctggctgcatgtgttacttttcctccctgctgcttagctcagggcttcccatagagctgcttcgttttgggaggtcaggataatgatgctgcccctttgttctgtcctcctgaaatgaagcgctgatagcagaaggtaaaaggcagtgggttagggagaagcagaaatggccccatcagtcgcatcaagattaaacgattctcccatctaatggtaggaaatgaggcgttttctgcgagccaaaccctgatagctgtgtccttgtggtgccgcacaggacgtgcgggggtgtaggtactttgtaatgaagcaagttaagaaatagactcagacgtgggccatccttcccctcccctcaagggcagacttcagtgtcattagaccaaccttctacgtagtatcaaaacctcttattcagaaacactgacgggtatttgactgaattcaagaaaatgtactgtttctaatcttgtaactgtttattaaggaataaaatcaagcaaaattatgaggacatgtattggatgtttccctgtgtgtaaggcattgtgcctaatacagttgttctcaggtataggtgagcattagagtcactggactggtagaagcgtgcagattgctgggcctcaccctagagtctctgcttcagtgtgtctggcgtgggacttgagaagctccctttctgacaagcttctaggtgaaggccatgctgccggtccctggaccgcacttgaagtatgaggctgaaggtcaacttacgaggtccatgctttcaaaactttaatgtacacagaaatcgttcaggaattttgtagaaatacagattatgcctcagaatatctggcgaagcactgactaaatttacctgaaagtttaagcaaagcctattgatttatttgcctgaaaattttgatttatcaaaaacagtatttaaaaagaaaataagcctttgatcacaaatagctactgtttcttaaatccttactatgtgcaaggtcttgtgccaagtgctttgcatgtcttgtcttatttagtcattacactaaccttattaaagtgaagacaatccccgttttacagatgagaaaactgagggctcagagagattactcaagtcagacagctaagtaaatgacagattccagatctgaacctaggtgtggctgattttgaagccccgtgacttttatactacactgtttctcttaatagctacccaagatagtttccactctgaagacattaatttgatatttaaactgtctaccctactgtcagttatgttccttgctgatccttctttgacttgtcctctgctgagcagagtatttatggctagacccagataagcagacaggctctgctaaccagaaattaaaaaaaattttttttcattaagcatgtgatgggttatagagttgtaatttttcttacattttgggcaagctttaaatgtagtatgccctatgagagttacaggaagacaaagtaatctaattcattaagcacttattatgtaccttgtgctttaatatcttttttatcttgtaactctcttaaccatcctgaaggtaggaattaccctccccattttatggatgatattagagaagtttactaacttgtttagcatcatacagctaaacagagacttgaattgtgattggaagctggctacgttagatttctcagccatgctattttcgttagatcatagtgcctctcggtttcctcatctgtaaaatgaggagactgatactcattatacaggcaaataataatgtctgacattgattaggtgttcagcacatggtagctatttattatttttatgagaatcaacaagaactggaagcaacatagatccacaacattgtacaccctcatttctctttctcttgctattctctcctctttctgttgtcctctcccctcttccctttccccacccaacattctctaagattgaactatcttttttttttaaaaaaataaaacattgaactagctccttcctgtcttatttgttcaagtgttaacattctttaatgggggtttttagtcagttccatcatcatcaccaaaagcacaccattgaaatctagatttagtaagccctactaagccctacttaggctgcagtttggacacagggattttcaggtcagtagtgttcaccttgaccctcacaattacaaagaggagtgccattagattcccattaattaagggtaaatgctacctgtcactttgaaagttttggtcttagagtatgtctgtatctctgctttagaaagacacgatttaagttgctagatacaagatgtcatttcttgtcttttctcttagccctaaacatcagcttgctttaattagaaataacagtaaggcatctgctgaaagtatgtgcacttccattaatctagggttactcaagagaatggcaaaggggtttctatattacatttgctaataaagagtataaacagtatttcaagatgaggactaaaatgaaatacctaaaaccttaccaggtccagctggttcatatttacattgccagaaggagggattagagaagcactgcaaaagcacaacaccttctgcattcttaaaattaaagggacaaattgttatctgaaatgagctgcaggccagagggggaaagataaccatatcagcaggaacaaaggttgtggctgaccagctaaaaagtgaccttttttttttttttttcatgttctcagaatctaaaaatggaatcccattaaaatgcattaaaaataggaaaaaaatataatataaaaagccagtatagtcgcagatgctaaatttacacttcccacaacagggattgtgccttagtgtcattcccatcaacccatcaactgagcttccccctaagcagacaccacttcctgggagtaaatgaagcatttttgggagctgctctcccagttggtctcaggccactagggtcccattcagttagttattacttcaggacacttactggttccctagtggcctcaaataaatgattgcagctcctaaaaatcctgacttccagaagtagcttgtgcatgaggagaatgtgcaaaactcacgcaatgagataattctgaggcttccagaatcctgttacatccagtataaagctgtgaagcagccacagttggtgtctttcgttagtaaaaatcatggacatccttcaggaaagcaaaactaccctctcactgctagtttccttcttcatagccaagacgcgagaaaaaataaatgtctaaaaattagagatctttcagctacgccagatgcctttgaaaagaaacaactcagtcattcaaacagcctgattttatgaggtgacattttagattatgatatgacattgcagatttgacatgattgtgctaattgtgagaaaatatgctactttgatcaaactagaatgaaggaaataaaaaggcactgtggctcaacttgtaataaagagcagctcatcctcacagctttgtgattgttgctatagttatctattcaacatgggatgcacaatacagttaacgtttcattaccagtagcctgttgcgtgcttattgttaaaaggaatttaacatacaagtttttgtatgttttgttcgcctaattctgattcctcgtgctgactggcatgagacagggagctggattgtattaaactggttttattgtgatgtgactatgatggatgtgacaagggcctctattattcgctggggagtgtggccattaatgaagccattagctgagctaaggcaagtgaagaaaatagggaaattaccactattctgaagccattaagttgtaatccaccactttctctccttactcaaaaaggcatcttctttttaaggcctccctgactgtcctttaaagattcattaattcattaactttccaaggagatgggggtggatagcatagttgaaattttaatcagttcagtgtatcatattattaacattatggcagtgtctgtgctcattgctggaccacatcaggttaattttaaacaaaccacattacagcagatgtctttctgttctatgcataacagaagagcttccatttgtagagtactttagatttcaccatgctcttttatgtttggttgatacccagggcaggcactatgtacctctgttatacagatgagtgaactgaggcttagtgaggctaaaataacctgagggatgaagatcagccagccactagataggcagaagtgggtttcacccttaaattctcactgaacctttgtattaggaatcatgcttttcccatgtatagtctctgctggaaaaaagaaagcctctggtgagcacaaatcttttgaaaatgaataacttgtgtttattctgtattaaatgtttaaaaatatttatttagctaatcagggatttgcatcttttaaaaacaatggcggtgtgctctgtgcaagtcatatatgtgatatactaccctgtgggtggtttcagtttacttataaaacgtttagctcagtcaagttgggtgatgtctactacttggcaaagcagagtgttcttaaagacacaagctttggctctacagcccttagcgaaccaacatttcccaagcagaagttaggacagttttttcttgaaagggatagtgaggtcaattctatgctcaatccttgccatgctaagaaaatttgggacccagaaccagtgccttagcacatccccaaattgatgcctcttctaacctatttgtgtagatatgttgcacatataattgttgctacctattgcaaggtccaaatgggtaaaggatacacattttgatcttctatactaggatattcttgagacctcctaaaagggagcatgaagaactgaggcttggctggctgctgggcagaccactttgcttagcagccatccatgcagacaggtgcccacaggctgaagggctgtcaggggaaggcagtcacagcaaggaaggaagtgggataggaactgaaacaaagattatttctcctcatatatttatgagttcctctaggtgggctagagcctagagcgaggagaaactcggtatgtattgttaaacagaatggattaaaaggaaggggactgtggcttaagaattcattgagcagtctatcttttgggtcatccccgtcttcatcacaagtaagtccacacctggaaatggaacttttccctccaaaccatagagttgatcaccagggggagagctgtaatgaaatctgtttctgaaaccagttggccttactgcttctgtgtgagttggtgttagcaaatggttgcatgaaaccttcctgatgacttaccatcctctagagggcagagccaggactggatccgggcctcctaaattgtagaccctggtattcaaaagggggtccatggaacagcagcatcgacctctcttggtataacttgttggaaatgcccaatgtcaggtgccagccaaacttcctgaatctgagtctgcattgtcaaaagatccccagggaatgcatatgcacaataaagactaaagagccctgctgataggcttggttcattgaaatgtgaatcttatgtgcaatgactaaagattgtgttcttttgccttacttttacaaaagaagaagggaactgatcttgattggaccccctaccctgtgccagtaactgaatgtgcctggcatcctatatttctgcttgttcaaccttcacaactaccctgggagataagcactgtcttcctaatcttatagacaaggaattctaagctgaaaaacaaagtgacttgcccaaggccacagggtaattgtcaaggctggggtttgaaccctagtttgtgtgatttcaaagccttccgcatgacagcatgctgtagtagaaagcacagagagaaaatctggagatgtaattgcctagttcctcggggaacatctctagaggattgattttattattgttgtttaacaaccctaattatttgagtatattttttgtagtggcttacagcatctcttgataaacatgcaagaattgatatttggcagtattatgaaaaataacattggtctgtaacagtgttttaagtttagatacttttgtttaatgatctgcacgtcttactttcaactttttattaacagggttaaagtaagtgaacaactcttctgctcctaccatccatatcacttatttatttttgtccctccatgttctgtgaaggcagaagtcttttaagcctcaacagctaattacctcccctgggagaaagctgggaagacaagaaacatcgaaaaggtcaactcagtttaagctggtgatttgccacaatgtgaggtgaggtggtcactttcgaacttggagtgaatggtcactaagcggggaccttgccaggcagcaagataaggaacctcccagggccacccatttgcctcaggccttgtgttttatttcatagcctgctcgaattcattatatggttacatttttcccaaacaaaatactcaccgcttaaatataatccagtcctttccaagttgaaataattttgggatttgccatttgaattacccacaagacatctttcctatatacccatgactgtttcttaaaagaatcccagctgggaaatgatttgctgccccaaggaaacaagcaggtttacatatccccatccccaccctgctttcactctctctctctctctctgtctctgatttcttcaacttttccactagggccaactgagaatcctcccaatgtgtgagtgtgcacacatgtgtctcagtttgcctctgtcttagggattggggctgctgtaaagcagccttataatgggcagattttcctacatgttgattgttaatgagattaatattttctcccttgttatgtagggcaattctgtattcacaagctgtcatctttttctttcttactgtggggctttctcaactgtcatgccatcaggctcatgagcctttcatgagaaagacatgggcctcttatgagtccactgagctctgtccacatgaacagccagtccagtcactggcaggatctgttggtactgtgttacgatcaccacagtcatgagtaaatttgagaggagatgctgtgaggctatgcaaatatcccattgtttcttagagcttcacccactaattttagcatccattgatgaaagttgcctgcaggaattattactatggtgttctaatgatgattttctatttccctccttccatcaacctttactaatttcttctgtgaagaatcccttcttctatttatgcattattcaatttgtttttttataagttgggaatcatggatatttattttattctatgagttataatcaaatactgttgttatttattttgttgctgaaattgttctagctgtagctaggggttttctacccccttcatttctggttgaggaacaggctggagaggggaatgccttgcccaagatcatgcctttggagacagcaccagggttagaacacagatctctttttgaactcacagttcaggcctgtctccattatactgtgccactttatgaaacactgagaagtatctaggtacactgtctcactttgctgtgctttttgtttatcttttgattaatacagttttgattgtccttcagagttgggtacaggaggaaattttgggtgtcagcctgctgtgttggaaagcctttttgtcacagacaaataacttcactagcttgatctactgtagagtggaatttaaaataagctggatgccttttgtatcccttttaggttgttatccgataataagacagcataggtagggtgatcatgcacactggtttgtcttgagtagtcctacttagtgtctgtttttcaggtgtaatcatcagtatagtaccttttccccctcaaaagtgtgcatattttgatgatcagttatatagtcaccccagtccactggttttcaaacttttgctccacatcagagttacctggagggcttaaataaattaaaaaaaaaagagtcacctcgagggcttgttaaactacagacagctggatcccaccccccaaatttgtgattcactgggtctggggtggggcttgagaatgagcgtttctaacacgctctaaggtgctgcaggtgctgcgtgattaatgtgttgattaacatcaataaatttcttaatattgtaatattttacaccttgacatgatgctatggaatagatttatattaaaaactgcttactttttctacctagtaaattatgtttatagagatgtagtgactgacacaaaggtaagatagtagtaatagcactgctaattatattgctgtacataaaaaatgacatcactattatccagcactgttaatagtcctaaatggagttggatatagtaaccttttatttgaatataccctctaaatcttgctgaatctttttcttccctacagattttaaattttgcatagactccatagtttttatttgaagagaaatggaactggtaggggagccagcataattttccactctttatggcactgactttgggattgacacctgcgcaggtagaggacctttttatctgataggctaagggcataaactgacctcatgacttactctttcatataaaggagacacaaaagatgcatgtgtgcatgcacacacactaccaactgtgatgatgacaacaaatttcctttgtttgctttttcttggtaactttttggtgactgtcatatgctttctttctgcatcacttccccatcgtagtagaggattatgtatgaagaacacaatgtaagaactgaatttgagacccagtgtgtatcattgtatcatgctctgtttccacattgatatttccctgacatttcattaatattgtttcattaatactgcttcaatagtattataagcacagctcattttcttctttgtctatgctggagagaatctcttggatgggtacatcaatggttctaattatgtaatcaatagtaaaccaagtcttgaggccctgtgcctcagtgtttccttctctgcaggccagtatatttagtgtttttgtagtattgggtttagatgtatgatactgctttgtatttgctgtggccatatgcaaaaaagatattactactttagcactgattgggtctcagttatttgtgtgttatcatgcatgtatttaattgagcagctactacatgcaaggagctgtgagaaatgaacatgaggccaagatattgaccttgccctcaaggaatttacagtcttgtcagagagataatccatacccacaaacaccgtaaaaagtagacagaattaagaagtatgagagctacacagagaacatgacgggaattcaaagaaagtactactcctttctttcagtgaagggtccagagtggctctgaggttcattttgaacatgacgggaattcaaagaaagtactacacctttcttgcagtgaagggtccagagtggctctgaggttcattttgaacatgacgggaattcaaagaaagtactacacctttcttgcagtgaagggtccagagtggctctgaggttcattttgtacatgaagagatgagaaaggacaatctaagtggaagatacaggagaaacacggaaacaaacaaaagaatatccagggaactgtttgcagatccctttgtctggttgcatgacacagaatgtagcagaaagccatgaactagctgaaagtaagaaggatttggctggctgcagacaggcagtaccaaaatgtaagggcatactaattcactgtgggccagttactatgctagggatcgtatataccttctctcatttcatcctcaaaatttctctgaggaagggagtgcttttattctttccttgtattaaggcctatgaatatatttcaggagaagagcttccaaaatacttccaataaatatgtgggatggttaagcaatggcacaacaaatttagttgccgtgacctaggtctgtccaaaggcccctgtacaattcagaagctctaaagagagaaatatcaacttcccaagtgtccaggtttaataacatttgaacaaagaaaaagtccttcctaggagacctccatttcacctggaggtatttcctttctattagttctacctgtctatctacgtgtgtaccaagaagagggtcactttttccccttcatcctgcacctatcactctccactgctcataccgctaagctctttcatcatccgacattgacttgtaatttaacagaggccatgtgctaagcaggacattgcagtattggctggccagtttgactcagctgtcttcccactgcaagtcaattgtttttgcctaaaattatttcagcaagctttgtgctgtatctgtgtcacacttttggccagtttgttaatgtaagtgctccttggtagtaggagtaagatcaattcctgctttacctacctatggcccttggacaataccctctacccagtgggtttcaccaacagacactttgtggtgggcatattggcaaaaatgtttgactcccaaccactacttcccaaggttttgccatgcatagagctctccttatttgcacactggggctttctgtaactgcaatgtccatccatgtctaaggatgcagccaaataaagaagctgcttcccttttattttattttattttattatttttttgagacagagttttactctgttgctcaggctggagtgcagtggtgcaatcttggctcactgcagcctccgcctcccgagttcaagcgattctcctgcctcagcctcctgagtagctggaattacaggcatgtgccaccacaccaggctaatttttgtatttttactagagatagggtttcaccatgttggctaggctggtctcgaactcctgacctcaagtgatccacccacctcagcctcccaaagtgctgggattacaggcgtcagccaccgcacctggtctgcctcccatttactttaaaacatctgttttcgtcttccagtgtaggcatggtcataaggtgggaatacctttaatagttaaaatggattctgaacaattggctcatgaaattaaaagaagataaaaatacaatctttttggtatgtgtgccgtaatatatactggctagatacatctttaatcatttttaaagtattgaaatatcatccgtcatgaaaataactctgcattgctataaaatatttactttttatgatgtttttgttttagttaaaaagattcataggctaaaaggaactttaaaggtcatcagatttgttctcataatctaggaatcggccattctaggcgagtgaaaatgtagtttgcttctaacagtgtcctgaaaaataatttttcaaccttgaggtggggctatgtcaactatttccgcatcccattccttgcttggaaatagcagagactcaacaaatattcactgaaaaagcgaatgagccttaaaggaaatgcatttaattgggtagaaagcaaattctgaacacatatttgtagagtgaatgcgtggaagaaggaatggacagacaagacactaggaaattttcggatatagctaacctgattttctcatgttacagatgaaatcagtttcttcttattcagtttgcacagtgtaagtgagtttcctcaactagtcatcataccctctctatttgaaggaagttattaattcttccctcagtcccgtctcttctggctgagtaatcatagcctcgtttacctttcctcataggttcatctttccaagcctgtgagagtctctgtggctctctgatccccaaatacatcataatcctctctccgttttagagcctaggcctagatatgccaatgtgagatttacagagggattagtgagcattttgtatctaaacctggatgatgacaatcacagacttcattagtgcataaagaaaaccataagacaataggggttttgtgggatttgtggtgagtttttttcaaaattatgtttgaccactctttgctcttctttcccccagttgctatttctggaactcacagttgtgattagacagcatcagaaaaggaggctgctacctttcactcttggttattaaaaacaatatgtctaatagtttattatacattttcaaatagcttcctctaaaaactggagaaagatttctcccgccccatacaattctgtggctcagagattgtcttttagctagaaatattgatttgctgttgtttagcccccagtggattgcttcttatctctaagactggatttttgttagaatgagagttgacagaattcagatttagtcaagtgaggtgtgtcagagttggtaaaatgttaaagtttgagaacaaattggatattaactcaggaaattttgtgtgaattttgtcaaaagaagtgatttcaagaatcagggcctttgtggtgtatatttgcagagaataattatttaattgcagaagataattatttaaatgcctgagtctccttttgggggaggagaactgatttccacagatttgtttatacagattcagtcctaaggcaaacctgaaatgaaaaatcagtccaaatttttaacagagaattgcatcagatttggtacattcctatactggatgataattaatttttcttctttgtacttttttgaaatttctaattttgttttacagtggccctgcattacttttatacatgctcatatagcaagtaaaaaaagacacaagcatgtatcaaatatgacccctattttatcaaataaaaaaatcatatacaaatgctcccccatcaagctatgattttttgaccttacagtggtttgaaagtgataagcattcagtagaaaccatacttcaaattagtaattgaaatgcattttcagcttacaatattttcaacttatgatgggtttatcgaggggcatctgcgaatacgtatgtgcaggaaaaaaactagaaggaaatataccaaaatgtattgcgttaatggttattatcagtgcttgataagattacaggctgctttcatgtatttttcattcttctctatattgttacagtttaaagaacatgtatatgtgaatcagggtttcttaattttggcaccactgacatttgcagccaagtaactctttgttgtgaggggccatcctgattatcgtcctgagtttccctgacctagatacacactagataacagaaacacctattcctccataggtgtgacaaccaaaaatgtctttggacattgcctaatgtctcttgggagggggaaaaatcagccctgtttgagaaccactgatataaattaaacaagtgtttctttagtaagaaactttcaagccatatagaaataaaactaaggcttaaataactacaaataaggtaagcaacaacatggctcccctacactactctcttctctttccattctcagaagaatgaaagtgtgggataatggcctggttgaagtttacagagttgtcaggcgatgaatgattttgataagccaccaattccctccccataaaataaatagactacataaaacaatatgggcatagagatttcttatatgtttaggcacacaattagcacttaatgtatgtttaataataagcaatgaaccccttaccaaattagtagtagaacttatggtccttctctactctaaactctcctccagatgctgggaagtgaaaaaaaaaaaaaaaaaaaaaaaaaaagaagaaagaaagaaaggaaaagagattgggcaaaagttgagttgttttctgcctgtgatccttggtatcacaactttaaaagttttgttctggagaccctgtgtattgcaaaggtcccattcaagaagaggacttcctctcttttggagagcacctgtgcagtaaagggttaacctagcaagcttggggtgttccaaccctgcatattccaaaaacagggccaatcaagggcttctgggagataacttctaggtccttggaatattctgcctgatgagagggtctttgtatacctggggagttgagccacaccagatagtttatgctaacaatgtgggttatggtagtgtccttgggccactgtgtatcagtttgacctctggaggggctggagactgagtaactaaaatcaggcacgtgggtgctccatgactactgactagtcctcaataaaaatctggacaccaatactccggagagctttcctggttggaaatattttgtacatattgtcacacatcattgcttggggaattaagcactgtctttactactctcctgggagaggaaaactagaagcttgtactcggtctctcatggaccccaccatgtgtacctttttcctttgctgattttaatctgtattctttcactgtaataaaccataaccatgagtatagcagtttctgtgacttgagtccttgtggcaaaacatacttgagggtggtcttgggaacccctgacacagccacatgtcctttaactcacagagagtgatggggaaggtcagggttgaagcgtggtatgaaaaccccaaagccttgcccagtgtgtgtcaactctgacttgatgtacagcttgaactggctattttgtcctctagtaggcagggtcttcacaagccaggtgaatgttggaacccaaggacctgactggggggaaagctgcacttcatacctggggttctatccacctggggaggatattggtcagtatccccttccctgagaatcagacacatgtgtgcatttgccagggtttcccttgccaggcaagcatagcagaggtatggcctttaattgcctttggttctcaaagtgttctgagcagtatacctgaaccactatgcttgttggtctgctcactttgctgttttgttttttgagtagagggaataggtttaatattacaaaacaagtcttggcttgacagcacagatagatgcctttgcatgaatgaaaaagtcaaatctgggagaatggagaatggaagaccttagagctttagatttttctctaacatgttttattcaaagcctgtttacctctggatatggaaatcggggacatcctttacttaaagcctctgcagtgataacagcctaagttagggccccagctccattctaggtatttgttgcttggtaggaagaaaatcaaaacagtaagaaatgagtggttttacccatagtagcttgatcctggtggtaagacagggaattgcaccaaagatctgacaaatggtggggatttaaaaaatgctcaggatggttctcccctctgtgtcagaacacattatttgaggctaaaaggagaggagactcttctttatgtactttttaaattgaactgtaactaatacacaataaaatatacgggtattcagttcagtgagttttgacatttgcttacatccaggtaactgctacccaaaacaagacacagaccaactctgtccaatagcaatataatacaagccacatctacaattttaagtttttttgcagccacattagaaaaggtaaaaagatacaggtgagattaattttaacactatattttcaatccagtgtatttgagtcatcatcatttcaacacataattaacatagaaattataattaaaattcacattttctttgtaacaagtctttgttacaagcatattttatagttacaacacatttcattcagatgccaatattaaaaaaattgtggtagaaaacacataacaaatgtactgtggccttctctgaaaggggtataaagtgctcaggctgtgaatgagtacaggcttctggaacagagagctgtccttgggtttcacttcccagtgactttgaatcctgaatccctgtggtcagaaggcagactcctagaacttgatctgaagactgaaactgtagctgagcctctatctgtgtcctcaactcattctttgctgtttgtttatttcttccgtgtccccagaccctaacttccttccactaatattactgagaatttgccaatgaaggacaatctacagagtgctcccaagagaaaggcattgtaatccctggaagaacttataagtcagtggaagacacttccagacacctttaaaaactatgacatagccctccgactagaggtagcctatggttagaggaagcttcctcaggttagaggaaggtacaacatggaagtatggctaggagttgaggatgcaaagaggagggtctaagaatgaatagagtgtgggttaactgtcagatggccagctctactatttataggctgtgtcaccttgagccaattgcttcatctctctcggcttctttgccattatctgcaaaacagggataatacacatatttaccagagctgtcaaatattaaacaaaaaagaatattaaacatttgttgcaatgactggctcatttgctcactcattcattcaacagatattttaaaacatcaaccatatgccaggtgctgggctagttgctgcggatacagcaataaagtgaggtaggcgtggtctgtattctcttaaagtttgacatccagttgaggagttaaattaacaatatttattatcatggggagaggcagacatgagaaaggccatggtgcatggtgcagctgaagaaaagtgagaggtttaaatcaagtttacctgtgcctggagggagacagggctggaggttagcagagggtgataaaactgaaggagttagatcgggtcccccatcacagtctcaatcctgctgaaaaaagtttggaaatcttcaataagttttccaatatttgggattattcaagtattttaataaaactagaatagactattgtttctcgtggggataatggaagacactccagtttaatttgcatttgccatgtcttaccatcctgatttcagactctttaagattagggagcatgctatccctgaatcttccacccaaactgcttttgcagtgtagcttagacttagattcttcttgactctctgcatatgttggccagaaccgggtctggcacagaatgaatgttcaatagatgtgtgttgaatggctggatgggagaatggatggatgcccaagacgctggcagagtcagtctggctattccaggctcctcccacaggtcaacccctgcagagaagaggcatctttccattcaacagaaggggccctggcctagaagttaagatgtctgggtcttagccctgtctctgccattcatttgctttgtgatcttgggcaagtcacttaactcctctgggcctgttgcccaacctgcaaaacgaatgggctttgacctctgggatcgcttctgtgtttcacatttcatgatcatctggctcccaaggttcattttctccagtctcctggcccctgacactcacatgttgtgtaagctgctcactagcctatattgtgtggaactgaactcaagccaattaaaaacagagtacattaacaagagtttcagtgaagatgtctgatcccattgttgttgcaaaggattagtgaaggggctgcgagaggattatggtctctgttgaaacctgtgtttaattattcgttcctttctctgtattttcatcatacacccactgagtacttgaccattgctgtgcatgaagaagaggaagaattaatcctcatctgacctctatttaaatgatacattttagttttgacatagagtgattccaagttctgccctgataaggccagtttccgccacctttttgatctgtaacacgttctgcttcctggtttgagcattggacttggatttgtcaagacatgtccctcagcaatatcagcatttcttttttgggacagttactgattaagctcacagcactggggagaaagaactgaacagctagaaagatgacagccaatgactataggtttcccatcccatttttgtcatctctcacaaaactaaaatcaccataagaaatctttctgcatatgtaagagtctgtattttcagccttggaatattcattcagtttttatgcatctgattatgcacataccaataaccctctaatttatggatgcttgctattaggttttgtttaaatgagttccttccaaaaggaaccagccttctgttctaaagagacacgtaaaccacacgaggtgaattttcctacaactgatttcaaatgtggagttttcagggtgtaatttagatgtagctgtggtggtttatggccacagaaactgtaggtgtgtgtgtaggaggctacatggtacttacgaatgactggaagccagagagcagagggagagagccagcggtggagattttagctcagtttcacatctctaccccaaggcattagatgccgctaattcttcaaaagccgaagatttgttttacagaagaaattctgatttgattaagatattgcttccagacctaatgttcctttagcaaatcatgcctacatccatgattagaaaaaaactgcatgttatctaagcatagaaaagcctcatgatttgaaagtattctacagaagtaacatttagtgtaattacagtacatttagattaattatagccgtggttccgggcgccaccatacttaaggttatatcagcatttttgtttttaaccctgcgtggagtaagtttatcctctggctgcatatttttttactccagaaaatatttgagttccacataatgtgagaccaaaattgaatggccttttctacttttaggctaactttaaaaagatataatttcagagaggctattctctttaagattgctgtttttctgtagaatctcaaaataggcagagattaattttgaaaaaaatgaaaatggtcatgatgcttagataagaagttgacttgctataaatggcttgtgtttccctttgaaaggctttatcgcattggccataaagtaaaacctggttgacatttaactgccatgtctgtccagaacttacctatctgatctgagtgtgtggctccattcaaattgggcccttagggaggcaccatcttattccaacagttctacctgaccaggcaggtaacagtttgaaatttcatctttgtgaatggtctttggaatctgtggctggttcttttttaatatcatttattataaactccagattttcatttcttgatggtagtggtgattgtgatttttttgaaacaaccagaaagcaatttggagcaagatttggtgagtaaggaggctgataaggttgaatataggttttactaaaaaatgagctgtggctctaagataatgagcctaattttcatgcatggttcataactgtagctgaaggtaattccctcagagcagttctaaacatggttgaagaatgcatgtctccttgagggtagtgtatagtttcctcatagtgttgcttctaagagtcagcatttatttaaatgttaaatgtctggtagtttctcttatgaagagtctcattgtcttatagttatacatcatgtaaataaagggagatttctttaaattctaagtattggactgtaatgaagctaaaaattgttatcacttacggcctattttgctgttgctataatagaataccagagactgggtaatctataaagaacagagatttatttgttacagttctggagactgggatgtccaagatcaaggagctgcatctggcagagccttcttgctgtgtcctgccatagcagaaggtggaagaacgtggttcctaactgtagctgaaggtaaatccctcagagaaagaatgcatgaaaaagagagagaaagagagagagcaaggtgggagcaaggagagtgctgaactcttgaagatatcacctctcaacactcttgcattagagattaaatttctaactttgggggagacattcaaactacaacaacctgtcacgtataataaaggcatttcctaaatctattatctttatacaaatgcatggaaacattctcaaaaatatttgttaatgctagctaatagttggcattttattgagcacttaccattagtcaggcagtgtgtttcccgtgctttaactggtttacctatgactttttgagaaccttagagacccatcctttcaaatggtgccaattatattcacagagaggttaaataacttgtccaaggtacacagcttgtaaaatgctgagctgggatgaaaagtcaggccagtctaactcagggtctgcacattttgccacacctgatgcttcaatacatttgataaacacatgcatcctgagtagagccacagattactgcttcccagcattctagctgttctcttggttgatcaaggcaaaaggaaggactgttcagccatttattacagagcaagttgtatcaaatgaacaaaagaatcaaggcaaaagcagtgaatttctccagccctcacttggttttatttgtcttttccttttctattttgccctgctaggttatattttaccttttcacggtggagttgtgcgggcgagtggctcttatcaggaacaaatgatgccataaatccgggctaaaatcaatgaggttatgagctctaagagtgagatgcagttctgtgggcccaagtgttttcccttcttaacatgctgcacctttgaagccagaagccagaggcttgggtgttgttctattcgcagctagttctgtcatttacagacatatatatagctgctctgtcactgagctgggttcccaatacccatcttcccattttaaacaagaggaacgtcaagaagaaataatagagagtacgtatgctctcatgcctgtctccaaacatataagaaaagagacagaaaaggaagcgccaaacaaaaccaccttttggtaataacactgtaatgtaaaaattatagcctggaattcttgcaaatggcttcatcttcctctcttggagagactggcaccatctctttagccttactcagctaaagggaactgatttaccagtgccaaatgcattaatttagtaagaaagagaaaaatagcaatggatgccattcaattttctgatgactggttatggccattttatgaagtactgaattcgcttagaggaaacccatgaacagacaccaggcatcctaggtagtggctgtgagcgagaaacatgccactcaaatactgtgtcttccattctcagctgttggtgcccttagtgtgtgagatagtggtaataggagtgaccattgagatttccactccaaaaagacaggttcaatcctgtaagagaagctagtttggcaactggagttggcctgttctagttgactagttgggaaaatggacttcttttctactccctcatcacacagatttcttggcttggggaagggccattactagggtcacaacattttaaaaatatcactaatcaagatgaataatattttaatgtggtatttgtgaaaaatcaagacgcatgcagaaaaatccacaatgaataaacaatctgatttttttttaaactttaagttctgggatacatgtggagaacgttacaggattattacgtaggtatacatgtgccatggtggtggtttgctgcacccatcaactcgtcatctccattatgtatttctcctaatgctatcccttctctagcccctcaccccgtgacaggccctggtgtgtgatgttcccctccctgtgtccatgtgttctcattgttcaacacccacttatgagtgagaacatgcagtgtttggttttctgttcctgtgttagtttgctgagaatgatggtttccagcgtcatccatgtccctgcaaaggacatgaactcatccttttttttatggctgcatagtattccatgatgtatatgtgccacattttctttatccagtctatcattgatgggcatttgggttggttccaagtctttgctattgtgaataatggtgcagtaaacatacatgtgcatatgtctttatagtagaatgatttataatcctttgggtatatacctagtaatgggattgctgggtcaaatggtatttctagttctagatccttgaggaattgccacactgtcttccacaatggttgaactaatttacactcccaccaacagtgtaaaagcattcctatttctccacatcctctccagcatctgttgtttcctgactttttaatgattgccattctaactggtatgagatggtatctcattgtggtttttatttgcatttctctaatgaccagtgatggtgagcttttttttcatatgtttgttggctgcaaaaatgtctttttttgagaagtgtctgttcatatccttcacccagtttttgatggggttgtttgtttttttcttcaaactatactacaaggctacagtaaccaaaacagcatggtactggtaccaaaacagatatatagaccaacagaacagaactgaggcctcagaaataatgccacacatctacaagcatctgatctttgacaaacctgacaaaaacaagcaatggggaaaggattccctgttggaaaaactggctagccatatgcagaaaactgaaactggaccccttccttacaccttattcaaaaattaactcaagatggattaaagacttaaacgtaagacctaaaatcataaaaaccctagaagaaaacctaggcaatactattcaggacatagacatgggcaaagacttgatgactaaaacgccaaaagcaacagcaacaaaagccaaaattgacaaatgggatctaattaaactgaagagcttctgcacagcaaaagaaactatcatcagagtgaacaggcaacctacagaatgggagaaaatttttgcaatctattcatctaacaaacagctaatatccagaatgtataaggaacttaaacaaatttgtatggaaatatctgatttttaaacaaagacaggatctgtaacagtgccattctgagccatattgaagcctgaggcaaaaggaaaaaataagacatttcgatttttaacagtattgcattaaaatttcatttatcttgatgacagtttttttctggggggggcacctcctgttctcctcaaagtccagctctaatgctttctctctggggttttacctgatttttctctgtacccctcgccacttcagtgtgaatgtatttcacctctggtcatccatcaatactttctgcagatctccttatggtttctgccatggtagaccatattttttatgtatttgaagtatttgcgttttttgtaagacaatggcttccttgaggatgaagtctatgtcttttgctttttgtatccataatgccagccagacattttgtaggtaataataaacatatttgttgattgttaaaaaccaaaacatgagtgaatgaatgagttaaatgaataaatgaacataacatttgagatttcttttagcattttattagtggatttacatttcaacaattttcctaaatataaccttgggtcaattttgacccttaatttgggaaatcaaagtctcctggaaagaactggctctagggtattttctcttataaccatcaggcagggagtcttgtttgctaaatgggtaatgataaagtcatcttcatgaacctatccaagcattgaactcattttcattacatagaaaactcaagagcaattcagcatcaaattagtcagtcttaggacagagatgatattttgctgagtgtcagctttcagttgatgcttcatcaagcctatctggctttattctagggtgtggtccttatccgggtccctgcctcagaatcaggagtggggtgggcttctctttccagatgccaatccttacctgtacctcgtctcactcctactgagccaggatctctaggggttgacttctttggtcctagaaggaatgcggtggaatacactgcagcccttagtaatctaacctaaatggtctgtgtggccaagctgtttggaagcctactttacttttttgagggctacattttcttacccatttttatgacagtgattcagtggtgagtttcttttagctgaaatggttcaaccaaggggaaataatcttttttactaaaagaaaaaaaaaacagaaccagagtggggcaagttatacaatattcatgatcacttcaaattagagaagtaaaagtcaatgttgaagtggccccttgcatgtggagctattatgattaggattcacggtctgtgaaatctaatcctagttgcaggacactatgaaattattgaacttacatatgggaaaatgttaatgaaagtggtgagttcccacccactaacgttgttgcttgttttagaatttaagacaacagttatgccagcaaatgacagctttgttctgtctacctgatgtcaaatgactggtctgactgatttctttttaaaccacatttaatcaattgtcaagtcgctttggcatcacacagacacagcctgtgctgtgctgggagctgtgtattgatttagtgttaagaagccatggctgaatggtgagtaaaagtcatgcaacaccagaatataaaccatggaaagaatggagactcataatcacagacactgctgctcagctttcccaagttcttcagaaaagtacaacctctagtgtctcccctgggccccttgttttctgcaagcaactctccaaaagattctaaacctcactcatagctacgggtaacaagccaccaaagggcctcagttttgtcttctcatgtaagcagtcattaaaacaatctgtctaaccatgctttcttcctttgcttccccaagccctctggaaaccaaggctagagacataggtcagcttaactattccaaacaaaaccccaaacaaacctgaagacaactgagttcaggctgaaggtgatttcattgttattcccaagaataatagatgtctcccttcctctctcttcctctctttattccttcccctatctcttttcctttcttgacctcctgaaaggggcctgccaaactggaggccctgaactaggtactgggggctcagtggggaacttgatgcctggttgcatggagtttacatttcagtcagggtctgcagacatgaaaaaagccacaaagaaaggcacaatccagtttcagattgcaataactcatcagaagaaagtaaaacaggttcctgtaatgcagttacagaagaggaagaggccgactttagccttggttgtctgagaaggccctgtttgagccgaggcctgcaggatgagaggaagctggtcaagtgtggatcttggggaagcatttcaaggagacagcagtgcaattacaaaaggccctgaggcagggacatgcctggcttgttcacagaataaaacgagccttgttaaggatggtaactttatagaggatgaggttagggatgtaggcaaggatcagacctgtgggtacttcaaagggccagataagcaattggaatttcattctacctgcaatgggaagcgtttggaggagtttaagcatgggcagggggatctgatttacattttaaaggggcacattggctgctatgtggggaacaaaatgtaggaaggcaaagaaggcagtggaggccagctgggaggctgtcattgcagtggtgtgcaccaaggcagtggccatggaaggagagagaggttggaggtggagtccacagaagttactgatggatcctgtgtgtgtgtgtgcatgctgggggtgatggaggtgaatgaaagggaggagtccagtataccttctcaatttttgtgttgagcggccaagaggatagtggtgccatttgctatgctttatgcttatataactcggacagtccattgagatggtttttcacaaaggactaatctttgccaagtaagttttatctctggtgagacaacagtaaaataaaactatttgcagtactcaaatggttgtcttttactagcagattcacacattcatgtgtaggatttctaacatctggggactgattttcagcctgggttatcttccagactgtgagctacttgagggtaaataagacaccatatcttatttctcctggtacttctagtgtcagtgtcagtgaccagcacatgccaggtgttttataaatgcttgttgaaaggaagagaggaaagacaactgaccctctccagaacttgactatcttttgtttctaatgcttatcatgacaatgaagaggacacaaaaaggaaaataaaataagggcatctctgcagattaggaagaaaatttcaatatatcctgaagggaaaaaatatgatagaacaaaacaacagacatgctgtagatcacttcttccctcactgttgaaatattcaataaatctatagcagcacttacctaactgtctggtagtatcttagtatttaggactaaatttcaactcagttgatcctttgaattcaatcccagataagttttaaatatatatgttgttcatgtctgagacacttaggatgacaggtatattatcattaggctatattcagtaactaataaagaaattattaagaaagggaagtacaaaatgcctatgtaattgtagaggagctgcctcattcatttgatgcaatagagtcagtgagctgtctggaagaaaaactattttcctccaaagcatttggtagttccctcttgatttgaaaaaaaaaaaaaaaaatcaacgttactctgcatgccattttggaggcgttttgacatggccgaaacctgcctttccttttttcaccccagcctctgctctgccattttacaccattttccattcttaattgcttactcttctgtgcctttagtcttgctcttccagtggccaggaagatatctccctcactttctctacttcaagtagcctaattatccttcagtgctcagctcagatgcagtctccccaaagcagccttcctggacttccccaggctgaattcataccttcctccatgtttcctctgctttgtattatgtgcagcttttatggatgcctcctacaactacattgtatttatcttccacagttcctaggtagcacattccacacagtaatactcaatagaggtttattgagtgcttaagtggaattgctttaatgtcatggtcctgtttcttattgtcttcctctgcatcagaaggaggacatgtagaattggctgctctttgctttttacagcaggtcaaaataaatgcaagctctgacacattacatggaattgaaattaagaagaaagagtatgatgcttgttatcagtggaatcatgggcatggtaggagaaaattatgctagtgacaggactgctagtctcaacctaggaaactggcagtagttggctttgtgactgcagccaaagattataccatattatattagttgaatggttgaatatatatctgttcttgaaggaatagtatgtaattaatctctagtttttaaaatatatttatgataagaactctgtttcccctgtattttatttttcttaggttgttaaaaaaaactactgacatctttcaaacactttactcaatattcccccaaaagcatcagcagcaaaagtttatgaatatttttattagagatgatttggattttattcctgcaacacagagctagaaaaattttaaggtcattagccataagagttttaaatacattgtcattcgagtatgttagttttagcttcatagttctctgttatctttagcttttcccatttttaagttaataatgataaaaataaatttcatacttattagcttttttcatcctaaggtgtttaacaaaccttaggggtacaaatataatgtgtagcaatccatatgcttgctcataggtttatggccctaagagcatcatttgatcacaattatttttgtttcattgacattccacacaatcaactgaagaattgggtcctaagttactggaaaagtacaagtagaaactcttgtctagccagttaacgtgtctttgaatatctttatttctattcttccttcctttcaacaaccctttgttacataacagctatggttgggttcagagcccaagactaggggtataaagatcaacaaggttgttaaaagttcatatatatatatataaaatatacatgcatatctatgagttaggttaaaggtatatataaatatgtgcgtgtatagttagaagtataaatgagaagtacattgtcagatgtgtatacatatccttagtaattttaatttcctaattgtttactctctgccaggcactgtgccaaatagtttatgtgcatcatctcatttaacacttgcaacaactctgtgaggtatcattatcgtatggtgcaaataagaaaaccaagactcagaaatattattattatctattttgcccaagtctgtcagctaacagttgtcacagtcagggttgaaacccaagtgtgtctgacttccaagctcattctctttccctatgtttttaagtgtctctggttgaatcagatgctgatttcttcccagaagtctagattcagaattaaaggaacaaaagaatgaaagtattaaaatggttgcttgaatatcaaaactggatggtcatgaataccaaagatctatttgttttattatatatatatatgctctggcaatcctgcattggagtagagagtcagttctcagacaatagttctctatttgaatcagagcaatgaaatgcagcaattcagtgacagttgcatcccccttaggttccccaactgaagaccaccttctggctggattactttatggtgtggtccttttggtacttcagtagctaagaaagtgttttcagattaataagatgttgaaacaccagatgagccatcaaggggtgtgcaaggtctctatccttaagaatctccatgttgagaaaactgttcatcctagatagctgaaccgttcacctcttgggatctttgacaattctgtgatttttgcaagacatgcacacttatcaagttaatttcaccttaagccaaaatctcctttgtagctctttataaccaaagtgccagcaaatcaacaaggtgtctctgaccacccttggactggattagactctctattaggcacttgtggtactttttgcttcatagtatttcttactcttagagttcagtgattatttgtgtaatgcctgtctgccatgctggactatgaactccagttggacagagactgtatttgtaatgctcagtactccaccttacctgcggtgcttaaccttgtggctggcaaatagcaggaagtcaatatatatttattgatggaaaaataaatgactgaaatttaatagaagactgaacacatacaaccatgcagcggatttagtgttgatttatgctacagtgattctcattcttaatatttaagcacacccctagttcaatacctctttcatgacctaacagctctaggggttttatgtgatggagggcaattctgtttgcttggtgattacaagaggacagatacaatatttactagccttagcaattcctgagcaaatgtggtccctggagaagggaacatagtaataaagcagggaaacctagccgttatcttgaagcaaagccacacaggcatcaaggctgcagctcgcattcctgtggtctggagctctggagttttcaagggttatttatggtgacactgatgagacacttcatttaaatactgtaactgctgaagtatcccagaatgaaaaactcagcttacggtggagtcaataccttgttatttcttttaactctctgatataccattgtttcaaggatttacactaaaatacttgagtcttgagtcctaaaatgacccaagagagataaactgaccatggctgcctcctgtacataggatttggtttcttaaaatgaagctcactcttatctttactcagcccattgttctttaattggtcaaatgacgctataaatgaaggactttgatagcaaaaaataaatgttttatacattgctagaaaaagctttaggagaaaattttagcaaaagaacagattctttcttgtttctatagaaaccagtagtgatcaggaggagcgaggtgttcttttaagcatacacattagtaaggccagctcagcagtctccagcatactggagagctggagtcagagacccactagctgggggagtgcctctgtctgagtccttttgatatcattgggagttggggacatcttgctggaaatacctggttcctcataagctgagtagggttgcagtccacagtcactcagcatcatagagccagaaaggtttttaaaggaatctcctgtcaaaaggggaggaaaaagataaacataggaaagctttaatatcagatgtcaacaggcctttaaacatgctctttaccactgagcaataaataccctggttgagtcctgaccagatcacttataaactgtccaaagtacgcattcgaatcattggattgtatgacaatttgtttcccttttggtttgtctacttccataaaatctttaaaaaatgaaatttgaattaaatgtatcttttaaagttaaatttctagagctgttagattcctgacaagtgaatgttggacaagacttacaatcaaattccaaagcaaatacttttctaaagcctaatcagtactacagctttcaatgatttctctagtcttttaaatgaagtttaggtcaaatgtaatgacaggatgaagcagatgcattttgcttcaacctgacatgccccagaaggtaagagaaatatctggtaactgacaaaagagttttctgtttgcttgacatttactttgtatgtaaataatccagtatattggcatgtcaatatattagttagtggtggcccaaaacatgatgcgaatttagatagtatttctttctgctcacaaatatacactcttgatcaacaagagaacatttattgcaatcttgccttgcagttggcagagcagaatgaatcgttttgaaatataaacttcctcagatctaaaatatatcacaggaaaacacaagacataaggggagtggattatgaaataaaaggagcatatttcgtaatctataggttataatcattaaagattgccattagtaagatgctgggccaaatgtgtaagactacatttggtaagcaggtatgaaaagctcatgatttccttgaaactgttctttggaagcaacactgcattgtggaatggtaagaagtggccccttactggctgtgtgaccttgggtaagtcactttccctctctgacttcagtttcctcatctgcaaaatggtagtagtaaaaatgatggtgatggtgataatgatcatgatgatgaggaggaggaggaggaggaacagaagtaggaataggaggaagaggatttctctatctagggttgtaaaatttagataagaaaatctagaaaactctgcatatagaagatgtacaatgtgagtcatattcctttctactttccctaagaacaaaccatgttagtacttaacatttcgcttttaccaagcttttagcggtcgtttctttgctattcaatgagaactgaagttttgctgaaatatgggaaaagtaaccaaacatctctaaaaaacaaaacaaagcaaaacaaacaaaaatacaaggagtaagaaatatgccatattttctagacacattttatttcagttttttcccctgggtgtagagttagggtgcaaaatctatcaaattcttctattaattttaaattaagaaatgtggagatttgctatgttagaaccaaagctttcctgattctctgaggataactgtgtgtgtgtttgacctctagagctgaagtcacggtgttagccccttgtgacattagtgttcagaagctctttctatgcatggataaatcttggttgtctagcacaggttgtgaaacataataggggctcattaaatatttgtttaatgaataaatgaaattattatgcaataaaattaaaaatgtaatgtttaccaaactactctcagtacatttgtttcagtgattttttcatacaatcatacatgatatcagaccacatgtaatatatataaaaaggatagctgtcagtaaaatggaaagaatccttgtctccatctcactggcttgattgatatatactcatatccaatatttcctatagacaggctaccataattaatttgattattctttcacataattttgatggatcaagatgcagacgatttataatttctaccaatccaaagtgtacagtgtatgtttattttggtctgtaatctccaaacagtcattgtcatcatcatcaagcctactttgaaccgtacaagctacatagtgtcacatctacatggttatagaccctcagtatgcttaagatgaaatttcatatcacccaataagaaatcttcattatttattaagaatgagtcaggaagagaaagcagttgtgatttcttggcttatttctctgacaacctcttcaatttgaaccaagcaatcattactcattttttaatacacaccacacacataggtggatcaagatttgaagtctcataacatttagtaaagtagaaatacgcatcttcgtagaagaaatgtggaatgtgtacttgtattcttccttttcatttcaaagatagtgctgcttacaacactgatgatctgggcatgcagatgtgactgaaagggtctgtgtaatgacaatccttctacctgagacacaggacgttctccctttgcatagggcctggtgctttgtattggtttcctggagctgctgaaacaaaacaccacaaattggtgtggcttagaacaatagaaatgttttgtttcccagttctagaggctataacttcaaaatcaaggtgttgggagggctatgcttcctccaaaggtcccaggaaagacgtgttccatgcctctttcctagcttctggtaaccgcatccgttccttggattgttgatccatcgctccaatcctccacctttacatggccatcttcttcctgtgtcttcccatcctcttgcctctatgtgtgcctatctgtctgtccaaatgtcccctttttataaggatactagtcatattggattagggctgaccctaagaccctcatcttaacttgatcaccgctgaaagatccctatttccaaattaggttacattctgatgtgctgaaggttaagacttaaacatatttttttggagggggtggaaacaattcaattcataacaaattttcatactaaagtttgttctttgcaactgcacctctggcacttgtggtatagatgaagcattagctcaaaaaacccaactgtattctttggagctgcttttctgggcaagcctgtggactacttaattgttatcaaagttctaccattaggccgcttgacttgaagccatgcttctgtggattcttaaagatgacacttctgccctcctgcctatgattactgtgcatgattagctgcagcattgctttccaaatgttccagaacttggcatttccagtaatttagcttggactggtctctactctgcaccacccgctacccccaactgcagctcatctgggttcgtaagtttgggtctgaaagatatcaagaaaatttaaactttggggcacattttcagtgggaaaacagatggaaaagctgtatgggagtgtaaagtaaaagattgtattgatcaaagagaggaattctcaaagtcttgtagctaaacttattcctgtgggaaaagctgctaacccaaatcctcctagacaaataatgccaattaaaaaaaggcactgagttcactggcttaaaagcagtcattctcaagatagtattatcattttaaagcttctaaaagctttctgggaagcctgagtcggttcattgtcctaaggacagatggacacctgataaagtatttatggcccaatctaactaaggatcagcacagggtcaaagggccagtgataataggactaatatctctagatccacctacatataggaagcactttctaaaagttatgagaaaaaagattattcagcctgaggcattagcaactattttgattaaatattggtagggagcttaaaggtcatcatcaagtaagtgaaaagacacatcacagaatgagaaaaatatttgtaaaccatagatctgataacatactagcatccagaaaagacaaaaaaaaaaaactgttacaaaataattcaattaaaaattggcaaagcatctgaatagatatttattcaaagtagatacacaaatgctaataaatacatgaaaagacactgaatatcttagtcatcagggaaatgcaaatattaataaaaaccatgagacaccacttcacacccactagaatcactatgcccaagaagatacacagcaacaagtgttggcgaggatgtcgcgaaattaacaccctttgcttgtggaaatgtattaaataaaattatgcagacactgtggaaaacaatttgggaattccgcaaaaagctaaatatcgaattttcatgtgacccaacaattacgcttctaagtatacatggaataatatttaagacatatgtccacataaaaacttgtactggagtgttcatggcaacattacttgtcacagccaaaagtgggaatgactcaaatatccatcgactgatgaatggacaaactaaatgtggtctatctatacaaagaatattactcaaccacaaaaggaaggaagtactgatgtgtgtcacaatttgcactgcaatttggatgaacattgaaaacattatgctaagtgaaagaaaaaacagacataaaaggttacatattatatgattcaacttatataaaatacacataataggcaaattcatagagtggttgtcaggggctgctgggaggggagaatgtagagtgactgctaataggtacagggtttatttttgaagtaataaaaatgttctggaattagatagtggtgtttgttgcacatctgtgaatatgaaaggactacagaattatcgactttgaaatggtaaattgtattatctatgaattatatctcaggaaagtttttagaaaaacagtttcactaactagctttaacattcactgatgattctttgaaacagcaactagatatattgtttacaacttagaccaacaatttttatttcagaaagagtattttatcattggcatttagaattgctgctgcatggtgatgataaatagcagacagacttaaaaattgttagggaaattatgttagaaaacattaatcactctagttttgtaagaattcacccagcttccagaaaaagatacacaggctggtttcagtggtggatcaaccagcaatgacagtcaaaactttgtagtttgctggcttttcagttgtaaggtcagccatggactccatgaagcctctgggaccctgatccccagcacatccactagagggggagcaagggagacagaagaaacatgcaatgagtggtcttggggtggctaaaagcctgggggaagtgctatatggagtggataggaatttgaacttctagaccaacgtatagtttccggatattgtgagtgtctgtggaatgcgataatcgatactaacctcttggtctttaaaatggtgataaagacttttttttttgtcctcaagaatcacatggaaagcaccttaaaattagaatctgtttgcattggacatcagggatcttttaaaattacattttaagaaaaaaacatgtggaggaaggttaaatttgatgtgaacaatccttgaaaaccaactgcagacatttaaggttaacgtgtcttattcccacaacataggcaactttagtgttttttgcagtcatggaaacaagtttgggttaaatgatatagagatttgaagctttactctttgaagtgaagctaaaagatagaacaaatggaatatttcttgtatttggggagaaagaaaaatcatgattccacagtaaagttagtattagcggtcatgttccgatgtgacaatccaaactagaaatgtggggcaaatttctatttctgagactccaaattaaaaatcttggagctggattttttcacccttagcatcgtgtactctgccttgataaggaggagacaaaggataagccaacaatcttttaagataataaatatagagagatagttgagatttaacccaatctatatgtctcacagcaacatcaggggttttgatgacctgaatcatccaaagaaagaataaatattgctcagtaaggatttaataacaactaaattttttttattgtctgagtcatggaaatcagtaatccttgtctatagtgtactgatggctcatgaaaacattaattctcaacaatatatagtcaattcccaccaatcctaaaagcagattatctaatatgtagattatttctggcccttctgccctagtgacaaagggaaaagtcgggcctttgtgaatggatgtgattgaatagctctataagggttggtgtcgacaaggccaaagttagtggattcttcattatgattcatggcctcttgtagtcagaaacacccagcaaactgagccataaccacagctctgggtttggttgctttgatcttagtcaatgacctggaaatctttcttaataataggagcacacagattcattctgtagcacagcaaattgtttattcttgtttgggtcaaattgtttagggaaggggttgtgactgaggatcttacttctggaggcaaggaatggtgggctgaatttatggtactctttcctgccctgcccttgtgcttcatgaagatgatggcacaacagctgtggccttagtctttacccaactgctaatatctaataatagttactaccatttactgggtactggactgtgacttttacttaccttgtcgtttaactctcaagaaaaagctaagaagtacacattattgtttccatttcagggatgatgaaactgagagtctgagaagtctgtaagtatagtatcagtaactgctttcattggaatattgtgcagattcataaatacatacatagtgctggggtgtgtgtgtgtgtgtgtgtgtgtgtgtgtgtgtgtgtgtgtgagagagagactgagcactggacactgtgcctgggacaagagaagcactaagtaaatgagagtcacatttttttttgtccgacatagcactgactattttgccaatgcctacctagcagattcaataggtaatggttgaattgaattaaaatctcactaaatatttttcaagttggctttccttctgtaattagctttcttacaatttgagtggtaattggttgatggaaagaataattaataataaaggttgtttatttgtggggtgagcatttatcactgttctcattttcactcttttccatcagcatttaattcacgaaaaggagtataagttaactatagagaaattatattactgaatattgaatggcaattacaatacataatatgttttccttttaattagcaaatagactgttcattatgttttagataattgttacatatcacttcattttatttctttatcatttgtggcaggtgattacgtttccacagggtataatttttaatcacattattttgaaatttgattgcaagattatgcagtacagaattcagtgtattcaaatcaccctgaatctctcacattctttgcttctggaaaatttgcccttctttcttcttccctgaatatgtatgataagcaagaattcaaaattaatgaagcccagtactggtgtaaatctctctaaattgctcatatttagagatctttgaacttgaactcagaaacttcaacttgtgtcccattgcaatagccatctcttttaaaatcagtctttttttgctaataaatgcaaataatgtgtaagtgcaaataataaattatataataaaatagaatagaatatataattatctgatattataatattatatatataataaatacaaataataacatttctgactcctcaaggagctaaatagcatgtggtgtgttgtttctagctttcttctctcctgtctttgagtaattgggctgatcatgcccgttgttgcctgctatgggattgacactgcaagtttagctatgacaagaattcagtagcagtgtacaggttgcttgaacacagacagacctccctgcttctgttttggtaatgtttataatgaaggaaagatcataggcagcagcacctattacaattattgttatattcaggcattggcagatatggcacccagatgctttgctgcagtttgtcttaataactggattatctgatttcctacaagttctgcaatgacaaagtggcagcctttgggggaaagtttcatagaatgagcactgttttaggcaaggcagccaacttggtttaaaatcagatcctatcagaggaatgagcagagtctacaattataggtcatacaaagattgtgaagatattaaacgtgaagcaaaactctttaatttccttatttaattttgttctgaggagtttaaataatactgcttaatgctatcaggatgatgtcagtacttcgaggaaataactttcctatttagacttggtcatgcagtctgtttaacagctatttcctttataatggcatgttgcatttcccagcattccttagggcatgcaaggagaacggcatggtcttcttgaataattaatatggttttctgagcagtagtcatggaaacccaagcagtgtcacatatttggattataagaattaggcacattttgaatataacgtttaaccgaaaaggtggctacccaccaaaaacgaaagtctttttcccaattcccctagtttagcgacatgaatgtggtttggggtgtgtgtgtgtatgtgtgtgtgtgtgtgtgtgtgtgagacagagaaaaactaatccttgcttcataatacaattatttttatatttttgtgtttgaattgcttaattggttctcttcgctctatttttgaattctctgtttaattgaaatgttttcacatgcaagcttctgttttcatactttatctagggctgctcagtcacaggttattacttttttattaaagagaaaatgtagaacttaatttacaataaaatagcatagaccactcactgtcttgagtatctctaaggtatcacatcctttctaatgctgccccaaacctctgatgttattaggttgtaagattttcaagtgtgttagacaattgctattcatgaaaaagcctagtgttactgcgaagtttctagacctgctctattagaccagttgtatatatggttcttttatttgtctcaaaaagtgtctcttcagaatcaatatcgtcattaccttggatgtgtgtgtgtgtgtgtgcgcgcacacacgtgcgcacaagtcaaccaggcaatagcaaaaagctatcatccagtcttcagtaatggtgtacgtgaaaagaataaaaataactggaagttatttatagagtataaaccctctggtttcataaaccgtgtatgctgctatttgctcagttttattccacaaacaactgcagtgtctaaggctcccaaacctctgctttcctagactgatgaaggaagtgattagtaataccattaacaaataacagaagagtaaaaagaataaagggaagcaaagatttctttttgttactacttctagttttctgcctatttaaaattgtctttcttacagaaatgtgccatctcatggaaggaagcccacacatgtttgaactattttcttttgcactttcatttgttaaatgtgcataaatagtggggatcttcctcggagctccagatttttctctcatcttacactgatcctttctctatggtgaatatgctcagcggcatcatcttttttcccccaaatgcctttacaacaaggtattactgtgtctcacttgcattagggcccacctactttgcacccctgaggctgtgcctgtgctttcattaggattccaactgcatcgctggccaggcttccatccatctgttgataagttgcagctcctctgcgattctttttggaattaccaggcaaatactggactgatgcttcagcaaatccccaaattctttctttatttttatttggtcatgtgttacacttactttcactcttggcctttaacttttctgtgaactgacttagtcagaaaattccaattggaggtgtcttttcttatatcattttgcttgtgcttttaggttttggaaatttgtagtcctgtgcttatgaagtttacctgtttgcaagggcttgttgacttaatcccgtattatctccactttatcccttaggctctctccctgacagtccctttggttgtttcttaaaggccaaactcattttgataacttcccagcatccttcttctgcctcatcatttttctagattatttctttgaggactccacttaagagtcatctcttcctctttcatggtaccagcccctcccagtctgaaccaagtgccccatgtatagaccatggcatgacactaataggtgcgttgaagggatcagcttttatgtttcccctgctgcctgaaaactttgaggttcttgaaaacaaagactgtatgttattcatttttctatcctcagacctttgtacattgttcatcacatagtaggtgcccaatacatgttcctggcaatgttggttccatgttaaaggttgttaggctgcttcattttcttactgtggattatttttgttatctatagatgcgttctgttttgggggaaaaaacatcatgggatacttggagacatatctgtcatgtaactagcactttgcagggcaaaaatatttgaatatggactgtgaaacattggttgaacgaattagttttttctttaatgtgtggagggcatccagggacataaatgttagactctagacttttaggcaaatgttttagaaaggcacccctccccagtgaaaataaagtcaccattgtcaccttaattaattacaaataaaaaggtcttactttgaggtgggttccactagaaaggatgccttttcccagaggctgagctcagttgcagattttgtttctaggctacacgttagccatgcctgttagcatggcagctaagttgttttgaagcatcagacattagggctcttgtaaacttatagaaaatgtgtctatgatcaggaatgtaagcactctttgagtgatccagcagcagacagaatcaaatagtaatttggaataaaagcatttttgttgtgataattaagcaccattgttagattccatacgctgaactgaaaacccacgtatgtctgtaattgatggctgaaatggttgaatatagcctccgtatttgttaccagattggctccaatatatttggtctgtaaataacattggagtagtgcacacatctatagggagctaagttttacctgagatgcgcatgcacaattttctctgagttcaatgcaaggccaaacacaatttagtttggtgaataacaggcttttatcagcagcatgtatatcacagctacacgttttgaaaaataaagcgattgttgtcatttgccatagtaaaagagagttgtctgttgtaatatatttaaatgatgctgttagtcatttatgccccaacataaatgctgtttcatgtttgttttattaaatatagtagtatcgaaagaatattttgttgctcaaagacctacatgaaaactggactaaataaaattaaggagctatcactgcatgcagtgtgtggaaaccaagtaaaaagtttgatgttttgttactgtgactggaaaactcgtcatgaaactgacagctgagctttattaaagcatttaatgtgcaagatggccaaatagacatgataaaatatgaggatttctttagagtaaataatttgaggtgctatgaaggacatggaggagtggcagaattcagcctggagttcttgtgtgtactaagagtgaaaaagggaggtaggtcagcgtctcttttgcagtcccattaaactaatttcctttgggtcaggcatcactattgtgcagatagtgcatgatttttagagataacatgtaactttgcaaccctctctgctgccaagttggtaagagctcagagactgcaaactgagctgaacatgctatgctgtttataaaccaaggtgcatctgtggaactagtactttaatacttgtccaagtagtgctgcatttgcctggatacacttgcccattcatatccaggggctttttgcccagtgcctcctatttgccagatggctgctactggttatgagtcagtgaagcctgtggttatcaaattgaactcagcttctaggaggctcttagggggcttatccttggaaccagcccatccaccttttgtaaaagaacccccaagtaaaatatccgtcattggatatttatttaaggggaaaataggtaaaataaaatgaaaaatattatcttcctattcttttagccaagtctcttagcacggtagctaagctgttttgaagcatcagacaacagagctcttgtaagtgtaaagaaaatgtgtctagatcaggaatgcaagcacccttagagtgatccagcagcagacataatcaaatagtaatttgaaataaaaggatttttgttgtgataatgaagcaccattttttcattcagatgaagttgtagaaaagaccaaaacaaaattttaaagaaaattatttgaagttaggcacatttttgaagaaacaagttcataacagttttatatatatatatgtgtgtgtgtgtgtgtatatatatatgtgtgtgtatttttaaaaaataagcttaggtaagtgggttgaaataaaataattgtacttcttaatgtaaataacaaatcaattttatactattattacagctcttaaaaaactttttattttgacatacagaaagttataagaatcatggaaagaattctcatatccctattacccagattcctatgttgacatttgtaccacattgcttccttcttccctctctcacaaatatatacatatatgcacctcctacacacaaacatatgtgtatatatacacacatatatacacatatgtgtatatgtatatatacacacatatatacatatgtgtatatgtatatatacacatacgtatacacacatatacgtatacgtatacacacatatacatatacgtatacacacatacatatacgtatacacacatatacatatacgtatacgtatacacacatatataatatacgtatacgtatacgtgtacacacatatacgtatacgtgtacacacatatacacgtatatacgtatacgtgtacacacatatacgtatacgtgtacacacatatatacgtatacgtatacgtgtacacacatatatacgtatacgtgtacacacatatacacgtatatacgtatacgtgtacacacatatacgtatacgtctacgtgtacacacatatatacgtatacgtctacgtgtacacacatatatacgtatacgtctacgtgtacacacatatatacgtatacgtctacgtgtacacacatatatacgtatacgtctacgtgtacacacatatatacgtatacgtatacgtgtacacacatatatacgtatacgtgtacacacatatatacgtatacgtatacgtgtacacacatatatacatatacgtatacgtgtacacacatatatacgtatacgtatatgtatacacaaatacacttttttcctgacttgtttgagaataagtcacagacatattgaacataaagttcaatgtatacttactaaaaataaagattcttttacataagcacagcatattgatcaaaatcaggaagctaacattggtactaatctatctaaatactttaatctaaaggctttattcagattttgccaatcgttccaataatgtcctttagagcaaaagaaaatccagggtcacatggtgcattgggttattatgtttcttaagtctcctttaatctgggacgttcctcgctctgtctttgttatttcatgtccttgatatttttgaaaatacagggcagttattttgcaaagtgtccttcattttgggtttgtcttattagttttgtctttgttagttttctagtgattagagtcgtattatgtactactggcaggaataccacaaaagtgacgttgtgttcttctcagtgcatcattttaggaggaacattgttgatttgtcccattactggtgatgttaactttgatcatttgcttaaggtggtaaggtgatagaaagcttgtcacgataatgccaggtttcttccctataaagttagtatttttttctttgtaaatagtaaatatcttgtagggaagtactttgagactatgtaaatgatcttgctgctcatcaaaattttacccacaaactaattaaaaaataagaaggacatatgaatatgctcatttcttcaaagagcatatacaaatgtccaataagcatatctaaagatgctcaacatcattaatcatcagggaaatgcaaaccaaaacctcaaaatcaaaaccacagtgagataccacatcacatctgctaaagtaactatgcttaagaagacacataatgacaaatgctgaaaaagtggagaaattggaatcttcattcattcctgctgagaacatacaatggtatagccactgtgggaaacagtttggtagttctttaaaatgttaaacatagagttaccatatgacccagcaattttactcctaagtatatacccaagagaatcgaaaacatttgctcacaccagaacttgtacacaaatttttatagcagaactaatcacaataaccaaaaggtaaaaacatcccaaatgtctatcaactggtgagttcacaaacaaaatgtgatatatccatataatggaatattattcagccacgaaaaaggatgaagtactgatgcatgttacaacttgtacctcaacttggacaaccttgaaaacatgctaaatgaaagaaggcagacacaaaaggccacatattgtatgattccatttatgtaaaatgtgcagaatagacgaagacacagtgacagaaggtaaattagtggttgtaactgtttagtgatggaaggatggagtgcaactgcttaatgagtacagggtttccttggggttaataaatagtgttctggaattaataatggttatggttccataaccttgtgagtacactaaaaacatctaaattatacactttaaaatagtaaattgtatggtatgtgaattgtatctcagtaaagccattacaaaaactgaagtttccctcactagatttagcattcattgacaattctgctgaatcaattattattgtggtggatgccaaatggtgatttttttaaaaataggctttatttttaagagcatttttagtttcatagcaaaattgagcagagggtacagagattttccatatgcaccctgcccccatacatgtatagccactcaccataatagtatcatgcatagtagtttctatgtcctaaaagtccctgcaaatgctaagtcctcttagcagatagagttagaaaatccatgtgtatacatatgttcatatatgcatatgtatatacacacatctattatatattttttatctttctttcatacagacttcaatatagacaaagacacacattaaaagctacaagtttgtactcatactctaatttccatctgacataacagggttcattctttctttttccttttccgtatttataactcctttttctgacactgagaaacctgagtccaattattcactatatattaactaattaactcaattctagaatacacggaaaagtactttcagaattgctaacccatgacactatggaaagaagcctactagctagtgtacaatatttgcttagagttatttttgtctttagcctaaggacatatagtttgaagattgtgtgcaaaaatcacttacattagctcttagtcgccttacgcctccacccccactgtggatatgttattcatttgaaatatacttaagtttgcttatttctgtttgaattcctttaaaagttttgttttttcacctttgtttattttttcttttctttttgtaaaaaaaacactgtgaaacattaacatgctttcaaatgtcagaactttttcatttaaaaaggtatccgggatcttactcaacatcagtttatagagatcttcctcagtttaaagcttattttaattaaataaatctctagtagaggaatgttcaataatgtattggtctctttacaagaaaaaaaaagtcattttattttctgttttgaattttattttcaaattcctgggtctgagaaactgttaaaatggtggcagagtatgtccaaggaaacattagcattcaagagagaaaactaggaaaatgactgatgtagtaattaaataatcaaggaaggtattgaaaaactgaattttattgtgtctgcttgccagctgttaaaatgaggagcccaggtcagcttgacgtagttatttgcccctggagttaaatgaaatgattttttttttttttttgagacggagtcttgctctgttgctcaggctggagtgcagtggcccgatctcagctcactgcaacctccacctcccgggttcaagcgattctcctgcctcaccctcctgagtagctgggactacgagcacattttttgtatttttagtagagacggaatttcaccatgttagacaggatggtcccgatcttctcctgacctcgtgatccgcccgcctcggcctcccattgtgctgggattacagatgtgagccaccacgcctggctgaaatgatcactttttaactcaatgcctacttagtggcaagtgctatttaggacataaaagaaacatgagatttggctgctgactttacagaacatcagatctaattggagaaaccaaccaaacatatacaaaaagaaaattaaatctttccaaattcaggaaaatagaggtgctgttccaggatactaaataattacttgactaaatggattgtccctgcttccaaggaagccctgactcctctgagagtagttcaaaggtgaagtactctgagaactggattgatcggggaatgtctgaggatgagttagggttgagataatttttgggagggcacatgggtaggtgaaaggaaccagggatctactgcagaaggtaagacagctactgggtacaaacataggtaggactgtccagcggttttgatgaaagagctagagccagactccctggatttcactatggtggtcctgccatttattagccctacaattgtgatcaagtcactcattgctctaagcataagttaccctcatctataaaatggagtgataatagtacctgccacctagagatcttgtgagaccaaaataagataatccattcaacttttagcacagtgcttggcacagagtatgctctcaatacacatttgctatttatcatgcaaaagcatgagggcaaggaagcataagatgtaatttaagaagactgagtaggccgggcgcggtggctcacacctgtattcccagcactttgggaggccgaggcgggcggatcacgaggtcaggagatcaagaccatcctggctaacatggtgaaaccccctctctactaaaaatacaaaaaaaattagccgggcgtggtggcaggcgcctgtattcccagctgctcgggaggctgaggcaggagaatggtgtgaacccggcaagtggagcttgcagtgagtggagatcacaccactgcactccaggctgggcgacagagcgagactgcgtctcaaaaaaaaaaaaaaaaagaaaaagaaaagactgagtaaaccagtctgattgcattagaatggtcaagatgggagcagtgggagttaaagcccaaaatatatgttgggaacatactacattgttgtggaaggagcagtatagtagttaatacttatatgcaacttactgtatgcttggcactcatcaatgtgtttttataaaatgtatatcagtccatttctgcctctcgccaaccctgtgagaaaggtattattattattatcctcaatttactggtaagggaaaattgaggcacagagatgctaagtaacttgtccaagatcacacagcttctaagtggagaatcctgggtgccaggtcaaggtgtattaactaggcttgaattataggtttatacatacttggaaaaacttctttacctcacttccagaagatgtgaatatggaagtggaagaattagtagcaacagtggcaacgtttatattaccagaagataatctcagctgcgccatgatggaaatacatattaggcttttagaatttgtagagattaatgttccacaagtgttcatttcaggtaacattagctttctttcctctcataagtatacattattacaagaggataatactcagattgttgaattagagtggtgataagtgttttagtaaacctatggaaacacttctcaatctgagctctgtcagtctgcaaattaagcaaatatatacccagttcatcttttcagtgtagtttaaatatttgagacaaagaattcttcaatatttagagaataggacagatattggactaataagagatgctcctctgaatacttttacatatttcattggtgaccaaagtacttttttattatctatattataattgatatcaatagacagtttaaaccataggatcacagactgatagagcaggcctttagaaattttctggcccactctcttcattcaatctaatggggtaggcttagacagcatcaattacttgcccaaggtcacacacttaatacagcctctcttccctccttccctccctcgctatctccttcctttttggcttcctcctcctcttcttttctccctccatcctccttcccccttccatattttcttccaacaaacatttgaaattggacacattctaggtgctagacccaattctgagcactggagacccaacaatttacgaggtaaaagtgttccttgctctcatcactctagcctatactcttaataactgtttctagactagagcttatacactactccattactctgctgaggattcactgattcagataatctagaaggggagatactttctgcattaaacaaaaacagttgtaacatacagccagccttttgcatattttaggggatatgtacaagaagagctattatttttacattgattctaacagtgtttccaaagccagaaggagccaaccactccaaaattgaatgaccaatgggaaattacttttaaatatattactcatgatgaaaaagcatgcattttagtatatgaatattttattaagcaaagtgcctgtgactggctccagaattttgtaatacttagtgtgaaatatgtaataaattgcataattgaaaaaagaaaggtgattacaaaaacatggcttaaggggctaataactcctagaaagagcacaccaatgcataactgcttgagcattagaatactatatcttgaaaaaggcctgtagtgaaagtttgagttgaacccttaaaaggaaacatcacgctaaagttacctttatctctttgccaaaggaaagcggttgattgttgaaaagtggctgaagttgattgcatggtcagcctggccctaaagtacccttacaaatgagacagaaaatccagagttatatgccctccaactgagaaagcatatttattgacttgaagacatattagtttttcaggcatgcttagagatctactctctgttttccttaggtattattcattctatgtatcttcaagtcccgtaatttcccagacactctgcatactgtttgcccgtagtagatgtcacatgtaggtttgctgatagcattgattttgcatgggtttcagctcccgccaaaaggcagtcctttgagctcctctttagggagcataggtgtgcttttaactgtggtggcttcattagtcttggtcccttcaatgccgttagtggatttttaacagaaggaaactagcctgctcccttactctctgcagcacgggttcttatgcagtacatgtattcacatgggtcttatacataccacagcttttcaagggaatgaaatgtcaacgttaatccagaattggtgatatttgttcatatatgtaaaatgtagacatttctaatacaattatgtgggtctgtcaaagttactccttgaagtgacgtgtgtgagtagtgccatcgctttaagggtggcactcacaaaactggcagaggccatagatgtgcagcagacagtgaaggtttcacagctgtcacctcatcaggcctctactttgttagtccctccaacaaaccagagggaaactgtttatggagggcagagacgggactgattcatgaatcctggattccaatgaagatcatattgagtttgcggagtcgttcagtgattcaacttgcagaaactatcatgtagattttatttctccaaagcaatcattcctgttcacatttttaaaaaaatcaaaatctgagtcttacctgattggtacactttccttctactgtgaaagttgtgctttaagtaaaggcagcaatatcaaaacagtatgcaatttctactagcttaccagtgtagtcatgtttgtatggtcacccccatgccactgtcttcttctttttgatcatctgctctggattgtttgagagagcttgaaccaggctaaactaaagtgactcacagcactccctggtgtttctattgtgagtcggcgtcagaacttgtagaaccgcaaaaacatactcagatttcagttctccatgttcactttagagatcacatgagacactatatgttactgagtaaaagaaactgaatccatgccatggatccatatggcatgtggacagttaagagctgaactaggttggcatttgcagcaggggagttggaaaagtggcctgatcatacctagccagcaggtctctcggtgcagtgacaagacaatcaaattggcaggctttgagaactttcctctttcagcataaggagggaggggggcagagaggcagtgagaggcatttaactgtgctgatgtgactttttaaatttgttgccactgatgccacggacgttaattcttgcagggttaattatgagaaattaaaaagctgctctgaacagactgtacctttcacactctgataaagcaggctctgacatgagaacatctcttcattaatatccatccccaaagggctactacatgcagcatttggaatatgaatcttgaacttccagggacaatgcaggacaccatggagatagggttcagagaaggatgactatgcttcttttacattttcaggaaaacactgcagtgcctgcctggaaatcacctggctggtgacatttggaaaggataatttatttatttgcttgttggtatgttatgagttttgaaatatgattttaacttcatttcatgtagacctcactgcatcagggctctcagtgtctctgtgtaattcatgcaaacaccaacaggtaggcttgcagaagccttgtaattgtttaccatttagtatgtcacccaagtggctctagggtatgcatttgtttctcaggaaaatttcaccagctccttacactaggcacttttccaccagcctaatatattatactaaatagcaatcttgttacaccaaatacattgcagaaagtaaactgtgaaaaaataccagtataaatagtgcaactctaaggcagatgctggggaaaaaataaaagccttcctatacaatatgcttaatttgtattattgtaaccggaaaggccatgttttgaaggaaactcacctagaaatggaagtaggtaaaacagtcaaatgccgtagcagtgttacctttcagcaaagataaagccctattgttcaatggattgggaactgagagcggtcacagagcagctcttcatgttagagctctgttccagaactcaagtgtagttcccccttagtaagggcatctgctaatcattaccaccaaacacgcagttggaaagacattaaaatatactacctattttatactgcagagctggcagtgtgaacacagagcaattcttggatttgctggctctctgaggagctgacagccattggctgttagaaaaaacaaaatatgaaaatccatcaatatgtaattatctcttctcttttgtctgaagatcatattgctcaaagggatataataaggcacaacactgttattctgcctctgcattctgtttcatgcattttccttcctagtgagcgggcacctacctagaccttgcttctgatcgtccactaagagctatttgcatagccatagtctctacatgcttttaggcctccctccctttcttcctttttaatttctcaagcccctgagacatcagtggttctctatgagaagcatccttgcctctttatattcttagctaggaaatgggtgacaaaccccaatgttgcctcattcagtacctcagggcatcataccacatggaagtgttcttggtagcaccctagtggctttaagaaatacccacatacccttctagaagaacccaagaatcatgaggataagatagaaaggagcccaggggttgctaatttccaagacaaggagttgcctcatttgttgtatttgttttccttaggaaatgtttcctactcccaagacccagtaaaatgaatatttttcattatgatttcatagaggggtaaacatagatggggaaagaatcatatgtgcaaaataactggatcgtaactactcttgtggtttttccattcagaaaatacttgtacacagcaactcattggaggagggaggttgtggtttattatataatcctggtctgcaattttccttagatgcacaagatggttgtttctgtttctctttgaattacccgtgttgccctctgggtattatataaacgatgaacttgtatgttcattgaaacattaacaatcttcatccaaaatgtttggcataatttttcttcctcttgaactcattgcttttgctgtgctgctgtcattggtagtatcatccaaatataatattggacctaaatgccatcagcagacatgagccacagggaatagggccataggtcatcataatcatgtgaaatttcttgggcactgtttacatggaaggaacacttgactatatgtggaagcttgtctacaagtcagtcttctggcttaactctagggtaaagagttccaaagctctggaggcaggagacctaggttccaggcccagccctgctactgatttgttctgggcctttaagttaattaaccaacaagagcctcagtttctttctctccttcaggaatggagctaataatcatttctgctctgcttttgttactaagcatcaaatgaaatgctgtacaagtgctttagataccaaaaagtgccacgcatatgctggttattcttgtagtttgtatattattatctaagtccattatttaatggattccagccacaatcaactctttcaaggcatggactggatttattccatcattagcgaagaaatttccttttctgagagggccaagattacgttttgtgtaatcttgctttccatagaagtgaccactttcaagtactaattttacatgcacttgagcacttggcaaataaagtgaaacacttttttaaaaaacatcttttcttttggacaattgttgcaaaaccctgatatatcatttctcatcagggtaaggatatacactgttttcaactgcatttcttgttttcatcgaaaatgcagcccattcacaacttgttcctgtctaaggaaaaggcttgcactgctacatttcctcattagctctgcctaagacaaactcctgtgtcatggctgatggagcctttatgagctttttagccaaatgactgatgtttgcctcgttatgtcagatctgagggcactcctggcatctctctttattccctgtctaacaccatcaatcgagcagctgccatgcacccatgatcaggctgattatgaaaatgtgctcaggagcctgatgactccagttgttttttatctgaagaggccagtagatgctggctagagcttatagttatatgaacagcagattttgtcccaggattagcaggtgagaatcactggagctgagtccatagcagctaggtgagggccatgaaaactaacattggtttattatagaagaagctcctagaaggactggttttggccattttagtcattttcccatttatcccttagaagattattttggccttttcattttggtttcatgtcctagacaagtttattattctcatgaccatgggaagaaagctttttaaacccaaggcctgctataaaaaaaaaaaaaaaagtatatttttcataagtgcactttttaattaagataaatattttttatggggcacatcaaaatccagctgtaccttcatgaagtttccctgaatatatgatgacagcttttatttgctgctgaaattaaaagtgatctgtgaccttctctgatcctgagactgttactagcctggtagagtggtctgcaaatgatggggcttgggcttcattagggcactggcctactcctgtgagctagcttgatggggttaggccctgaggcacgtggcctttggatggagctcagctaagtgcctcatcagcagggagtcagctctataacctcccagctgagcccaggcaggatgaggttgaaacagcctattgttttttctcctctaggcttttttccttacccaaaagtagccctgtggcttttctctcttttctttcttacctagtctccctttgtatcaccttttacttggaaaaccagaaacctgtattataatttagttcagaacctcaggttgttctgaagtgtttgaaatagatcgctctgctgaccctggaggggagcccaggctgaccacaccaaaggacatcctcatgtgttcaggaaaacttggtgagactgtagctggatcttgatatgctaatttctagtcatttctgagaagctgtgcattctctaaaccagcaagttcttggggtgctcaaacaagtgaatgggggtaacaatttttatatttgcttaacactttttataattagtgtatcatggttgcgtttctagctactgacaaggagtctagaacatgggtgggagataaaatacaattcaaggccacctgggagtgaaagaggaagtttggcaaagaacgtaagttttgtaacccttgcctagtgttagaatcacccagagagggttgagaacaaacccatgtccagaatccacacctgaacagttaagtcagaatcacttggatggaccctgtataggaatgttttcaaagcttcccatgtgatttgagtgtgcatgcagccagagatgagaccactggtgtggtagaagaagcatgaacttctaagtcaaagatgggagtttgagccttgtcttatctctgtgccttattggtactgtggacttgggaaaaatcatctaacgtttctgtacctcaggatcttcatctgtaaaatgagaatcagagtaatagctgctatttattgagtgctttctttgtaccagctattgtgctgagcacattacatgcattcttgtttaatcttcacaaaacctcaaataatttgagagtactgtagttatctccattttacagatttagaaactgaagctcagagagtgtgaataatttgtccaggttgtatgaacaatcagcatggaaccagaacccttaccagctcatgtttactccagagtccaagcttttaaccatgattctagaaagaatgaccactaccaaaacaatttcttcacagggatatgaactaagtgagttaatatatgtttaaatactctgtaaactgtgcatggatatatgtgtggaagttgcatattagtagtggtaggagtaaaaagaataggctgggaatttcggtttatgaaacatcagagtcagttgaaaagctgtagacatgcaagcagaagtgagtgggatgcggctaagcatttgtgggctcttgtggctcggttagaattacaagacagcactttagaactgcttagcctgagctagtcaggacttactcgggtctggaatcaattcagaaatacatctggaacaccctcctgaggacctctttgccttttgtttatgtctactaaatttcaagttctttctcagtttacagaagtaacatcaggcacataattcatgttttaaaagaagagagaaagagacgtggttgtcatatgtgaattagctgctttgacttttttcaatagtggattgatcacatgcctctaatttaactcccttttaaaaccacaccaaaactacaataagggattttttttttttaaagaaactcaaaaggactggagatatgtgagaggaaataaccaaatttcagaagctggaaagcatttgagcaaatattagctgatttagcagatctggaaatccaaatcctagcagtgggaaagcttagaatcaatacagttcacactgcagaaccttcaaaaagccaaggaattggtgatagcagatatcccttgaagcaggagtgaagagggtataaaatatagaggattgattgaaagctgtgtaagaagttagatccccaattcctctccctcactcttactgctcttcctttccccagccttgcagaaaatggaactttattttttggagaggataaaacagaggtttgttgtcctggagtacttttctggaaacatggatttttagtgaacaaatgcatacaccaccagctacacacagggactgccagtttgcttccactagaatgctggcagcaaggattcactgtgacattccagaaaaaaagaagataaagagaaaattccacaagcctccagaaagaaggaagaagggaggaaggtaggagagagggagagaataggtatcatgcaatgggacagaatagctttggatttcacagcagcacttgaaactcaaagacaatcctgaaggaaaataacttccaccttaatatttctacttagccaaattatcgataaagtgggaagataggataaagacattttcagacactcaagatctcagagaaaaattgacctctaaccaagtttttctcagtaacctacagaggatgtatttgttcaccaaagagaaggaataaataaaaggagaggaaagcatgtctataggaaacaggagccataacacaggagagaggccaaaggagtctaccagacagtggtgaagagaatcccgatgtagagggcaaccagttgaggttgaagtaggtcagaaagctctgaatgaaatttatgaagaaaatgaaatagatagctaatgtgagtaaatgtattgacaggatttatgcagctagtagagagtttaaggttggattagtgatatgtgcatagaaaaatgaccaaacattaataaaaagccagtcatgatgattgactccaaaaagttgctcaggaaaggaaaatcctagtttagtacatggcttaggtctgaataacatataccatctaaaaattgcaaaaataaaaattgatctaactaaacttttgacgtaaatatgttgggaagatggagggatgacaagtattccagtatgtagtagggaagaggaaagcaagaaggtcaactaaatgctcattttccacagaaggaagtcaatagataatacctaaaaataaaaaaatagcaatccagtgtgttttttagagaaatgaaggcaaatgctccaagaataaaataaagttataagcaattgcttgttgagaagaaggaataatctaggggtgcagtggcagggctgggaactgctttgggtctttaagaagctttgataggtagttgactcttgaaatcatcatatgtatacatcaatttgataaaaatccctaacatctactgtgctctttggcaaatacaacaatgaaaactgccttgagatagaaaatgaaatgcacaaagtagtaatagaaactcctttccttggtgtaggagataagatatatatactcctactaagcaggtgatagttacaaaagaaagaaagaagtccaacagtaaagaagcaaagcctccatcaaacttttattttgaaggaaaaacaatcaaacaccaatgaaatgggctgtagtacatctgaaggaacaagagcgccgcccgcctccaaccacttcatggccacttgtgccctggtgtgactgcctagtcaaggggccagggaagctgcacaaagaccctttcatctagccaggtctctctccttaattgcttgcaaatccagtagagctaacccaaatacaataggtacttgagatgtagcctctgaaaagagcataaagtgggacgactatgttcccatctcctctgacagtaggaatcaggatttccctggaatttcccattagcctcactttttagtatttcagctctcccaattaggccaaatagtgatatgctgaatgctggggcagatcctaaatgtcagttagcgaggtttaatgaaagcaaagagctctgtgcacaggtaagtcatattaacagatatttgtagtcatttgcataattgatgtgactaaatagtttaatcaggagaatattggaaatatttgttacacttttagcctccttttgtattgctctaggataaaaactgtggagataactgaaagtattgactaactcctcaggggatgtgatatatcttttgacaatgaaaactcccaataaattctcagcactactaaggaacaactcaatggaccatgttaacacttcctgtctgtctgtcaccagacaaccaccaggggttactatagctaggctctctacagaaagggttatgacatctgctggggggcagatgaaggggtctggcttaccctattttctatggtgaagctacagttagttaatttgaaattaataatgccttagtggagtttaccaaaaacctctgcttgtggggccttgcaacaaagaggagaatgtttaagccgaaaaatgcttaatgtcttttaaaatctcaagtcgggctgctttgtgtgttaccctatgaaaggccctatgaggtggtggaggagctgaggagggcaaagaggggagtgtggtaatctcaaaaagcccagtgagctggacagcgatttcctttctctgtgccaggtaaaatcagcacaggagcccttaatcgcttgttgttctagggtattattaagtgaatacatttttcatggcccacctgctagtgtaactaattaacagccattctcattaattacattgatcaggatcataaaataatttcaaattgctgagcatgatccgcaggactaaaatggtttcactttaatcccttaatgattttttcatgattaatcaaacaaaatatatgtagttatttgatccacttttttcatcttagaactgcaactcagggcaattatagtcgacataaagttgatacaaacagaactacgtttcatgcagtagctaattaagcaataagacacaatggggtgagggtatatgattatcatgagataatcacccccctgaggagtcacagagcaaaaggtacagttgagtacctctgctcccacagggctgtgattaccttcgcataaccacatatcccgccggcgccttattgctaatcgcaaactcttcgttttacacggaaataaactgaggaaaaatgactttcatcataggaaatggctcgctgcggtataaaggtttcatctattaacagtgacaacattaatgcgtactttggaaggtgaaataatcaattatgctgttctcacatcatcaataggagttgggggattttaaattgatgtttatactttgaagagtacgtacatctggtagtttgggtgtatgaaattaagtatacaaatgctcatacatctaataattaatgtttgatttaattggaaaggtcttgcttttaaggtactagacatttttgaatgaaattataaaataatagtaaggcaactcatttccaaagtctaaaaaagagaaacaaatacatttgctaaattttggccataattcctcaaatcactgccagcattaaaactttcacgccatcttccagccagcaacaagatgtgaccaatgggaacacgaggccatttaggtgaaggagatagttctggctctgagacatggttcgtccccttccccctccccataaatgaataaaaaaaataaaacccaaacaaacaaaaacgaagtaaaatgaccaatatccttcctgtgccatggccaggtggcagggtgagaaggccctgcttcctagagtgccaccatcccaaggcactagcgttctcctatccttgcctgcacactgcatgccatgggaaaccagaattccttccaaccaccagacttagttacttcttcatctaggaacaataacggtgttagagcaggggtcacacaaaagaaaagcaaaataaacagataaaaacctactaccctttccagcaacttccaaacaatacagagtagagatagaatctaatggttgacaaacatacctttggctaccctggctgtgtagtgtttgcgtttaatgtcttgaacgatttcgttcttgttaactataaagagatcccttgtaaactttaatgatattaatcaactaaacttcccatttatcatgaaaaataactatgtatctgatttatgcctaaaacaatcagatttatttcatttcatgtttcccttctgtcgggctaaataattatggttttctcaaaagtggtttctttaaaactgtctttctctatgttaactctagaacggtaacagagtaggtaaatagttgttggctcttgaagaggttcatccaaatttgcccaagtttgtctcaaaattagaatgcctggtttagcatctgtggacttcctgaaggaaatgcaatcatgtgcttattgtgaccctgtgaaatgaatataagttgtgtcatatgcaggatgcattactgactttatgacatgcatgcattgaaaattgagtacgtcctatatataaaagcatccttcaatttcttatattatgtttttaaagtaagtcagttaacaatatgatgaattgaaaaatatatatgtaaaacaactggacatcagattcaggaattttccttaacatgttggtaagtgaagagctgtctttgaaaacaagagtctcactttaaccttgctaaacattcaattcaagccatatggcttgatcagtccaaacatttgacttgatgtggctctgcttggcatggggttctctaccatagagaagcagtttttgtggtcagcgttatgaatgaccaagactttgctgaaaaacaaaacaggcagaagatataggcaatcagtatgatcttgaaacattggcttcatattgagtctgctggtctctcagcttatctcgggttcacagcagcactcaagcttacattatgtattacgaagaggaaatgtcagttattaacttaagtagcataggtacgaattgtaaaagggcttttaaagtgccaaatgctggaaaaaggaaattaaatgtagttatttatgatagagctttagaaatacttagatttgttcttgaaagacctggcatttagattttaaatcatgttcagtcctcgaacttgaacaattcatgcaaaaataagaataaagacatcttcccctataatcatctaagtgcatgtatgtgtatttggccatgatttctgctcccccatcccccaaagcaatcaaccatcacaactttctccttcaataaaacataacactttcttctgtctggtgagttgaaatgatgacaggtgaaaaaattgacaagtgaaggacatttgtaaacctctttcaattgagatcaatttttggtttttgtgtatgtgtgactcttccacatttggtggatatcgtctagagagatctttgcacttgtgaacattgcaggtgttttgatctttccaagctaaggagacttggtagtcttgtgtggaatttagcaacacaataggtctttagatagatagtccacatggtttcaatgaagtgccatttaggaattgctcattggcccaaacaagtaggaggacagcttggcgagacagatggaaaaggctgctttaagaagggatcagaaaaggcattgctcctctgccggcctaaatccactaatctgatgttattattagcgataaggagcagtagccagaagaaaatctcattctctacaaatgtcatttaaataggactctgatattttctggtcaagtcgacgggcgttattcaaatactgagcactttatttgtaaatgcaagaaggaaagaaaagcttcagttcagcagtacttaggacgtcagcttactagtattgattaatcgttcagtagtggcagctgcttctttattaaatgtgcagctcaccatacaaaagatatcaggtgtaggaagtgtttgttgataattcacattttctcacaatgtggcagaacctactcttacttgttcaactactgttcttaggagttcacctccttccatctccagatgcctgccgcccccaaactccctgtgcctgctcccaagtcagttagtaggctgagcctcctccaagcaggcagtgactgcaacatttaaaaaacatatttggaaatattttaaaagtgtcccaagctaagtgtagagcaaatgcaaaggctctgaggtatgaatgagcttggcaagttgaagaaagagaaaggaggccagtcttggcaagaagagagtaattaagttggagagtggcatgaaatgatataaaagaagtagggaggacagatactgtagggcctggaaggccatggaaaggagttacatttcattctgagagcgtttcttttacatttctttttctttccttgtcattgttttgctctttgggaagatcttgctacttaagtactaatttcaattatagatgtagcacatatattgctaatgagtcatattctcagaattgtgaaactacttcttacttggggaatgaggcagcttaagaagctgaaagaattctttgagaccactagaggtactgtttagcaagttatctgcttcacagaaattgtaccccagcgagggcaaatattttctgaagttttctaaaatatctcacagtcggaggtgagtttacactttaggagagcctggcatctatgtaaatcgtcaatgaatttatcccaaattcacctttaagaaacaaaagtccagtaaaaaagctttctaactctttcccatcctttaagatcagttttaagttcatcttcctttagtattctccagctctttaaattttcttggcatttaacttcagtggccctcacttggcattcagtataaattaagtgtgcatgtattacaggcatatcttttttttctccctccaacgagaaagtaggaatttcttaaggttatatctttagtacctgaaatccatatattgtgaatttttgagaacaattattataaaagattttaagttccataaatcactaaaatgtcttataaatttcaatattttaatatcccagcgacaaactctatatgcctctttctgcaaacagcataaaaatgttttgttaaatcctatgtctccattcaataatggttttattgtgctcatcaggaaacatggccaatatattgattattcattcctcattaaataaatttcttttgagtcattactgtgtgctgcatattctggatacttgaggatacaataaataaccagaccaaacaacaagtgatactgttatgaattaaaaagccttggctactagagtaaggatgcatggggtaaagtgatggagtgagggcattacctttaacagggtgctcagaagaaggcttttcagaggaggtgccatttaaaaagagagcttggagaaaattgtcccatgctaagtgtatagcaaatgcaaaggctctgaggtatgaatgagcttggcaagttggagaaagagaaaggaggccagtattggcaagaaaagagtaattaagttggagagtggcatgaaatgaaataaaagaagaaggcggggacagatattgtacagcctggcaggccatgggaaagagttagatttcattctgagagcagtgggaagttgttggagaatttaagtcagacagtggcaagattcgatttatgttttattaataaaaatgtagtcctcttccatatggagaatggattggggggtgtgggattggagggggtgatagcggaggatgagagaagagttggatgtttattatggcagttttctaggtgagagttgattctgacttgggccagggtcatagaaatatagatggagagaaagggaatacattttggaggtaggtagatgaaatttgctcttggggttgagtgaacaaaacgaacgaagaaatgacttgagagtgattgttggggccatataacgagaagaggctgaagaacaggcaatgtagagtaacagttaagagctccaattttgccatggagcagccttggttttgatccttggacatattctctaagcttcattttcctaatctgtaaaaggtgaataatagtagccacttcaaaagttttttttttttttaaatggaatctgtaaggactaatgcaggtaaaatacttagcacagtgcatcataaataataaatgcttagtagataattacaaaggagtcttaggagagaaacaactttggaaattcatgtaagttattttttttaattacataactgatgggactttcccctcttccaatctgaagtttctgatttgacacattaaaaagtcaagaatgtgtctagtgagtcaagggtaatgtcagcagcacagctggctgtcttgaaagatttacctccacaaaccataagaaataacaatataggaaaagtaaattctacactaaaccaaattcttttaggataatttgaagacagacagtgccaaatgtgaaatcactatgtgtaaagaggaaaaaaaaatgtcaccaaatctcagtgtgtgatttcatgattcttccctgactctgctctgataaaagactttgcagtcagtaaggggcgactgagaaaaacttcaaaaagggttggtatgtgcagaattccctaagttcttctatgttgaaaacttttattttctcctatattggtatctgaataacagactggctagatataaaatctagccactttctttcattaggtggttttttttttttcccccatcattgccttggttttgaaaactctgatgccagtctaattcttttgtgttctgtagcttatttttattttagggggagactttgagatgtttatcatcatctttgaaattactagttttgccaccaaatgcattgagctgatcattcaggatactttctccagatgcagtgagccgtttcagtgggttgattcagatctttttctatttcaggaacattttcttttattataattttaattattagctcagttccagcatttttgttttttttttccagggaccccaataatataaatgtaaaataattgttttttgcctttcttccatttacaatacattatttctgcttctttttgattttcttatttatgtaattatcttggttatttttctatatttcttcaatgtctcttattaaatttcatttgaatctattctccctcgtgcactttgtaatttattctttattttttagataactttgtctatttcatttatttattgagtttcattacttacttttcatttattcctgggttttttggtacatctctaattttaggtttagatttctgagtcaaggcagattttcatatcttcaaatgcttttttaagaatattctttttgagtattttaaatctttttatgtgttggattatagttttcttgtactttgcaattgtttcttggaagatgggtttactcaactgaaatgtataaaatttcacttcctgtgccatgacacattcacaaaaattgattatatattaggtttcattgaaaacatgaatcatttttgtaaagtacaaatagtataatacaaataacactctccaattgcaatgcaataaattgagaaactgctaacaaaataaaaactagatggtcactttcatctagaaattttagtttattttttatttttattttttaagagacagggtcttgctctctcacccaggctaaagtgcagtggcacgctcatagctcactgcagccttgaattcctgggcttcagcagtcctcctaccttggcctctcaaagtgctggaagtaaaggcatgtgccactgcaaaaactcctgaatgagagaggacatgcaaattgaaattacagatttaaaaaaaaggaaaataaaacactacatataaaaatctatgagatgcatttaaagcaaagattagagagagattcatttcattgaacacttttaccaataaaaatgagagtggaaatcaatgggaaaatgcccagatcaaaatattagaaaaagaataacaaagtacaccaaaagaaagcaaaaagaaggaatttataaagacaaaatagaaaataatgaggtagagagcagaacaatagagcaaatctaatcaataaatcaaagttctgtgatttttaaattatgcaaataaactattagctaatttaatgaagaaaaagaagtagaaagaaaaactatacaaaataagatatgacaagagggaactatcctttagagaaaaataagttttcaaaaatcacaagtatttacttttcagatatccacatgaagttgaaaacctagataaaatcaataatttcctagagaaatacacattaccaagactgagcttacttgattttaaaagcttaaacagatcaatatccatgaaaggcatagagaaagttatgaatgaactacttcacaaaaaacaccaggccctgatgatttcacagttccaaaactactctgtgaatattacggttgagcaaactgtgaatatatgttatttgaataacatattaatatatgtgaatatacgataatgagcttaggtttctcactgttggaaaaaggagttacaaataagcaaagggggaagtccagattgaaacttgtgttggattgtaattggaggtatcagtatgaactcatgtttgataggtggtagataaatagatataaacatgtatacattcccattatttcctagcttggtttgctgagagagcctagaagtaatgacatcctcatagcaataagcacaccttgcacccagatcttaatttctaaataccatactctgataagtgaaatcagggcctcttggtgaagtaattgagtccggcactggggccagaaaactgtaaactaaacctataatatcttgtgatgctagaaataaggaagtgttgacaaacgatcaaggtgtcaaaaggacaaagaacacaggagccagcacaaaagagcatccaatggtcaaatcatggacaatttagataactaaataagcagtgatagtaacgggttatgatccatagaatgaaataaatatccatgagttcatactgctatgaattaatgagtgagtgaatgaatgaaataccaagtcaccattagtgaaagaccactctgtaattatcgcaggcaagttcaaacaatgaatatcaaaatctatggatgaatatttgaggagaaacagggtgttagcatagtctgaaaatatctcccccaaatttagaccagttaaaaagggaaaaagagtaactttaacaactaagattattgacatcttgaactctctgatgtgatgcactgagaaaagtatgataactacaatattacttctgtgatatttgcccaaaggcataactccacatataatcatgataaaacctaggatacacacaaattgaggaaacttttacaaaataaattaccaggattcataaaaagtctcatgatcatgaaagatgaagaaagatgaggaattaattgtcacagattgtaggaaaccaaggagacacaactaaatgcaatgtagaatccaagataggattctgtacagaaagaaggacattagaggaaaatcttttgaaatcgaaaagagtattgtagtttagttcattgtgttttattaatgttgatttcctttttttgataattcaattaaggtaatataagttgctaacactaaggaaaggtagtcagagaagacacctaaattctctgtattaaagtctaaaattctttcaaaataattaaaaaaaaaaagtcaagtcagccttgtggatagatttgtaaaattttctaaacccaacctgctttttagtagcctgcatattttctatggtgtttccaagccttgtagatgctatagcatgtgaatgctatatgccagatttttcagtttctataccatacaggaattaccaattttcaaacgatcacttagaactaaaactagattgtatgtaattgaatctttgacgattcagtaggcacttcaggactttgcaatacctctggatcatgattataaacgtcaaattatggttgtacagcataggagactcacacagaagtgccaattaacagagattcctggttgagacaatgacacataaatgagtgttttcctaattcaggcctgaattagtcaaagtgaaataaggaacttgctctctttttttaaagcatttactctaaactcacttgagcttgtttctgggcattacacagctctcttgctctaaggcaattataagaaattggcttcgtgtgccatgcaacatgtttagggtcatagacgacaagatgtaaagcaagaaaattgagaccttactataggctgagtacttcaagatgaggaaacagaatctcataaaggtaaagtaactggctcccatgctcactaagctagtaaaagctcttgcccaaatcttccagattccgaaactcaggttccttgaattatccaagactgtctttagaatagagatataaaattatttgagaatttggcctgtgatgttgttttgctgtgtccccacccaaatctcatcttgaatagtagatcccataatccccatgtgtcatgggagggacccggttggaggtaatttaatcataggggtgagttttccagtgctgttttcgtgatagtgaataagtcttacaagatctcatggttttataaagggcagttcccctgcacacacactcttgcctgccaccatgtaagatgtgcctttgctcctccttcccctttcaccatgattatgaggcctccccagccatgtggaactgtgagtccattaaacctctttttctttagaaattacccagtatcgagtatttcttcatagcagtatgaaaatggactaatacagtctatctacattagagggcaacatcaaaggggcacacaaccactctatataaatcctgcaggaataccatttctctcatcatttgaagatttgtatcaattagtttatgacaaggaaacttgattttatatttaattataaggaaaaaaatctcttttaaaaatggttctacaaatctatctggtttcttttttttagagaagctatatactggtaatgtgcctggcaggccattgctatctcatcagaccaagaagagggtttggactcccaatgttgcctatttgccatgtgcagcttttcaacagaataatacaatgagtattctgagaagttgatgataccttgccatattcagaactgctgctaaaagggaatatttaatataccatgcaaagaggcaattgtgttttggaaactagaagtcagtgtagagctataatctagttttgttgcacttaccgaggtccaggatagaatatgacccttgagagtagggtgttctgtaaaaagggacaaaaaagccatggtctggtattggattatatagttttgggagatgtattccaggacttacagcactggttttgacataccccattgtgtcaacaattttttttccaaatggctttatgaagctatcataaggtcctcaaagcaaaattaatttgaattagcatacacacagtcacgtaactatacagtacttccataaagaaatgggaaagatgtcatgaaatctaagaagcacagatgtggaattgcatcttcagaatccatggaaaactctggctacctggtgacttttgtgtagttgcttggctctggaggaagctaaggcttgtattctttattggtaggggagtcagtggaatactttattttaattaattaattaatttttagggacagggtctcactctgtcaccctagctggagtgcagtggcgtgattgtaggtcactgtaacctcagacttagccatcctcccactccagcctcccaagtagttagaactacaggcatgcactactcatgcccgcatgccagctagttaaaaaaaaaaaaattgatagagacggggtctcaccatgttacctgggctaggtgaaatattttaaacacttcctcagacatctccaaagtctacattttacattcttgtcctgaaatccaatcttagtttctaatggcgtatatgtgtaaagatgcttttaacaacacgaatgtttagtgtggcatagaaagtccttgagccaaatcctgccttcaatgtgcacttaagtttccattaaaggagagtggcaactgagcttatagagctgagggtaacatttgaattcttttataagaaatcagagtactaggaactaggatattgaatttcacttttacccatgctgacattgactttcctctggagcatcaccaactagtgagatctagttcagttgcatgattttttgtttttcttcagtgaccaaaatccagagatacaaatccagggcttagggggctcgcatatagatttgccatattgctgagggtctgtgagagcttaatcactttcatattttatttataaagcaaatgttccatgacattgaaacattaaatgtattatactcagtcatgtgcaatgtataattttctaaaatctctgattaatttaatatgggtgattttcattctttgatatgtggccttggtgtaatttataacaagctataaatatttgaaatgccatggaaatgtggtttgaggaatagtattaacacctgccttctgttctagttgggttatattaagttctgaatgtacatgggtatgtttctgggatattatttgagctgtggtctgtctgtgtgtgtagtgactggctgaattaaaaggggttctcactattttcttagcttttgatctgaaaccaagtctaattttgggagttttatagcagcattccttttctgtactttgtaattccttgtagaagcagaaatgccaaagtactttgcatgctaactcctctccttcttactccacacacccttcccaactcagtatgtgcgttataaccaggaaataaataacacaatccctgttaaagcctgtaccctgagacacacacattggatatggtcctggtgacattcttcctgtcatggtatggctcagccaacctgcccagggaactacaaggattgtcttgaaatctgatcccttcctgcttccttggcaaggcagttgaaaggggcagcctctgagcaaagtggcctaagctttgcccctcccacatccatcttgttcttaggaagggaaagagtgagtgcaaagcagagcctgtgaaagcttttggctttccctgagcacttcctggtctccactactgagtaatctgaacctcatgaacctcacttcccttatctgtcaatgatgggtgataatagtgcttatctcataggatcgttttaagaattaggaattgcccatgtgaagagagagaggggggtggaagagtgagagcactcatgcacacttggtacacagtatgggtgcattgttattatcgctgtagttctttcccctactattaataattctaactgtaaatgacttggtattgagtcacaggtggtgaaactacctgtttgttgctcacttggcagttaacggccaatccagtaacagaatgtgggattcctgactcctactttggggtttattctacccgatcatgatgctctttgccctcttagtattccatatttaatgatatctatgtttttgtgcatttcctttcaaaacgataaaaaccaaagtgaagcaaaacagaaaacaaatattcttgcaaataacatttagtgagggcagaggaaattgtacttcccttttctgtttctccccctttcattctgagtgagccatagtattacacgtaaaagttgtgtagctgcatcttttttcttctacaagatgagtgatttattatttatggaattggcttgggatttatttatgcaagtgaacttctgccattccaactgcatttccagtgggtaatgtgcctggagagttgtgggggttggtgatcaggccgctgctacaatctggcatttgggaaatggcatcaggttatctccacttagtgacattgggctcaactgatcttatcagcctttccaaagactgctgtgtaatagttgagggtgagaataaaatatgttttaaaatatattttatttctctatataggcatcacaatccctttaaaaggtattcagggagcttgttaaatgggaaataaagctaaggaggaaacaacactgaatgaattatattagttgacattgaaagcagtaacttattaaaataatgctttataattattttacttagcccaatgtttttcaaatattgctctgtcttcccagtattcctagcagagacatgaaaaacaggcccatttatcaactatatgatgtgacggttaaatggaaagttgggctagattttcacttgtgtgaatttgcaccctggaagttggacattcatgatcaagtggtctggcaggtaggggaagccctgggtgaatggttgttgatttaggcagtgagatatttggaaggtaagctttctttggagaagctggctttgctgtcttgtctccaatttgttgaaattaaacactacattcagatagtatggtctaatggttacagtaatgtttgtgaagatgagaaatgtatttgtatacacataagatatattagtttcccatggctgctgtaacaaatcatcacacacttagtggcttaacacaacacaaatttattttcccacagtcctggagttcagaaatctaaaatgggttagcagggttacattccttctggaggctctaggggaaaatccatgacagcaacccctacccagtacgttcccaaactcatcttcctttgcttccttaaaattgctctttcttcagacagactgggacaatcactgtgccctgagtgggctggttggactcctatctctgagccttacatagtctccattctccatcttgggaggctccagtttcaactcctccatgaagccttgcttgcccactccagccttcaagaatttctcctttccctgaacccacccgtagtgggcccagccactcatttggcagttgttagggagtgtctaaatcagttaattgtctttatatgtcaatgggtcttatttttccaaataattataatcttgagatctggggccattccttgcacatttgcatgctttccactcagcatttagtacctagtaagccttaaatacatatttcttgataacagcatgtgtgaatagggattaactttgcagggcttttgttctgggatttattttcctgtgctattaatcaggcacttcatgccatttaaatttattgacctttaatttcttaggaaaccccctcagtctaccatagagaattatgtactgactcattttcatgactgtgaaactatatgaaagttcatgtaagttttgtggtaagctatacaccatttatagttctgacaatagcgacttttcctaagcctccgtccatgtatcagactaggcctatttaaagagagttcttatctatggagatttttcctccctgcttaagatgtctgaaacctctattaacaaagccctctcttcttgtgcattatacttgtaaggcataatctttgtaatttcctccaaggatttcctcaatatgaaagagtaaactgttttaccaaagctattgaatatacattgcttttctaatagggtattttccacctgatactgctgttgctgctgccaaactaagaaatatatgcaaccacgttagcaaatgaacatgcttctaaaaacagacactgcatatgtgggaaaaacatttctagagacttacaaggttaaaaggagacatgatcaccagaccaatcctaggtttgtggcttatgtaagacctggttggtaagctggttattgtccttgtggcagcccagtaactggaagaaacaacatgctagctaaggccagacattttgtacaagagaattttctgattagtacgaaaagataaccaatgtgcaaatatttgtgatccaattggtgaaatttcccaagtgcttttgagaccttggagaatgtggccttcatgaagtcattctttggttctctctttccccctttttgaaacttggctcttgaaaaggagggggagggaaaaaggaggtggtcaatcttttagagaagttagaaaataatcactgtagttgtgtcaaagctgccctttgagactataataatgatcacatcatagattttaaggcagtctttcactcacagtttctaaattggagaggctttttccaggagactcaatagtgaccataaggattgttgttaggcttcattatggcctgcttccattttacatcccctaatatattaggccatagaaatcagaagtgtgaattcagcctttcatttatcattgtacctccccacttatcgttaaatccttaattttgaaggctcaagtggcctattgtgctggcaattagccaattgcaggtgcaaaatcttgatggcatccacagggaggccttggtgggaattgtctgaagaaatggatccgtctttatgcacttggatgcagaatttgtgaggggatgagtgtaaagaatattaaatgcataacagatgacatcccaggaaagaattgcaagtgaaaatgaatgtgaaattgcttgtctacggattgatcttctttgattaggcaaaaaaaagacccttcactctaagccctttacaatagaaatacccaggatacagtgggaatggagacatttagatgtatactccattgccatctgcctaaagagttcaataatggggtggccttcaatgcctttctgtctccattcaataccaaggcaaaatgttcgggcttggaatgtgagccccagcacaatttaacccccagctttatctcccatcacatgccctcatgagccctgtgctatagtctcctgttgtcatctgagccatatctctctctctctctttgaaattcctttccctgctttatatactctaactgatctgtaaagatgcacatcaggtcctcatcacttctgagaaacatttccaggtcattctagccgaagataaaatctttatccaccacattcctgctgcactctgtatctctgtttttgtacttagccgtgaattagagtgatttatgtctcattgatgtgtgtactcctgtaaaacctagcttggtgctttggcaccggttcattaaattaataacaactgtatatccagtttaggaaaaacttgacataagaaaatccgagcacattcttctaaataagatatgtaagaattggcaactcattaacaacttaatggagaggctagggggaccatcagagatggagagctcaattgttaggataaactatcagttgatgcaattagaaatggagacaaaccatttttaaaactataatcaaagagaaagtgggaagtgactgatgatagcttaatttacacacaattttgtgtatctacaagctttgctttatttttattttttagctacacctttctgaaatttcttgcattgttgtaggtggaaagctgaattggccctttgaatgagagcaatgtctgctaatgccatttatgaatctaatgctagaggccagattgaagaaatgagacacagtattctattttcaaccacctggaggtgtgatccctgcttggcaaggtgaacatagatgagatgcacttttacctcatcctagccagcaggatttggaaagaccaaccatcagagtcagcagattcaaaactactatagcaggccgcctcctccatgtcttttcctccctccttccctccctctttccctccctcccttctctttcttttccttccttcctttctttctttctctctctctctttctttcttccttccttcctttccttttcttccttctttccttctttcttttctttctttctttctttctttctttctttctttctttccttcttttctttctttctttctttctttctttctttctttctttctttctttctttcttcctttctctctctctctctctcgctctcttcctcatctttcttttctgcctttcttcctccctttccttctttctttttcacccttatgtttctttacaggcaaagataaaggacaaatcagttttccttaatgaataaatgactctatgcaagagaaagggggaatgatcatttaataactttacattatttccccacacctcccttatttctttagtcccaaagtgaacgtaaatttctgttggctggtataattttttgcctggctccaaaatgttgtcatcaattcttgaaggtttgcagcaagtttatatgtcttttgtcatccagcacaattcatgcctgctttttcctcctgtgacttccatactagggaggattaaagcccattttagcctaagcaaaacaaagtgaagagggtaaaatatgcagcatgcagaatcaagaaatgcaacaatgcactgagaagccaagggcttactctcctcagctaatgcaccatttcaagtctctgtcactggccttcttgcacatagaaggtatgtgataactttgaaagagatcgaatggaattttacattgacagtgtcgttttggtggtttaaagtttagatggagttgtcaaaccattatcgtggctctgcatcataatctctaaaagaaaattactgtatgtgaaattaaaatgaatagtttctgattttcccatctcttttctattcgtgcctttagggggcctttaaggactagaaggcagaatattatgaaaggagatagatatatttattctactcatgagaaggcccaatgctcttggctttgccgcctgtgaatcatcatgtctttcctcccttgaaggataaatatggcattcattccaacccatttagcccattattcttttgtatataaaataggtccaattaagacattcttgtgttaatttctgcattctatgtatgggtagaaagaatttaaaaatatccatcacagcaaatgtctcaaaatgtttcatgcatactgagcataccactcttgcccccctccccaacccaaaggcaataattcacccaatcatggagatttgtgattttgtgttttccacttacctacattaaggctctgtgtatgcacaattcaatatttagatgaagccatatatttgtaaatatctggtgtttttactaaaagttttcatttttatccagatgtctgacatcatagaaaatcagtctaagaatctactctttatatgttaactcattcatggttattcaagcatacaaacagaaagagacatgcttaccttgttcttgtctgcatcccctgcccctcctcaatgagcgagggggtgggatcatcatgttctgaagtgtctaactgaaatttcattatgtgtcttccactggtcatggaaattcattagacaagccactctgggctttaatcttccatttactagccgtatgatcttgggaaagtcattgaacttctctttgcagctggcttctttaactcataaaaatgaaaagaacccagggaagagttgggatcttataattgccaaggcaccattgcaacccaaagttctgtgaatttctttacttctaccttgtatgaaaattaacagttgatgaatattattgtgccagtgtcccttgtgttataatttagcgtactttgaggtgatgttgacatcttgtgtgtaagttggtatacaataaccaaaaacattgttttcaaaatttaaaataaaaggacaacattttcttttttttttaaattttattattattatactttaagttttagggtacatgtgcacaacgtgaaggtttgttacatatgtgtacatgtgccatgttggtgtgctgcacccattaactcgtcatttacattacatatatctcctaatgctatccctccccccttcccccaccccacaacagtccccggtgtgtgatgttccccttcctgtgcccatgtgttctcattgttcaattcccacctatgagtgagaacatgcggtgtttggttttttgtccttgcgacagtttgctgagaatgatggtttccagcttcatccatgtccctacaaaggacatgaactcatcattttttatggctgcatagtattccatggtgtatatgtgccacattttcttaatccagtctatcgttgttggacatttaggttagttccaagtctttgctattgtgaataatgccacaataaacatacgtgtgcatgtgtctttatagcagcatgatttatagtcctttgggtatatacccagtaatgggatggctgggtcaaatggtatttctagttctagatccttgaggaatcgccacactgacctccacaatggttgaactagttgacagtcccaccaacagtgtaaaagtgttcctatttctccacatcctctccagcacctgttgtttcctgactttttaatgatcgccattctaaccggtgtgagatggtatctcattgtggttttgatttgcatttctctgatggccagtgatgatgagcattttttcatgtgttttttggctgcataaatgtcttgttttgaaagtgtctgttcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaatttagttgaattagatcccatttgtcaattttggcttttgttgccattgcttttggtgttttagacatgaagtccttgcccatgcaaagaccccttgaatgttgagtgttgcgtgttgatgcaattcacactcgccttatgtttactccttgtaaaatctttcttgtgtatacctgttcgatagaatcagcgtgtaagaagctcatacaaaatatgtatcctcaagatcgtgtaatatttggttactaaaaagattcactgccagaagagatacaacaaagttcctctgaattatgaagtaaaactttgatttaaaaaatgttgctttccattgaaaggtatctttccacaagggagaacatgatgatagatctttacacaggagtgacatccagggagagcatttagggtatatatacaatgaaccttacttattttctctttctctctctctgagtgtatctgtacatttatatttatgtgtgtatatatttatgtatgaatatctatagtttatattattagaagatgaaagttatttataacctgaattatgttatttctgtgactaactctttaaaagttctaaatatctgtttgagtcattaaaaaaaatcttattttcttacctaagggacagttgaggtttatagcctgtgttagtctgttatcatgttgctataaagaactgcccaagattgggtaattcataaaggaaagaggtttaattgtctcacagttcacagggctgaggaggcctcaggaaacatacagtcatggtggaaagggaaacaaacacatccttcttcacatggtggcaggaaggagaagtgccgaccaaagggggaaaagcttcttataaaaccatcagattttgtgagaactcactcactatcacaagaacagcatgggagtaactgcccccatgattcaattatctccacctggtcctgaccttgacacatggggattattataattgaaggtgagatttgggtgggacacagagccaagccatatcatagccttgagattgaatggatctaatttaaaaaaaataccatttcattcctttacaaatattttgctttatgatgacatcagcagaaattgatacaaggtggatttttataagagggcttcatgttagctgggacagtttatttaggcatggttatcattttcttatgaaggaaacagattgaccaaagggattctgctattcgtagaagtgagcaagtactgaacagggataaatttctagtcaaaatggatgcctactgaacaagacttttggtactgaaagagtattatgttgcaccttttgtcttgctcatgaccctagaccccactgcctgataaccaccagaaggaaagaactccctatgccactgagtgaagttatgatgcaacctgtccagaggccaaagaatattaaatgagaacacccaaggacaccagaaaaaatgagataaacattcttttcttcctgtttcttcctcagcttcttatattctattttccttcactatgacctattattcatcttcaaaatccctcaaactggcagttttgaaggattccacatgtagccttgcatacaatccctcatggctttcataaagaccgtgtcatttgtcctgcatgagtccctcctgacctctcttatcctggggctacagactttctccaagatagctcaggtgctaatgtcagcaaaacaaagctgataatgatcggtactgtgtgtgggagtgcagtctgactattgaaacagcactagaacaaggactttggaccaaatacatagctgagcccagaggttgcattataaaaatgaaatccctcaacttccttcctgcacacacttcacctcattttgctggatggctccaatgtaattgatgaacatattctttaccagagctgttaacaaatagattgagaaaaagtgggtttcatcttttattcctgttattaatcttccaaaagttggtaagatgtccagaagatgagagatagttggaagatggaatgctgcattaatttaagacctctgtgttgatagaatattccagatatgccttctgtaaacaactgtatgggaaagatttatcatagtccatgtatctgaactcccagttgcataagctacatacagaagtcaaacggatgatatgtacccaaatatataacaacagtttttctccatcttgcctccctagaggactttcccaaaccacagtcttgatgactgctatttcacactttggctatgtgattttatgagttctgtgtgatctaccagcatatttttgtttgctttagcaattttaccaagaaatacataattgagattattgtcctgacaaagcattttcatcagtgtgattagaaatacataattttgaagagtgacagtaattgccaccccaatgtgtatgcacttttgaggttagctcagagggactaagtccttagaatgtcgataacatgagcgtgcagatgtagtcagcattgtcaaactccggagttcagtctcaacagaactgtcaccaggactagagtcacaggtgtcagtttttcttagggaagagtgtcttgggccattggttgcataaagtaaggcttgtctctcattgttactcagtagtctagtaagtgatgttcttaggaagtccatactttgtggtttgtggctagcaaatgtgaagggaatgagttaggtggcaggggagctgtgtttgtaataaagattgttttcatttttccaataactcttcaccttcgtaccattgttattcatactatgtgccttagaactcccaaaatgtaaggtaaggacctttaaaaatatatcttaattcattcattttagagaaactgaaatgtacaaattagtgcattttatctctgctggttaatttctgaatccttcattatgccctgggttcaattaaaaaatatatatatatatattgttcttctagtgatttttgggttgtaatatagactgatcttactctggaaaagacattctcatcagaagacctggattccaggctctctaatactaattttgagcatgctttgtgattttgagcaagtctttttacgtatccctaccttatcttagctactcctccctactgggacttttatttttcctctaggagatttctggaacttgttgcctccaaaggaaaagcagtgcctctttaactctgatttttagcaattgtagtaaccacccatttcatgaaaaccttttatcagagctgccaactcataccataaaggatggattcacatttttcaactcttctattttctggtctgccctttgttggtgatttcaatgagtatcaaaatagaatccttgcacaagtaacataactctcagatagcaaaatgatgatagaaagcactctcaaaggagagctgtgcaaggcagtgaatgctttatgagccaaacaagcacctgagtttggaagagacgattccagggagctgtcctggtctagctgccatagcagaagtgatggcaggagctaaggacataccaatttttatgctttcctgaatcatgggatctgtgattagagcaagagcccttttattggacgagcttgggacaagttattggttggctaatcaaaaagtcatttcaagcaaggaattatttagaaattttaacatataaagcattttgttttaatgtgtataatatatatattcattttctaatttttggtggtcttttttggagtattggatgacttattgaagttccatgttgacttttttttgtataaaccacaccctttatccatttccagtttaagtttctttgaagtggaacagggcttacaggcacttgggaaatgatctcagcagttttttagtgatacattttaatcaagtttctctagatattcagctgagtttttatagaaacagtaagtctgtttttcactcatatttagtcagtttatcttatatttgtttcaattatgtaatcataataacaactacaattggcataaactctcctgtggtgagaacgcaactcaactaacaagaacattgtgtttcaggcactctattgaagagcccattagctgtggatatttagctttttttgagtaaaatgtgttaggatcatccattcatttatttattatatttagtgagctacctactatgtgccaggtactctgctaggtgctgggaacatattggtgatgcaataaaatgccactgaccaggagcttacattctagtgggtgagtcagaaagtaaacaagtaaatatagctatagaggtttgtcctatttactttagtctattatgcatgatttgcaattactaaattatgatgttaacatgtcaagagcattaggactatactgctaatttaaccttgttactttaacattgtcaattgtttacttgaaatccagcacctgagtgattgaaaagtttcatattctcaagcctgaaagagtcaaagtgaagtggggcatttttgtcatgtgatacctcctgatgcttataaagtagatgcaaacagcagttgaggcagccctttgcgaaagctctgacaatgatttctattattcagtgcacatgggttgagctgtagtagtcagggtccttcagaaaaagagaaccagtaggagacagtgtagtgtaggtaaatagagggagagagaattttactttaagggattgacacacaaaattgtgggagttggcacatctgaagtctgtagggaagccaagaggctggaaattcaggtaagagttgatgttgcagtccggaggcagaacttctttcctgggaaaccttagcccttgcttgtgacaccttcaactgattggatgagatccacccacattatggaaggttgacttgacttaaagtcaacttgttgtgaacattaatcacatctacaaaatcccttcccagcaacacctaaactggttttgaccagctgactggggaccatagcctggccaacttgatatctgcagtttaccatcacaagcacctactctataggtgcagcgctcagtgctgggagctgacaggctcagtttctatgctcaagagctctaagtcaagactgtctgccttgagtatcagaaccctacaatgtagtagggagtcaattgctattgtctcttgcgatgtagtcccaggccaacctgtgccagatttctggcataggctgtttgcctattcctgccactctccttcccatgccacgttctcattcacttactccttgaactcagcatattatttggtagccatggttgtatagtattttaactgagttgtcactaaccttttactccaactacactgtaagctcttcagggacattatgtgtttgcatcctggcaaggaggctgatgaagatgaagcaggggcttggtagaaacaattcaggtgcagtgtgttgccattgattctagtaggaattgcccagagattaagaaataaaaataaaaagtcatcagattagttctaaaggttataaagatggtatcatataatataaagaaatccacatgctgtatttttctgggcaaaccattgctctttgctgacccttagttttctcatatgtaaatgaaagggacagatgaagtgttctctttgctctaaaagccagtgattttaattgacttccatgcagaagaccatgagtgttatttagtattgaaagaatggcaaacatttgttttttctaaacctttgaaaggcttagagctggaaagaaattgttctttttaagatctgtgtgaattggtgtgccttaaaaaagtgaaatgatgtgtttgtatctcccattccactgtgcctagcttagtgcctggcaccaaggaggtgcatattaatgtttgcagaaactgactgagagaagaacttaaatattggagggtttattttagtcctaatattttatgtgaatgtattatcacttccattatatagttcatatatatgtcccactcaaacatttgaatatatatatatatatatatttaacttggtctagaatttaaaccacttcaaatcatatgaggaacaagaagagttatgttaataaatatataggtaataaaaataaaaataaacagataatctgtttgcatggaagactcgtgtaggtattatgtattaacataaaataaccacagagtttcaaactgcatcaagctagaaaagcaactccagattcatagtcccaagtgtgagcctctcctatcccagttcttttgaaaatttctgcctctttcaacgtgaggtttcataatttggccaacacatgtgcctttaaagcctacagggttggtagaaggtctgtgataagctggcagttttgttattcagatagtgattttgtcactgcaatttgacaaaaactacacatctaatttaatttttaagatgtttctaaaccagtagctctagacatagcaagctaatgtcaaataacataggcttattttgtaagggccaagtcttgaaatttctgacttagtgggcaattttgaagtgtcgaataatgcatcttctcacagttaagctgctttgaatcagcagaggttttgcagtccgcagtcccttccccatcaccacgtctaacctcgtcaccagccactttttattctgaactcctctcctttagcacctaattttgtcattctgtatacacaaaactataatgatctgggttaaaatgtgtttgattccaacataacttaaaaaaagctttctcaggatgtatcagcattgaagttgctcccatcttttaaagcaatgcagccatattaccggcattattttactttgtatacctgcttcaatatatatcttatattgcctgtgcagatatttaacttgctgatcatagcaaaatgagtttcaattgatttatgtatattttttctttatgtatagatatacttcttattgaacaatgataatcagaaggaaaataagactagattgttgaaaatcaatgtaattagtgttgatttctctttacatttctttttgtttacatatcattagtatttataaagctaaaataatattcacagttactttcaatataagagaaatcactactgcccaaaactagactatagggcacccaaaatccagatgggaagtaaaatttctgtcacatgtccaattttcccccaaatggtaacagtcctttttatacttgcacatcatctgcatcctaaacatgtattcagaaacattgatgcgtctaagaatggagttataacaattgtccgaggatgtctggaatttagtttgtacttagcccatagcaaaatgcaagtgaacataagaaaaccacttccaacattttgagtctctagttatgagctccattttctccattgttctttttttttgcatgctaattagatgagtttgtctcttgtgaatctatctctgcaggcttctgtaccatttccttgtgtctatgagggacctgtcactcttcactgacttcatcttaataatttgctttccctgggggccttgcttgtccacagggattagctactccaaagaagggatacctaacttgaggctctaagctcagcagccaggccctgtcaatagctgtgaataactgacttctgggcattcagctgcacatgagcttccagaggtgcaagattgatgtgtcccctgctggcttagcatgctggcctgtcctgagactaacgtgacttgtagaactgttaccttgtcactgacagatttgcttagtggtgctgacttttggccccttactcctcccgccaaagcaaaggtcagtgcagcaaaagacatcttcaaaggacaggagagtggtcactctttccagtcagaaagagcatgtagctcagtcagcctcattatcagtcgcatctggcctcccaccaattagaggacacttcatttagtgatctagtgctgcctgtcccttcctcctctggactggatggacatcagaaacttcagatgccagttacctttctttcatttctctagtcttattaatgtgttactttaaaaaagtcacactttctttcctccatcagaaaaatgtctttgttcctaaagatagaggatccttcagccattctaacttagaagggaaaggtaaaatgcattagttcaatttaagcaccaaagactgttatcaccaatgacctgtttaagcagggtgtatcatggggattaatgacagactcaagggagctgatgacccacagccaaaccaaaaggccattaactcccatcagttatttaattcctggggaaaacccgtttggaggtaattattgctgttataaactggacaaaaaacagaggtgcacgagttatattaatgaaccctgatcattttattttataatgttaatccaataaaaaagtaaatggttttaaaaatttgagtttcactttttaatttctaaggaaatgctcctttggaaaaattggtggtgccaagagaggcccagcagtttggtggactctccccctattctgtcttcaattcttaatctcagacatgctgaactaaagagacatggatgtcgggtggtattgtcttagagcagcatctctctaccatttactctttgtggttatttgtgttaatatttagccagacaggccttctgcttgccagcttgcacccaagtcattttactctcctggtgcgagttcaggtctcttcttcactccctcctctactcccacctttgtcaaccatatttggcaagaatgtactatgtccaaggtgctgtgttctattgggtgtaggtgacatggatgcatatttgatattaaagacaaagaggttagatgataggatttctgagatgaaagggggtgcattagtttcctaggatggctgtaacaaactgccacaaacttggtgtctttaacaatggttatatttttttcttacagttctggaggccaaaagtctaaaatcaaggtgtccagggccacactagctctgaaagttttaggaaagaattcttccttgcttcttccagcttctcatggtcccaggcattccttggcttttggctgcattactccaatctttgtctccatcttcacatggccttctctgtgtctccaatctccctctcctttctctcgtaagggcacaagtcaatggatttaggacccaccctaaattcagaatgatttcatcttgagattcttaatttaatgcggtgctaaataccccattttcaaataagttcacattcacgggttctgggtgaacatatattttggagatcactattcaaaatactataagactgggcatagtggttcatgcctgtaatctcagtgctttgggagactaaggcaggagattgcttgaggccaggagtttgagaccagcctgagcaatctagcactccatctccacaaaaataaaaaataaaaaaatagctagacatggtgtcatgcacctgtagtcctagctactccagagactgatgttggggaattacttgagcccaggaatttgaggctccagtgagctataccatgatcccgccattgcactccaacctgggtgacagagcaagattccatttctgaaaacaaaaacaaaaagccaaatgctacaggaagcaaattccaggcaggatcattagagaagacttaatagaagaagtaacctttacatgtagacatgtagaagaaacgtttttcgaggtggagagaatatcatgaggtcagagacacaagacaaaggagggattgtggcaaggatggagttgcagaaggattgaatgggggtcagcttgcccaggcacagaatgtagaggacagaggagtgaggggcaaatttaggagatgggcatgggccatattgtaaccattggcctgggaaagactgaacactgtaaaataagacaggagactttagaaatgcttataagagaaaggtaatgaaaacagggcagtagcaatatcaattgataggaaggactggattctgaaggtaaaatgaatggtctggaagcttgtagatttcatagatggatgaattagtgtgaacaaagagcagtaaagggaaggaggcaaagatgatgcccatatgtcatgtctgtgtgactgggggtttggtgaaattgattaaagaaatgagcaacacaggacaaggagcaagtttgagaaaaaaattgtatcatatgaactttgagacattggagggccaggcagaaatgatcctctactaggtgagatttcagggcttgagttcaagggggtatcacaggtgtcttttatgtagatttgggtgtcttttgtgtagagcacccttcaaagctctgagattggccaagctggccaagggaaagcttatggtgttcgagaaagagcaagcacaaggagagccttggggacttcctcaatggaaggaggagaagccaaaggtgggaaaggagattgtaaagaagaagccagggcagcagaattcagagctggtgaggcccattttcctgaagccaggcaggaaggtgtcaggaaagtggaactgctttgaagtgagagactggtgatggggggacaacactgtgaatgtacctaatgccactgaattggacacttaaaaatggttaaaatggcaaattttctactatatattttctattatatattaatatactttaatttgaataaaatattaatgtaatataccaaaaaagtggaaatgatcaacaatgtcaaatactgtggatgagtctatggagataactgggaagagaaagcaaactacttttaaaatatttgccagagagaaccaaccatgattagaaaggttatttagttatccccaatcatcctgatttagttggcactttgaaaaacatgttagcatattgggttacttcttgtgttgaacacttggcattataaaaaattattggtctgggacaggtaggtaaccaaaaaaaaaaaaaaagagagatttattgggctatgaatgcatggcctccttagagccaaagtggtcatacacattgaagcagagaaagctagctatgatatttgtttctagaagtaaaatcccaattctgatagttaatgatatgctaattgctgtaaagacatagtggcagtttcttcaagactttgacaccttctccagattgatataacagctgcactgtattggaaagctacattctgctttggcagatgaatggtggcagtctctagcaggcatctctcatggtttgctaagatatcagtttgactctaacattttttttatgtgttggttggcattgcccataggagtgagcatttgctctataagtaaatgtgacttttatcatagtactattagatatactgaaataaaatatgtatttcccaaagtgtatctcattttaaagtaattatccaaggaaaatagaaacctcataaagaatattaattggcctcaggtgaattacaactatatgacaagagtttgtgtgtgtgtgtgtgtgtgtgtgtgtgttctgaatgatcagcgaggttgaaggaatagggagaagatgataatctctctatgtctcagttttcttatctgtaaaatgaggggacaggactgattagcctctgaaagcgtactttcaactgtaaatattatgtgcttctaatattgagaatggaacagcaacagacatgcctaaaactttgagataaagctttatatgctttcaagtggcaaattgttagtttactttaatgaatccaaactttatgaagtcaaatatttgattaattgcatcattaatctgtttctattagctgattgaaacaaattgtttattaatttccagttggtaatatgtaaatttataatttaattaaaatctcattatgtattttttaagacaaaaggcacattggtacagagtttgatgagtgagacacagacaatgctatagaatcagttcagctgcaagaaagacaatttgttaccaggctctgtgcagagggagagctgggcctggggccaagctactgggcccacttagaatcacaaggaagctttttatagaatgtgagttcccttgaacactgacatgcttcctcggtgagtctgaaaattagaactttagaagtgagaaggcttctcaggattatcaggctctagtccggctccctgtcaggtatttgaacccacaactcttgagcctgttcagtgggccaagtaaagcttgcttccctgtggatggaaccaaactcaccatcatacaccttcttctctgtgaacccccaggaagtctgctttatcttccccaagctgtgcttcagagattgaaagacagagcccctatgtgccgagtcttgtctttttaaaggcaaaatatacccaggtttttttaacaactgtccacagaacagcgttgtgagcccactctgctttccttgaagctgatacattccattttacctagttccctagagagtaccagaccccacagaaatgccccctgtgtggggtcttaccagagcttctctggtcagggttaccaattaaatgtattttccgtagagacctgtgtgcacgttagtgaagcatcttgatgagggaggaggtttctcacacaaagggcctgaaggtagccatttcccagggggcattaaagtccctcactgggcttaaaaatgtgcaggggcccacatcttggtgatttggttttgattttctggataaatttggggagcagttttgagtgagataccacagataaacatttgcctttgcctttgtagtgtaattattgaccatttggggtaatatttttattccttgttttcctcaaagacttccctgatagttgcaggtgggaaacactgaaggtcacctgggtgcaggttccaatgatgtttccaaggtgggagacagcttgcctccgcccattgccctcactcccgcctaacagtagaacgtttaggacgtttcttttgggcacttccctccattggaggaacggatcttgcagacgaatgtcctctcttgccgctcctgtgtccattcctgtccccagccagcctgccctcctttctatgttttataacttttctgggcagaaagacaaggaaacctgctggtggagtccagagaatacattcatccctgctaacctttacaggttcccctctcatgactgttcatcaaatctctggttcagcctgacctgttcttcatagctgccattccacggttttcctctttctgtgagctgaggttcttacttaccccaacctgggcagatgaattcatcttctgtttctctaaggaaatcaaggtcatttggccatttggcatgagtttcataatctttcttcctctccacctgtcatagtgattctcactgcttccaagtatttgtcaatcttcagccccttcttactttcccccacagagtaagaaataacctgatgccatcccaaattggtctctcattcttcattctgccagtgcatttgagcacccatgaacaatgggatgatattttcctctttaggttagttgcagggttccagaagattatacttgtctaaagactcaataccagagaagatatagcccaaatgtaatgtaccctttatcagtctaagaaagtagtgaaattatattgataaacgatttacaattacatctatagaaaaggaaaaaagctctcaattttgcatacgattgctttaagaaagtttttagagagaggaaatatatatgactgtcatatatatataaatatatacgactgtcaagcacatacgtagaagtacaagggcaatgcgcaacctgactgattgaactgggaaagatatagcaagaaattttcaaattcagacagtttggtacctacacagactgtgaagagaagaataagccaaagaggccagctccctattattctttccccacacaacaagaaggacaacagagaaataaaaggggccagatggctgtaaagtgagttgtaggatacctcattgctgaagacttcattctagtctgcagctaagtgacatttttactcagagctccattgaaaggcagggggaggagggcatgggccagaacccgggagttgttgagaaactggctcataacagccttccagaggagttagggaggtaagtgggagatagcctcagaacagctcttttaataacggcctaacatactcttgtgttttgggagatcacaaggcattccacaaaggctcagatcagctatggttcaaacttctgtttgtgtggatatgtgcaaggttgccagggtaccatgccagagccatgccccaagaacagtaagagaccatgtaaggcacagatgaataacatgtgtcttagtgtctatttaaaagcctacctttgtgagaagagggattctattgaaatgcagccatcattttggatttcactggtctatgaacctggtagtgagagactaaaaacaaatttgtattgaacttgaatgttaacttaataatcaaataaataccttcatgtttaatgcttaaacagaatttcattaaaatttctttgacgttaagccaaattttgaagtgaattggaactggtttgcatttcttaaattggtctttctttggaaataatgaaaaagtgttagagtcttggccgaattccagtgactgtgactcaacttgttaaagttaaattttaatatttacacattacatagtataatatttatactaggcaacagattgggtgtgtagaattcaaaataggatacactttgacttggaattgcagtgtggtagtcattacacccggagaattgggggttatcaaatactgagactgaggcagcccaagcaaaggagtttgaaatataaacactgctaagtgtgcagttccagcttgtacttatgtgttggttttcatgacaatgtgtgctttgtactctcgccgatcattgattttactgttgttgagatacttaggggaaagctggcttgtacatgacaccttctactaggttggatgataatgtagtcagtgagactgccagtgacctcctctcagcctgccaggagccaggctggctcactactggaaagtaggagaagttatgtaaagatgaatgtaatcatagaatcccagaatgtaagaattgcttagcacactggaaactttccagtacaaactccctgttttacatgtgaggaagctgaggcccaatagggttaaatgatctgctcaaggtcactgagctagttagtgacagaaagatggaaacccaggtctccacttctaatccagatagattaactacccctgaatagaaactcacatgtggttacctgagattgatctattcgaagatatagaaataaataatggagaaactcctggatcaaacatccctagattttttggcaatgatgttgtaaagggcattcaagagtcatttatagtatagaatgcaactggatgatactgcagttcctttcaaaagtcagagttccaggagtaatgtgaaaaaatagcagcaaatacaagatggtgtagtattaaactctgaggtctagtgcctagagggcaagggactcaacacagtgccctttctcacccagtcacgatcatacacaaagagattaccgggccaacttgttaggtcatgggcaccctgaaactaatcttactgcttgtctgaaagaggattcgacacattggatgaaacgtgggacagtttaactgcatgactacatgcagcctcttctactctgtggtactgtaatgtaaatctgcctgcctcatccctcaattgtggatgtgcatatgcatgtgcacacacacacacgcatacacaagcctcatcagcattcaccgtacccttatattcagtcatataattggcttaatagcgtcttgttgtccctagaagataaaattgagacaaccacttacaaagaaagcattctgtcagtcacttggccatttagtctccacatccttctttatttaataactctttctaccttgtgccaaaccttgggctttctttggagggcttccaagttacctttttcctaaactaatcccacacagtctggaatatgacagccttttcacatagactggattgcttgcagacactatgtcctgttaagtttgtactgattcatgagcattttaagtgaaacttccaaaactcattttatctgttcagcctcctgtttacaaaccacatgatataagaatgctcttttcccttcctctttcacctttcctttctcccatgaaaaagtgaactaagatcaagggtcagaataacccaaagggtggtagagagaaaagagcactaaatgaagagtcaggagacttgggctctggtccaagtcatgccactgaccgggtggatgacattggacagtcaacttccttttcgtgtacctgatcttccctaaaatggaaaatgatgcctttgatctcaataccctctaataaccctttgattgaaggttgttttcacgctcaattttctcctgttttcatgttcccgatttgaactacaataaagtgtttcgcaggtgtgtggtgtcttttagggtaattttccttctattggaagatgtatcatcatctctatggttgcaatatcactgaaactccttattatcaataaaatggatgggttaatatgttagattttataaatgagtaaccacagatttcatatgactgtaatatgtaaacatgacaaatctgtctttgattgttgtgcccaagtaaaacgtaagagggcaactggggccccacttatctagggaaatcgagcatctagttatttgaggtaattaaagcgtcttgtgtcagactcttaagctacttgcatatgaatagaaaacatttccatggtcacttttggatggttacttttgctgagttttacagaataataataccttacatctctatgtaagtgggacctgttccctcttctctccctctctcaaacatctagtgtctcttctcatagaaataacaagcatagagataaatgatgtgtataaagcaatttgtcttcaacaggcattttcacataccttatcttatttgagggtcacagcaatccccggagatacttaactgttgagaagagtcagccttgcagagctgaagtggctcaactcagctctcatgggcattaaatggcagagcaggtgtggatgacacaggccttcaggctcttcccttcctcacccagtggacactcttcatgtgtgaggtggttctgagaagagacatttgaaagttttcataaaccattctcatgcattaatttgcctcaggaagaattttgaagccctactgtatgtcatgtaatggtttgaggcactaggatgaccacagtgaacaaaccattatacctgtgttaggcaaaataatgccccgcctcccccaaaatgtccatgtccatatatatataatgtgaatacactacaacacaaaagggactttgcagatgtgattaagttaagaatctctggctggggagattatcctggattatcgtggtgggcctaaagtaatcataagggctctaataaaaggaaggcagaagggtcagagtgagagaaggagatgtgatgaaacaagtaggggtgagagaaagagagatctgaagatgctgtgctgctggccttgaagatagaggaacggtcgccagccaggcagtgaaggtggtctctacaagctggaagaggcaaggatatggattctcccctggagccttcagaaggaacgcagctctgccaataccttgattttagctcagtgagacctatttcagacttcctacttccagaactgaaagagaataatttttttgttgtttgaagccattgcgtttgtagtaatttgttactatgaaactgatgtaatacctgtccctagtaactcattatgtatttgggagaatggcaaataaacagccccatcagagaggaataagtgacgttgaagagaagctgcacagtgttggggactggaaactctgaatgcagcctggatgaaaggtgcaaggcttcctcaaggaggcaacaaggaagatgaatcacagatgtttgggcatttcagaaattagtgactggggcacagttttttatgtgtcactgtgcccagggtagggccactccagagggaaatgaataatagcctgaggattctatttacattgaggagcggggggcagagaagtaggggggcccaccactcataggattctgtatcctggcccagcattagtagagttatcctatctgattccatggaataagcaagcccacagcctgggcatcaattatagatctgtgtaaaagctacatatatgcaatatatgtatgagtgtgtggatatatatatatatatttttttcatttagtactcccagcatatatatcagcataatattcgatatccattaacttagggacacactgtggaatttgaaacagctgaagcttgaagtagatcatatcctttctttccagtctgtgttggatcatacattacgatgaatagaggcaattataggcagattcaatgacagtgctgccatttattggagtataattcctctagccaatcagtgctctaagtaacaataaattatgttaaacttccaatattacttgagcgtgtcgagggctatggatcaatgagtgtctgatacttgaaaagcttcagcattcagttcttgttgaatctgtaattaacaaatgaaactaaactaatcatagtaaattgttcatttggctacatttttgttgttgagcacactgagtgctgaggaacaagactgtgaagtgttgcagagcatgggcctgcacccttctatttcaaggtgcccaacagcaaatgaatgcatctatcaaagcatacgaatggtgagttgctgtgatagaatgattcatccttgcaggatgctgatttatctggcttgaacagtatgtgttaataagagattgttttatattaaaaggcagagtttaattttgatagattggctagcaattttccaagaaaatatcagtaaactgagggagttctaaaagttgtgtgtgaaatgtgtgtgaaacaggtagaaaaaactcctggtggcttatgtgaatcaaaattttttccacctattgtaagtaccttgggaaaaaaaaaaccagacataaaagacttcaaaactgcacagtttagatttaaagacacagttattggtagattgtcccactcaattatttagtctttttagcttttgtgcctgaaaaatgacttcatcttgtaaaaggcaatttacattaatcccggaatagtgcttaggatctttaaatatttcagagaagggcacgcactggttcccacataccagcacactgtttgtgatgttcattaaaaatattagggaccacaatgttcagaaactacttagcatagttttgttgtactagttaactatgcaccagtgatgctcaattgggtcttagcattaatacactcataatatacagtgcactgcttccatatggtgcattgggtagaagcatattaaacatattacacaaacagagctcaacacctcacatattattcatcaacaatgcaccaattagacaatacaatggtcatgaaaatcaacattggcatatgtgccccaggtccagattaaagtagatggatggggagaaatgaaaatagaaaaggggagataattaaacaggatggcataaggccgcataggttagactgttacaacaaacccaaaggcacagttttttattgtcctgaggcacagcactgaaaccaatattgtttaagctctaagtgacttattaagtagacctagaaaatttctacttttaggctagtgctgaccaatagaaatataatgtgggccacagatacaagccacatatgtgagtttgaattgcagccatattaaaaaggagtataaagaaacagatgaaattaatacattttatttttactcaatgtatgcaaaatatttcataatggtgtctgtataaaattattaatgctatatttaatattttttacatactaagcctttgaaatctgttatatattttacacttacagtacatcttaatacagactaaccacatttccagtgctcagattggctagtggctcagattgatcagtggagttttggattatttcattacaattgtatcttatcctgcagtttattttatgctcctttggataactggggttttttttcttagaaggctgggagggtggggttgaatgtgtaaactgcagagacagagccacagaatagtccaggaacttgccccaggtcacacaatctctaaatggcagaatcactctcggaggtctttccaccacatgacctcctccttctaaaagtccattctttgtatgtcctgccatatccttgttttccataaaagcacaattatgatctattagctagtcaattaataatgataacccattgtattagtctattattgtattgctgtaaagaaatagctgagactgggtatttcagtccattttcacactgctataaagacattacctgagactgggtaatttataaaggaaagaggtttaattgactcacagtttcgcatgacaggggaggcccctgaaagttacaatcatggtggaaggagaaggggaagcaaggcatgtcttacatggtggcccggaggggagagagcaggggaactgccacacttgaaaaccatcagatcttgtgagaactccctcacaatcatgagagcagcatgggggaagccacccgcatgatccaatcaccccccaaccaggtccttcccttgacacttggggattacaattcaagatgagatttgagtggggacacagagccaaagcatatcacttggcgatttataaagaaaagaggtttaattggctcactgttctgcaggcggttcacacatggcttggcttctgggggaggcctcagggagcttttactcatggcagaaggcaaagcaagagcaggcacctcacgtggcaaaagaaggagcaagggagagaggggaggtgccacacacttaaacaaccagatctcatgagaactcattcactatggcaagtacagcaccaagccatgagggatctgcccccgtgacctaagtacctcgtgagatttggtgctttttgtcaaatatccaaactatatcacccaaagaaagctactctctaaaaaccttaaaataatgtccctttgctctaacacttaggacctctttctacattctagatgaacagaatttgaaagcattttacaatgagagcagggggtggtatagaagaaaaattaactgcacctggactcagacaatctgcattcatattctggttttgccctgcattacctgagtgacagtgaatgctaagcagtcagcccttctgggtctcagtgccttcatctgtgaaatgggaagtcagagtgcctgtctggcctatttctgaagattgctgcaagttttgtgtaagatcatatttgtgtaaggaattgctcagtgaaaagtaccaggcaaatggaagagtctgttgcttttcaaaagagaaacatttaaaaatcccggtatgccccatatttattcatttgtttatttggtaatgacatcaataatctgtgaatttactcaccttcaaaaaaaattcagccatgacagataaggctaatatcatctcaatatacccccagctccgcctgtcacttgcttaactacctactgctagtttgcttgatacaagcatttagtcaaagaaagaacatttgtattaaggcccagtgctagataggagacaagcaattggtgcacacatagttttgaatggaaggctgagctggtgaccccaggtaagcagaggcctctcacctccacaacagaaaacatttgtgccaatggaattgctcctgtgctgccacatataacgtgtttattgtgtgtgtaagggtgtatgcatgtgtgtgtgcagtgccgaggctcaagaatgaattatgcactggtgggtaaatccagtggatccacacaagatgcaaaggataaacatggctcaaattgagtccaaaagaaagaagaaaagcaagcattttctgtttcatattaattggtaggatgtgggctgtaaaatcctctgtggcagtatttggtgtgccgagaatgttttctttattcaatgaggatagtagaggagaagaaaaatctgccactaaacactatcataccaccttaagtagtactaaagataatgattctaatgcagatagagaaaggagctgctatgtcatcaatgatagtaagttttgtttatgaaatattaaaatattaaactgcaaggcattgtccatttttattcactgttcttcagagagcaaatgcaaagttacagaagaattttattaaaaatagcttgcctagaagaagcattgttaaccaaattactatcactgatatcatttacatgtgtcatgtttcaaaagaagactgtgttgttttaatttgcttttttaacaccacaacaaggtctccaaacatttaaataaaacagaaacagttcattagaacagaagaaaactatctgaatatactggtcacaacttgcttaaagcatttctgacagcagccctctgttgaagagaaaattgcacaaattgccagttattatcatttttaataaataagccttctaccttctccctccctccctccctctggcttctgtgtgattgtgttcaacaagcatattttcagtggcaccatttctattaccaagtgattgagctctgatttacacatcaattacccaccttcatggagattttcatgctcccctagctgacatcaatgaaacataactgcgtaaacgctttatttcataccagttttggataactgagactgataactaatcatatcgagagacaacgtgctataatacacaaaacaataaatatttccctttaaaaatctcatctattctttatgagttaaccattcacatgcttatctcagttgtccatttcttcaaggatcttcctgtcactgcgtatctcaaatgaagttagggttttaccctagaatacaagcattcgcaaaggccaaattatcagtttccagcttccccaaggcgtagaaattcttattgttttccttccagtgttgtagatctcttgttcactcttccatgtttgtcgcatgggttcatctttaataccacttcattcatgtgtacttgaattagctgaagtgttcaagtcccagctggaacacagctggctgattttgtttcctaccccaagccaacctgagagtgttcctatggcactttcctcataaagttataacatgtgttactctgcactgcaattgttttggaatggatttgcctctcctgggctgtgaatttcccaaaagcttttattatgtcttttttttttctttttttctgagcactaaacatggtacctggcatgacatagatatccagtaagtgtttgttgattaaatagacaaattaatgtattaattaatattttgtcaacatttgtcagtgaacttaggtagaaaaatatgttagcctgtcatttgttcattcattcagttgagaaatatttattttgagctgaacactgagcttggcatgtttccagatacatgggaagcagaaatgcattattcctctctagtgacagtttcatttaacacccacaagttctttcagacatagcaggaaaggggagaaagaagaatgagttggaaagccaaaggagagttgtgctaggtagagtagaagggacaggattagaatgaatcgagtgcaatatagagtaaaaaagacaaggtctagatgatctgcacacactgtgaggaggcctggagatttcattgtgaaccggctcagaaatgcagtctgtaggtgcatgcatttggtagtttgaagtaaaggtgttggcagggttggttccttgtgacgagtattaggaagaatctgctaattcttcctaatacccctgaagtttgaatgaagtatgaagtttctggtagtttgttgacaatatttggcattctttggcttgtagaagtatcactgtgatctctgcctttaccttcacatagagttctctctgggtttctgttttcacatcttctcctcttataaggatgccagtcttataggattaggggcccgccctagtccagtatgattttattttaactaattacatctgaaatgaccctgtttccaaataatgtcatattctgaggtactgtgcatgagaatctcaacataggaattgtgggttgatgcaatttaactcacaacagggttaccctgattctagtcaggcaccttgttagggcaagagggagaagtgtaacctagggaagagtcacacctataggtccacatgagaaagcaagcctacggtcataacagtttgctgctgccctactttcatactcaggccggggctctgcaggagtgcatggtagaaggaggcagggccaaaaggttaagcctatagggggtagaatttgcctgggcaaaaattagtgagtgcaagtggatcaaagggtttgttgagatgtgaaaacagagtcagcttaaaattgtcaattataaactgctccttaagggcattaatttccttagtttaaaagtaattaagaatactatttctgagaaaatattgttttaaattaagtagttattgaaattgccttgcttatagctaaatgaaaataaaacaccttttaaaagtgtcacttatgagaagccagaaggttatattaagactttgacttggaaaagaattcctgatatttaatgggcctagagaggaaatacttcaggtagctttttcctaatttgaaagacagagctgatctgtgtaagttggctgcagaagcaactggtatggaacttgggacgtggcgcatgggatgaagccaggacacattgggacaggacaagggctcatcaagagcagagggccaagctaagccttgggccactgagcagggtactatgcctgcctcactagggcaggcaggcctgaggaaagaggaaaaggaggaggtgaaggaagaggaaaaggaagacctcatcgatgacatcaactgtgtactcctgagcagcaccacagattccataaactgaaccttgcctcaagccagaattcaaataaaccatgaagtactttagagccatcacaagtattctaagcttgtcactgcctctctgcttcctttctcgtaaatccacgggaccatttctagttgtggaaaggatcctcctgaagtaaatcaagaattagatctagtaactctttaaagctcagcattagtatcaactttgattaatttagatagggaattataaatgagattggttcaagttgacagtaaagagtgaatgaagaaatattggaagaaacatgaagaaacaggaaatatataagaaattgttacctctgattggcaatggggaacagggtggatgctgacaagagtggaagtggtaatgttttatatcaatttgatatttatgtacagtagtttaaatttttgatcatattctaaagtcataaaatataaatgaatacatttgctatattcactatccgattacatatttgcttggtttttgacatccattcaaggcccctactagtcttcaggaagtatttttataagcttccaagtcattcagttgtttgcagctctcttggtttggccatgttgagtgtggggcacttgtaaggcactggtttctgttacaaacgggtcaatgagccatatgaagtgatagtgaagcctcgtttttaattaataggtcagaactaaagttattttaaaatgattttctataaaaatggaaatcagacatgtaatctaagagcatgttattagagcagaaaagaaactcagggatccttagatatctattgtgcaatagagctgtggtagggtatgtgcatatggaagaggacaaggaagtgcttgacatgagattcaaggagataaaatcagacattccatagttgtaaagggataactgacacattctgagctgcttgggggagaagcgaagtaacatttgttgaggagataggcacccctctcaagcagtcagggatattggaccatatctcttagccaacagttatagtgtatgaggacaaaagaatttaatttcactggagaggttgcttttagaggacatttaattggcatacaaagtggttgatatgctgaatactgctgcaggcagatgggaaactttggcttgctagagtcatggtcattctatataaaagtggcatttccattaaaatggaatcccctgaaaatggagttttagtgcactcttacaatatttttgacaatcaatatccatttgagtgtctacctatgcttgcttttctgagaagaatgtaaaccatgctccaatagcccctgagaagccgagatattctgaagatagttaagattttagacataccttctggatcaattgcactgtgcacgttgtgtgagcagagcttaaatatgtggatgtgcctctctgtgaatagagtgcccttctcttctgtgagtaagactagaatcttctttatgaccaagagggtggcctctggattctgacagccccagcggttactgtgtttttgtaccactgactaattgtgtggtgttgagcatgttaacctccctgtgtctcatgtatctcagtttcctcatccgcaaaatgaggatggtataccacttcagagtttttgtgaggattaaataagatagtactcataaaagtcctggaacagtggctggcataaacaaggaatcaacagataggaactattagtgttattgttgttcttctgcacaagtctattcttgtaataactgctttcaccttcaaggcacttttcccaacatataccagcaatgtatgtttctacataatagaataaatacattagttccctaaaggtgtttggtccttgattttccttcatgaaatgaaaagacaaatgatctcttcaggttaagtttgtcagattttgatatgcccaaatgggtcaaataaagaaatttatctattaatataaagaccaggagttattttccatgtgatgcctgggactcacactgtgagatccagatgcagttggtccaatgtatgccctgagcctggagatttataaaatcttctctggatgattctgataggcagccaaaattgtgaaccaagtgataggagaaatatttagaaacatttccaatttaaagttattattttaaatttcagatcattattaatttgtgaattacatttttaaattgaccaacttagtgtctctgtctcaaaggtcatatctgagtctatagaagaaaatttgtaaaggatatctaatgaaattaacttaatctgttactagaaagactttagacttcagcaaccatgaaattttgctatgtttttacagagtaaagaggacccaaaagctataaagagatttacatatcgctttatcagggtgtcagtcatcttatctgttaaatgtgagcagtcattagtagtttacagaagccttttttgataactatcatatgtaacctttacactaaccatgcagagaagacataaagttaattttcatgttcaaagaaggaaactgaggctttaaatgtaaagcaatttattaatgaacaagaaacttgtaagtgaaagtgacagagcctgtcccagatcatctgaatctggatgccatcttttttggacacactgtaaaattccttaaagctttctacctgggaacaaaagaatctgtttctttgactggcatcaggttaggtttctagtaggtttttaccactcctaagtgtattaaattatctttgcagcttgagtatttggtatttgttagagagatgacaacgtcttcttgagtgtttggtaggccagtcaaaataattttgtccaaagcctaagccacacactttttttcaaaaaagcaaatatgttttccttatgacatttgcattgtccattgcttatttatgtacagaaaggttatttgtgttcagttggaggatgcagtgacttaaaaacctctgaccttaaggagggaaaagtctaatgggagacttagagaatcctggttaaatcattagaagaaaacaaaattgagccctcttaatgagcacagtatatcataggaccaggaatatccatacagtggaatattatttaactataaaaagaaacgaagtactgacccatgctacagtgtggatgtacattgaaaatagtatgctcagtgaaagaggccatgcacaaaaaaccacatgttgcataattccatgtatatgaagtatctagaagtggcaaattcattcagagagaaagtagattagtagttgcttagggctgggctggatggtaggattgcaggacaggatgatacctaaaagtgtacagagcctctttttgagttgatgaaaatattctaacattaatatcatggtgatgctttcaagactctgtgaatatgctaaaaaccactgaattgtacactttaaatgggtgaaattgtagctatattagttatatctcaatcaagctgttattaatgaaaagagaggactagaaaagaagcaaagcaggggatacagaaacaagttaggagggatggctcttgggaggtctgcctgacttaattggaggaggcttagacaggctttgcagatgggctgaatctttgcttccattttcagaaatggaggggatgaggtagtcccaagatgctcctacattgaaatattaagcctgtttctgccaggacctctggactattgatgtctacataattttacaaaccacagatttaaaggaaaatcaaaaacaaattggaatgatcagatgggcagctgtctagagctaaaaacttgtgtgtttctcaccttttcattctcttcttgattatttttcatgagagacagtgtttgcagggagatagttcatttgctgaagagagtggtggtatgctgagttcctcatgagtcctgacattaaatatggctgaggaggttctactggttttagaaattcctttccaaggccacttaccttctattcttttgcacacctccagatccaaggttcttgtgtttttactctatatgtgtaaaataatgatggcctgttttgagctgcttttatagttttgaatttagcactttacataatgtgggttaagtttgaaggtattggatagcagagattttcttttcttaacaaaaagaagttatgtagagattagatcagtgtcaaattcaaaataggactcggtatagaaaaagtatcacctgacactctggaacatataacatggataaatatctacacatgttatagaaggcagggattcattcagaagaaccacaggaagtgagtgatagcttatgtttgtcctttgagtggattaaatatgtatttttatgcttttgcaaagatattagccaaataaaggtgtttactgtagttggactggaaaacaagtgaggctgaattatttaccttcatgtacaccattactacagtaaatcatatattagcagtattttaaaacaaatttatcattttaaaatatcaattttttattccccaagtggctttgtaaaataaccaaattaggtaaacaatgagtattagcttcatgaaatatatgaaccaaatggactgaaactggtttttactctccctcgcccagcctcttccccacagatgcagttaatttttataatccctttagggtctgtacattttgatataaggaaactagtggtttatctatactcgaatctaaattaaatccctaaagtttttccctactgccaatttctaataaaatgcagtcctaaggaaaggtgaccaatggagtgcatgtgaaactcatcttcattctgaagtgtgatggaaacacaggaggcagaagggacaaaccatgttgcttgggaatgtgaaagcctgagttccagcctcctagttctctgacaaacccgctgtgaggcccattaccttaccttagttctatttcctcatctgtaaaatgagggcactgcaactagatgattgctaaactctcttcctgttataaacagtctctgttgtaaaagactagcctgcattgtcagcctgtgtgggctaccactgtgcgctaatgaagacggcataattgaactttctagatctcacggaatctacatgtgccctgcattttattgtcccaccaatgaacctgaggcttttaatgagcaaaatgagagttatctacatacaagataaggttcaagtgtctgagagaaggagaaggctaggagaagatactacatgtacttgaagatggaagaaacagattcagatcttcctttgccactagcttgatgacggcttgagacagctccctctgttcatttttggagggccttagtttcctcttttgtaaatgagggcagttcctctgtttgtggtggctagggaagcacacaggtgggtgaaatcacagctaatataaaaatcctgggctgggtgcagtggctcatgcctgtaatcccagcactttgggaggccgagacgggtggatcacctgaggtcaggagttggagaccagcctggtcaacatggcaaaaccctacctctactaaaaatacaaaaaattagccaggcgtggtggctggtgcctgtaatcccagctacttgggaggctgaggcaggagaatcgcttgaacctgggaggtggatgttgcagtgagctgagattgcgccattgcactccagcctggtcgacaagagggaaaactccgtcaaaaaaaaaaaaaaaaaaaaaaaagaaaagaaaaaaaatcctatgatagagagaagcttctcaccatcatgccttacaccaaggtgattaacaaagtagttaaatggaacttgttcttctttctgaccttttccagtcagctagcgtggatatcaatgaaatagcgattccaaaaaggtaacctggagagagagaaacctaaggcctttggttaattcatagtaaatttggttttgagtggtcagtttttatattatcataatgtgaccaattttattatatccaggagaaaaaagttggaaaaatatcctaacttgctaagagtgatgaatccttgagttgagatttttggcttaacttctcagtatgaacatgggttttcatgctgattgataggatcaattcatcctgtcttcatcacagaataaacttgaattgttcataccgatgatatgatgattaattcaggtttttggcttgagcatttctttgtgggctatggagctctttttcctttggaaagcaggcctgggtgtgtaaagatgtatcaaattatcaggggacagacatatactttcctgcagcctctgcagggctcacaggttcaaacacaacctgcctgaatcataagaaatttaattgagtagataaagaggtcctcataattataaactgcagtaggtataacaagaggctaaatacatagctgtggttttaattagctggtgcttcaaattagtaatgttggtttcagtcagaaatcagtgacgttatagactgaaagcctcatcaccatgtagttcattactcattagacctcactgtgtgaagccttcaatacaacgccatgctgagcaagaaaggaaaaagttggagatatttggttgccttccaagagcagtggagctctgtggagattaaattcattctcgccagagatatgagaattaactgttctttgtcggatgtgttaaaaaatgcagcaggcagttttgcttgcaacagataacacccgcatgcacactcaatctgctattcaaatttgtgtctggaatttggtagctaatgaactgatgcaaaatgcagccaagagcctcctaacaaatcaaagccagggctaaagcaccgaaagtgcccttactgctgatcgtttgaaaggttgtcatgcaagctgaagcacgtttccttttcttctccttctcctttctttttccttcagggttttaattatatctttccctcggagaaggaaggtagtttgcaaagccaagagaccaaagcacttcagttctcttcatgggagaattaaatgtgatctatgggcctgtcattcttagctgtcaggtgcacaaaatgaacagatagctagaaaactgacatcctgctcgcattactcagaaggaaaagactttggttcttgtttgtgtgtagatactaatctgctatggaaagcaaagaaattaagtgtccttctcctttgcaacaaccctgccctcactaaatattgctttaacttgttactctacccccacccccataacacccaatctttcttacatttggataaattgatgggattggattacacacagccaatttatggtgttgaggtacggtcacaagcgccacacttaacggactgaagatgttactgtgcctgattgtttccatgtcagtctcaaacatggagacattgagacacacaacaattgtttggggttctgagttcaacttgtgaatggaaatgaaagatgatgctagaaaatctaatacctatggagggcatctgagactacaaataatagcctggcttccagtatctggacttgatatcttccttgaccaggcaaggcctagatatggggccctggctttgggtaggactctgaaggttttctttgctttactcagacagtgataacatttgctgaatatactcatgaatggtccagtgagctttaatgtatctgacgtttgtattatgaaagtgtaatgtgcatttaaacatcctataaatgttgttgctgttttttaatggagaaatgagtgttctttatccaggagataaagttatcaaagtcactttgaatttgaccattcaaggattcctgtgaagaaaagtggatgattaagtgtagtggcattgtacactccatgtttatcaacatctagttaagctgcacagatagtttatgttctaggttctttgagcaaactagcctaccaatgacaggtattaaggtttcggatatagtcaaagcctgtcaactgtagttttatatcagtagatctcttataattcctttagctattatgttcatttgcatgtcaattatctaattaagtcttaacatgggactattaacatggggaaggaaaccaacatttatccaacacctgctaggcattttatgtacatttatgtaatttaaatttgctcagtgtatatatactcactttgggtaaggttaacatcaaaagcatgaaaaaagcccagtgaataaaataagatacaccactacgagacttagattatggcttaatttgcagtcttgcatgatgaagaaaataattgttttcttaataaggaagcattccattccataaaaccagaaggcctggaatatatcttaaatattgtttagaagcttttgatcctccaatgggaaagcctgaaatgtgatgagagtcacagttagtctttataaaacatttgttcgttgaggtcattaaaggcttttgacacctcctttttttcatccacagttagtcatttgttattcaagtcagacccctttttttgtgaagagtttctcaaaaaggcttccattcacttttgaagaaaactgtgagaagaccaacaccacaacaaccaaacacaaagaagtgtaggtgatttggtgatttatttttttgtggacttctgaaaatgcccttaaattctcctgtgagttcatcaaaacaagctcactttggctatgggctcaggacagaaatccaatttatcttcagctccgtactttgataattcctttcccttaggactttgtgacatctgtggattctgagccctaggtagttggcaacacaatgtaactttaattcagtacctttctgcactgtgggctgacttttggggagtatgtaattgcttataataatcaaaaaaggacaagggaagagattttgctttacttgcttgtcatgaatatcatttcaaataagcaagtttttgttttcttctttattctgaagagctggtcaggatcttaaactcaataggtgtaatgaaaaggattatctgttctctatgcagtgtcaacttgggcagcaagttgacttgaatttttttcttattattgacagcaaggaaaatttaaatgacttgcatgattaattaatctttttctctttttgtcttttccttttcatatcagtcactatgaacaagaccgtagtgcacttaaaaaaagggaatgggagcggaggaatcaagaagtccagcaagaagacgatctcttttcttcaggctttgatctttttggggagccatacaaggtagctgaatatgtatgtaatttttctttctggaaaatggttgcttgttacatttttgaactcactaatcaacatttaatttatgtttaaagcacccaactcatttccaggggaatatattttacaagtgaaatttgtacatacactgtatttgaggcaactgcaagtttctgacgaagtcttcagaaacaaatttcatcttcttttgggagcacagtatgattgaagagagacttgtgagacttcctgtctccaatgagcccctctctgcccaacacttcctacagcaaggaatgcccccttgacactttctactgctgtgattgtcagtaggcagctcctgaagacttcatcagaatgtcaatggagatgtctgtttcttttcccaatcagtgtcatccattgcaaggccactgtttttcttttccattttaggttgttagcagctcttcagtggtttgagtgctctttgaaaatcattgttctagaataaaggaaaaaagccaatcatttttcctggtggttaataatcatgggttagaagattgtctcaaccagaggggggtagtatagctaggttgaatttctagtggtattctgactagtgtgtagctccaataatcatcaaactgctgtgtctacaagtattgattttacaatgactgcttctgaactttctatttggggtagagatgagaggcgactgggaagagattatgatggaagaatcttattgaattgctggcagctggttggtttttattgaaatgcagtagcagtgtaattttctgtaataaaaatgatgtaagaagtacaacaatagagaaaattttcaagagctgtgattttagaagagtaccctttaagggacagtgacttctggaaaaggaaagttcttaaggaagacagcataggcccaaatactactttggggtagagagtaagctatttggattggtgactggtgagaccaggttcttgttaccttgttcaaagcaagtaagcaactcttgattgagacactgcaggaactttcaagtttggtaagcctgatgaagaaacttaggtcacctaagctactggttttcaatctgtcagtaatagtatgatccctaaaaaagcagtgttcccatatcaacaggttaatttgtatactactttgaaggtatatatttagatatataattggtttaacaaacatttatgaaggtctactatgtgctagtcactgccttacaccagtgtacaaagaggaatagcatagtctctgttttcaaggagttcctagtcgagtggcagagatcatttgacacagtgatggcatgcctgcatggtaacagagagatagcaagggacagatcagcgaagactttgtattcaaactcattataaagagcttgcacataattttttacatgatgaaaaaaatcattacaaatatttaagtcatagtatggccaggaaaaatgaacagtttagaatgatgatgttgggcagtgtggacagtgggtcagagggaggggaaactaaggaaagataaagaagctattgtaattgatgaggggagcttatgtcaggaatgatttaaggtagagtaaggaagttgaaattatggaattgggtatctaattgcatgtggggagtatggaataagaattaatggttcccaagttttttatttgagagggtggtggtatcatgaacaagttttgttcaggaggagaacatggttgctgcttgtagagaaaaaacaattaatttagttttgagtgcgttggctttgagatgctagagagatatcaggagagagctatccagaaggcttggatatatgggtctgaaactcatgggagtggtcaagggagaagtttagctgttattgtcttataggtatcagtggaagctgtgagaatgcctaccatcactgaagagattatggagtaaaaaagaggacaaacaattcttgggagtagcaccatttaaggggtaaaagaggtggtgaaagcagaggccaggaaaggaaactccaaaggaatgatcagagtgataggaagagaactaggaaagaaaatttaatagaaacctagggaacaaaggaaggatttgctgtgcctcagagaggtcaggaaaggtaagaactttaaagtggctgtttggatttggcagttaaggagtaattggtgaccttatggagagttgttttatttgttgatgacaatggtcattgtgggatgccaaactgccaggggttggagaataaatgggaagtggttaagtaaagaaagcgagacagtcaatgtagatatgatcttgaagaaatgttttgcatggaggaaaaaagaaagaaagataagttagaaagtaaagggaggaattatataaagggaagctttttagaaaaatgagataaacgtgaacatgtttagagattgatgggaagcaaataacttcaatggtgaatgagaaggtggaagatacaggagagaaaggtgaggctaagttgagcaaggtcccggaggagattaaaaataatacaagatggagagcagttgaggaatcatgagctatagggtagaaggtgggaacagaacattagaatgagaacaaagcaggcgaggggaaggaagattggggaagtgcaagaaatcagggcctccattttctgcagaaaatggaggagaggtcaaagcacggtaagtgtcttatcctttctcaagctgaagaaggaataaggagataagttttacatgttatctttggatgggttagaaaaatgagctttactcaaaaggtttattcttaaaatccaatgtccacactatcctcaacattataatgaggtggagaactcttgatttattctcccttcataattttaagtcacgatgaattgatggtcttgtacctttaaggtaaatgccatcttttcacaaggcctgttatatagatccattttttaaatgttagcagtgtctttttgagtaggcagttgaaaaaaatctgttatcaacattttcagaagttttgaaagccatctgtcttgatattacaagggtacatcaagtagagacatagatgggaacatttagtatagtgtggggcagggcctattgtgtgattagtagcttgttacctttgtgcttcctgatggggaaaaaccttgtcctttttttttttttttctgagatggagtctcgctctatcgcccagtctagagtgcagtgcgacttactgcagcctctgcctcccatgttcaagtgattctcctgcctcagcctcccaagtatctggaattacaggtgtgcaccaccatgtccgactaatttttgtattcttagtagagatggggtttcaccatgttggcaaggctggtctcaaactcctggcctcaggtgattgcccaccttgacctcccaaagtgctgggattacaggcgtgagccactgcgcctggccaaaacctttgttcttaagtcaaaactgtgaaggaaaagaataatgctagtgattggtgacctaataattatttttctttcacccttgctttgatgattggttgttatcttgagctgcatccacattcagggttccctgggagaacactgaggagtaacagagtactagaactgatgttgcacctccataaggctccccagaccaagactgggcttgatatccttggagtatctggacatgccagtggtcatgggagtcctagagctggcccatggtccactggtagaaacgaggacataccacagctcttccctaagatagcagtgggagtgcttatcaaatttagaataaacattcctgatggtgggtcaagactttcaggaaagttcttgctaccctgaagcctaaaacaaggtccagtcacctgtccaatagcgccagtggttcataaattagccaacatgaacactgatctctaggacctattatcctttcttggcagaaagataaatggtgatctctcatgttcctggctaatttctttcccttcttttctttgcctctaccactgccagaatggagagaatgttgaccacccctagatttggttggtaatagggaacttctctcttgggctgcttttgtagcatatgattttcaaattggagtttgtgttatgcttttgagaaggatgtcttcaaatgtgcctgaaaaatatgaagccatttgacttgtctaggttagtgcactaagtttggtaaggaactggcatgtaacaagtgcatgccagcttactgtctgctaggcactgtgctagagttttatgtgtatgctcatttagtccttataacaatgtgtgtgttcatttagtccttataacaactggggtatgcaactttcccatgttttccatgaggaattttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggccgaggaattttaactcagagaagcgagatggcttctttgcattttcatatccttatacatggcgaatttagaccttgcatccagttctgtatgattccgtatctgtaacaggaagttatttatcctctgacaggatgtcagaatacttgataagcttacctgctgggtgatggtggagaagaaactccctttctctgatccataggttttctttttcctttctggattgaatcatagtaattaataagaatagtaatattttatggctcttcatagcccaatgagaatgaggaaactgaggtgcacagaggattattaaatggcttacccaaggtcatttgtgttgggacacatagaggtagaggccagatggaggccagagctactctgctgactcacatggttgttttaaggatcacatgaaataacctgggaaaccttgctttgaaatctgtaaggtgctacacaaattcaggtattatctttattataattagagtaaagaaggaaatagaaacttagagcttagagagattaactgcaaaaatactagaattagaaaaagacaaattactaaatcacatgttagccacaataaaataaaagaaaaaaatgcgcttcaaaacttgaattattttgctacttgtattaaaaagaaatactatggtacaatagcctcctagcacattagtcttgcatgcaatgaaattatactactgatttgtagatagcattagaaacaaactgagggaagtttgcatttcctgaagtaatgagaggcaaaaaaacttaaatgagggaatgctgttagtcatgagccacaaaccagacatgtaatttatgcctgaaaatacttggaaaatgcatttcctgatgatagagaaattgtgattgcttagaaaataatggctgcagaggttacctttaaagaatcaaccaattatctagaccaggaagtaaataattagccaaattgaaagaagcatataattgattgaaatggctgaatttcatttttgtcatgtttataatgttcaatcaagattaccaagaatattttgttccttaataggattactaagactctggagggtgaaaaagaacatttagtatgaatcagaagttgctatggtgtataatgagagtacattgtgtaggtgtgtataaatgtatttcaggccccattgggttttctatccagtggttctcatatctccatcttgagaaatttaaaagctgattgacagttacccacctccagtggtgggaaggtagagtgcttactctggcgacctggactggactactaattatgtgctgattgttgaatggtgaacttcttgaggctctgtgtccatgtgtcctctgtgcgtaaccctgcctcaggagggtctcaaatttaccagtgtctgtcttaagaactactacaataattcctacttgtagccacagaacatctgttatgcaaaccatatggatcttccttcaatcagcaactcagaaagcatcaccagtgaactcaaccttgaactgtgtgctatacatttcctgtcacacgtccttccttctgagacaattgctctatgaggaaactagtctaagggagatgacatccctctatttctccaggttatcacagcttcactcctgtgtcattactgtgcaagaaagctgcacgcctggattgtattagcctagacctctaagtccacatgcaggcaggctttcactgagttagtcatcataagaaaaagccacatgaagacatatttgcatcattttggaaaatgaggccccaaaaagtgttacattgctcaagtgttcttgtaaaaatatcagtgagaggaattccttttcacattttattatcagacaacatttgtctcatttaatgaattaggatatgcttctttcgatgaaagataattctataacctacgagcttttcctttttgccttagctaccaggaaactcaaagttcaatttaatgttcaatcatagtaacgaagttagcctgatttttgccttctattatgtacctttgacttcagccattgcaaattctttattttgatatagacagggtatgaattttaatttatcctgttcaattctgtaaaaatgtattgagtatttgattagcacaagacatggtgctacatcttgggtatataaaaataagtgaaatgtagtctctgacctttaagaactcatggttttattcaaggaaagatatcataagtgtagtatacactgtgtagtagaaggttgattttccagacttattgagagaaatttcaattttcctctaattttgttcacatagacacagtgttagacattggccagtttagaaattcttttaatttcaagtatatttttaaaacctagatatggaaaactatatctaagcttgcttcagaaacccagatcattataagtaaatgtcaatgaagagacattacaaagtaggcaaggttctccctactgaggacaagatgaacctcttttatttactcctgaaacaagaacaggaatttgactagcttgcttgtaagcaaatgagctttcacattcttgagtcctgattgtgtttccctaaggagactacaatgacttttcagggcatggaggtattacagtggtctctatgacacctagggagaaggttctgattttgcagagctctgtttctgtgaaagccagataatgaaatgaaggcattccaatgggaagtgaaatggtgttgttttcccttgttgagtcagatcattgaatatggccagatatcactgttcatgaggcaaacatctgacccaagaggtaatctgtttgacaggccaaaacaacctacaaatgtttaaagcttgcatcagattcttgttggaccctcagcacaatgaaatttctttgttttaaatttagagattgaacagggagcctggttttggctactgtccatgtggttcattgtgcaactcagttgaaggagaccactatatacaaagagtttattcttgtctgggctaaaaagtaattcctgccattaaaaatgacaaacctagagacttttaggaaataaaagtgacttctacccatctataacttttaaatatatctttcagatgtacttttgaaaacagagtgattattcagctgaggattatacagaatgttaattgtttaatcactacttcagtactaaggttgcgtatgatacaatatatgattggaggataagcaaactaaaattgacatatagttatttgacttctaaaaatatctgtccctgacagagctcccttagcatatgtttagcatacttttccttaatctttgaaatttatatttctcctattgccctcatttctttggaagtgtctcatatggtttcacacacacatagtatgagttaaatactttttacggtatatggagatggtgctgataatgaggccaagattactggtttgattctctctctgttccttcttggtatcgtttgctggttcctcatcttctctcagtctcttaaaggttgatgcttgccagggttctctgccaatccgtatcttctcattctatgttttctttccccagacgacttcacccatttctagcacttcgccctctagccatctgcatatcctcccatcttcacatacaaaggaaaacacacagccttagactgagatgctagcgctggataggtatactccctgtgtacactaggagactgggctgtgttaagggcatgtgaaaaatcttagatgttaaacaactatcttcagcagagagtgtaccaatggttagatggtcactccctcctgtgcactgaaaatgtgcccatggcttctgggacttgaaggccacatagggtggtatttttcccatccagtggcccagttgccagatggctccttgaatactggtagccttctatcattgcaacatcttgggccaggatagtgcagcctaggtacaaaaaggtcctttggctttctgaattcagcagcttgttttgataaactctttggcatataaagagaataaagaaagtcacttttgggggtgatcaactgagctttcatcaaagtcatttccaagtatacagctacccaccattttttagtcatgataactttgctttctgtattacaaaaacccatgcaggagcataattattttaaaaacaatcacagccattttaatagaaccaatacatcctacagggggtggtgtagctggtatactgattgtccataaaatgagttggttgcctctctaactgctatacattaggctaacatcactttgaaaagataactttgttttggtttccttaaacaacagtttaaatacttgaataaattttccttaatcattgaaaagacacagaagggcttgagtcactgttgatgaacaattgcatcatttcaaagtaaatgagtatgaatcatcaatatgtaaacacagtcattccagaatatacaggcaaacactagtaattcatacagttctttgattagaaggaatcagattcattttaatcatgagttagctcaattagatgctgtttaattccattcctgtcctaaacttattatagtcatggtagcacaatttaactgattttcttatccaatagcctaagcctttttcatggtataatgtggtgcaaaggctgatatgtcaaaaatttatataggtagaaaattccattataactccaatgattggtaagcagaagttgttaatcacaatgtagaatgtagcaattcagctcatctgtcacagaataagttatttttctaataaaattaataaatgatgtaatttaaaagtttttctcaatgaacatgtttaaggactggctagggagtataaaaatgttaatcatacccgctcattccagaagctttttcaatagtgttcttgattttttttcttacatagcacatgaaaagcatgaaattatatggcagcaagacatatttaaagaatcccgtatgatagtctacttagggcatctgtttgaaacattaacattaggaaacacaaacctattcattctctctcctcccacccccatctttttgttattttagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagtaatttttaaagttttgtttggtttcacttttttttagttctctgctctaacctctataatccagtattcacaagcagctctcatttaccttaatgagctgtataggatactcttcaagttcagggtctgaattttgatcttctgtcacttgtgacataactgattaacacgctgcaaatagagttaaatctcaataatttggaatgacagaagacaaggtcggtctgactgaaagaatgacaagttggagttataaaatagtttcataaaatacagttgtggtaatactatgtataaattaataacatttgagattataattggtcataagtagtatgaggttcatgagaagattgcgagtcactatatgccttcactactcagtagcatattctaaacctaaaatacagaagttccttaaagtagaagaatgtagaactgtggtttgctggaacctgaagtagaaggcgttctttaagaattttagtttcttgagtgattacagagctattccttggcaagatcttaatgttttctcccgtatccatcaatcttcccttctgcatctccttcctccacaggtatctacatagcccttttattctactttcatcctttctgtcaaagcaaaaagcattacgagcaaccaaaagcccactggtttagaatgagtaaatatcctacccatctcaggaatcattgccttgtaaaagagaagtccagaggcaccaaagcctcttctaaggaatgaatcgctaatgattggattccaggccttgtggcccctgggtgggggtcatgcatggtgctgcctctcagacactaccatgtaagcggctgtctactgcacctcaagcgtttgattggaagaagccactgcctttagattggattcctgtcactggtgactaaaggcttgaaataacacagaggaagaaagtagggttaaattcttactcaataggagtgacaggcagtctgtctgaatggttgtagattccaagttagtggtatctgagttagagaagtgtgaccctataagcaccctggctctccttcctttatttatcctcagcagatgcggtgatttcagaggacgatgggaacataaagggagggaggcctggggctgttgactatattttctgaatgtatgtttttaatattgtttcatttctgaggcagttttgctttttgtatcatcattcatcaagtcttgtcaagcttcctcttaagtatctctccagtctgtcatctctacccccactgcctttgaaccacctgtgagccttcagtggactgctgtgagagcccctcttgactggtctccttccctctagtctcacctctcttccataccatccatgcaggctcatctaacaggcagatctgaccatgtcactccctgcttttgattattcagtaccttctcatcacttccagggaaaagtccaaatttcttagtcacacatacaaggctcttcaccctttagtttcatactccttttttggccacatatttcactacttcttcatgtgcagttgaaatcccagccatatgggactacctgtggttccctgtcatgtcatgctttatcacgcttccttgctttttggcttgctgtcccctcagcctagaatgtctttccccaccctcccttgtcttcctggtaaagtcctgtttctccttcaggtctggtcagttgtcaccttctctgtgaaagcttccctgatcccctcagcttaattaaaaacccctttgtcttggctcctctagcaccttctatatgccctgattggcaccgactccattgtattgtagtgatttagttatgtttctatctcctctactagactgtgagctcactaagagcaaggaatacctcattctctctgtatcccaagcgcctaggaaatacttagcacatagtagatactcaataaatgtttgttgaatgaatgaatttcaaaaatggttacttgattacattttctaagccacaatgttaatcaaataacatgcacaaatgtgaacaattgctaggaaatccatcatgagttatatctttttcagttgtattctgtctgcctgtttcttactctgctctgctcctgttctgtcattgagaaatcctagccataatttctactgaatgacttaatacaggctttaatacttaaaaatcaaaaaagagatctgctttgaaaaagtacaagtataatgggaggtggggatatcattcttgtttcttcttttgccctggtatctgctgctgttccctccttacacagccagaactgatctggaaatagcactgccccataaagcagtctgtcagcctgtttccatacctcattagtagagtgacaaatcacagacccagcgaaatccaccctgttgtaattctctctcttatacattcacaaaatggctgacccagattcagaaatgacttcatgctttcactcagtgctctggcacaccaacgagaggtacattttcaaagacagtctgagctgtcatcagctctggagacgattatcccaggagcagcctatgtgcttgcagcctttggtgatggtacaaacagaccttgctagagctctgtatgaaaaatgggccaggtgcaataaagtcatgataggagatcagtgaagaaagtacttattttaaaatatgggtttcaaggaaggatttgacagaagagtagagagaagcttaaagccctaaagtcaggggcatatacagaacccaagggtaatgtgaaaaccaaaaataggaggaaaggaaaagagaggttacacggcccaacaagagagcttagaagggtgcagattaaaatgcgggcataaatatagacagggaggagcattatggagctttgaacctaatggaatttatgtggctaaaactctgaccaagtctgaaaattcaccctattaaatcttgatgcacttttcaaaagcacttagcattagaattcagccccagttcctggcgccaaggagtttcaggcactaggttccgggtctctagtcagtgtagccatctttgatgagtggtagcattactctgagttattaccaaaaaggcttatccgtggagcaatcacagtatttctttgagtattctcaactttttccctggctttagtgacaggaggttgatgagtgttagtgaagtgcatttgtggggagggtgaagcaggatgggttgaatggccagaaaacagacaacattctaagctatacaaataagcagataacattatatttatgaattgagagatcacaaactattattgaaatgtgatgtgcaagtgtgtgtgcccatgtttgtttatgtgtccacatgttgagtatatagtggggaaatttttattttttatccttgaatcatttccatgcttcttagaatttctgtatcaacaataaggatattagaagtataaccaactttattgcaaaaggtcagcttttcaattgaggcatgtcattttaacaaataatttgtttaaaaactttctgttggccgggtgcagtggctcacgcctgtaatcccagcactttgggaggttgagatgggcggatcatgaagtcaagagatctagaccatcctggccaacatggtgaaaccccatctctaccaaaaatacaaaaaatagctggccatggtggcacacacctgtagtcccagctactcgggaggctgaggcaggagaatagcttgaacccgggaggcagaggttgcagtgagccgaggttgcaccactgcactccagcccggtgacaaagctagactctgtctcaaaaataaataaataaataaataaataaataaataaataaataaataacaaaacttcatgtcatagagtttattaacattcctggcaacaacaacaacaaaatgctgatgtgttctgcagttgggtttagaagaattttctcggaactgcatctgaaaacagtaaaaggcctatttatatcaagtggaaactgagggttgcttgcagatggtgctttattaggaaatgaatttgttaataaacgtagctttatacatttctttacagaaatttttgttcatttttaccttaggataaaaatctgctggtgtagacagctctgcattttggtgcaatttgttattagtatagcttgccaagtaaataatcacatgcacatgaaaggattgatatcacatattaaatgtctccatcctaagtcagtaagcttttgaaagtacaaaactaacgtgtagagtgtcatatccctaaagggtcatttgctttacatgctgctcttggctgtgatctaaggctatctgaggctccaattgccacaaaactagtggccttagaaaactttaatagaaatggtgtgggatttgtctgtagcttattttagtggttagctttgtcaaccagctgaaaaattattgctcacatttgtgactgtgcctgttttgtttcacaccctatgcagtgaacactgtgagtataattacctttatttattgtgagttagatagtaaactcaggtcccttgtgtgagaactgcagagaatgctaggatattaccattgatgttctagatatgtccatgcagctacacagaaaagagacagctgcttcaatgaatggaaggccatccagttgctgtttacaactcatgctaagaatttttcacttgatgtattagtctgttttcatgctgctgataaagacgtacctgagtctgggcatttacaaaagaaagatatttaatggacttacagttccacgtggctggggaggcctcacaatcatggtggaaggtgagaggcatatctcacattatggcagacaagagaggagagcttgtgcagggaaactcccccttataataaccatcagaccttgtgatacttagtaactgtcatgagaacatcacagcaaagaccttctcccatgattcaattacttcctattgggttcctcccacagagcatgggaattatgggagttacaattcaagataagatttgggtggggacacagccaaaccatattaatccacccccagcccctcccaaatctcatgtcctcacatttcaaatccaatcatgccttcccaacagtaccccaaagtcttaactcatttcagcattaactcaaaagtccacagtctaaagtctaatctgaatcaatgcaagtcccttccgcttatgagtccataaattcaaaagcaagttagttactttctggatacaatggaggtacaagcattgggtaaatacagctattccaaatgggagaaattggccaaaacaaaggggctacaggccccatgcaagtccaaaatccagcagggccgtcaaaccttaaagctccaaaatgatctcctttgactccatgtctcacatccaggtcatgctgatgcaagaggtgggttcccatggtcttggacagctctgcccctgtggctttgcagggcgtagcccccctcctggctgctttcatgggctggcattgagtgtctgtggcttttccaggtgcatggtgcaagctgttgatggatctaccattctggggtctggaggttggtggccttcttctcacagctccactaggtggtgccccaacagggactctgtggcagctctgaccccacatttccctttcacattgtcctagcagaggttctccatgggggccccgcctctgcagtgaacttctgcctgggtatccaggcatttccatacatcctctgaaatctaggtggaggttcccaaacgtcagttcttgacttctctgcacctgcaggctcaacagcatgtggaagctgccaagatgttgggttccattctctgaaatgacagcccaagcttagccccttttagccatggctggagcaactagaatgcagggtaccaagtccctaggctgcacagagcagagggccctggacctggcctatgaaaccatcatttcctcctaggcctcctggcctgtgatgggaggggctgctgtgaagacctctgacatgccctggagacattttccctattgtcttgagggttaacattcggctccttgttacttatgcaaatttctgcagccagcttgaatttctcctcagaaaatgtgattttcttttctattgcattgtcaagctgcaaattttccaaacttttatgctgtgtttcccttttgaaatggaatgcctttaacaacacccaagccccctcttgaatgctttgctgcatagaaatttcttctgccaggtaccctaaatcatctctcttaagttcaaagttccacaagtctctagggctggggcaaaatgccaccagtctctttgctaaaacgtaacaagagtcacctttgctccagtccccaacaagtaactcatctccatctgagaccacctcaccctggatttcattgtccatatcattatcagcattttggtcaaagacagtcaacaagtctctaggaagttccaaactttcctgcatttttctgtcttattctgagccctccaaactgtcccaatctctgcctgttacccagttccaaagttgcttccacattttcatgtatcttttcagcagcaccccactcctggtaccaatttcctgtattagtccattttcatgctgccgataaagacatatctgagactgggcagtttacaaaagaaagatttaacggacttacagttccatgtggctggggaggcctcacaattgtagcagtaagttaaagacacgtttctcatggcaacagacaagagaagagagcttgtgcagggaaactcccccttataataaccatcagatctcgtgagacttactgactatcacgagaacagcacaggaaagacctgcccccatgattcaattacatcccaccagattcctcccatgaagcatgggaattgtgggagttacaattcaagatgagatttgggtggggacacagccaaaccatatcacttgaggtatatcaccagtttatttttttgtgcattcttatgaaaatacaatagtactgagtccaaggctatatctgggctatttccaaacccatcaaaatgaagggataactttatacttttagggtgccagaaaagactcttgaacttagtatttgtcttatagctgtgtggaatctagaaagctttgtaccttcttctctgctagtccatcccctggtagttgcattttgtttatgcttttttactaactcttccaactcactggtctcattggtattcaaattcattttcttatcatattcctcctaactttctcttcatatttcccctaactttagtgtctccctaagctaaatgaagttgtctccaactgaacatgtgtagttgatagtaatacaaatagaatacctggctttgcattctttgtgatgggaaggttggagatgctaaaagagaagtgattaggaagggtgtcctgaggaggggagactgagaccattctcacaatagcaggactgatttgtcagtcggggacacatagaggtaaccagggagggtttcacagagaatgaatgggaagtttgttttgaacttggcctttaatattgggtggtattagagtagttcaagaggaatctggagagcagttcatatgtgtgcatattagtcatattagtgatggatagagataatagcatatacagaaaggggaagtgagtaaaatgtgaagtatattctaaggataagccagtttatctgcagctgcgggtatgtgggaccaaagtgagagagctcaaaagccagactgtcacttatcttgaatttgtaggcaatgtggcaaccagagtgtaatgctgaacttggcacgttactttccctgtcatcctaggagacctaggaattctctcaagaccattgccatcatcaattcaagcagtaatttctgagctttcccaggtttgttctctacttccctacaagaaaggacatctcaattcttctcttgtaaccatccattctttttcagtgtgcttccccaaggatttttctaaagtaatgccgaactggctattttataccatacttttcttcccttggagtccttgtcctccgctcaccccctttctcctccatttttttcattggcattagtcaaacccagagatagctctcaaggatggcttcttaaagagtatgcaaatacttgggattttttttctttctttttcctcaagtcctcttctttctcctatgtatttttttttcttttctaaggctgtatgcaagtggttctagccatcagcatcctaaaacaatgtcagtgatttcaacatgccattgtgtaggtagatcagagtatttggtttcagtgcatctttcttggtgcactttgcttttaaagcctttgtcattgtttaacactttttttggttggaaagaaaccaaaagattgatttattcttactctgttttaacaaaatttaattcttatgttatacacatttctgtcatcattattaataatgatgcaatttaaaacagcactatttgataattttagtgattcttcatgaggcagttgaaaataaatctctactttggaaagtgtgaaatattgcaaagcatagttttaatgaggtatactgagatgtgggtttctcttctggcctgaactttgtttgtaaaattaagagagttattttgcctttctagggcttttgtcacatgaggagattagactaactcattggtggggttgcttacagctctaaatcttctctttgtagttaagcccaaacctatcttgtttgtatagtaatttcagccattatctcccccacccataaccctctaggagtatccacagtagaacaacatgaagggatctgagccctgccggcacacattcagaacagtttctgactttgtaagactaggtaaatatgggaagactcaaattggatctttttagggattgactaccaattcagctggggtattcttatatttcacctttttttttttttaaggtaacagctatatgctgaattttaccagaaagtaccaaactgtagactcagcacatagcctcctaatccttttgtcaccacccactaaaataatgaaagatagagaactcctattttcacattacttctaggaaaatattttgacagattcagtatgcagtaaaatggtaagcttttgttacgtgtgttccaaatcatcttgttatcactggatatatcgattagttcagtactttctgagccagtcataaaaaaagacttctctcgttctgcatgaaagaataagagaaattgaaaggtagataaccatattgattcaacccaaatagtaaatgcaaggggctttagacataagtcataaatctctttatgggagttgtaagtctgtttggtattttctatttgacatgaaagaaaataatctctaattaaccatcattttaaagtgaactatgctttgatttgagtttataatacaggtgccaataacataaacctgttacctttatactttgtagtttacaaatgccttcatatgtcttatcttgatccagttctaatggggtctggaattatcataattttcttttctgcagaaacttagtctcggagaggctaagcgtcacttgcctaaaggcacacagccagcaaatggctatggcaggaccaggacccaggcttttagtgatacttccacgtggcatttggtgtatggtgtgctactgtatatgtatgggttaattttctaaaagtagctcctctactggcacgtaaagggcaagagaataatgagctgaatccagcttaagttaaaattcccttcttaggttcatatttcgaaagtctggaccaaacacaccaaaaagagcaatttttcttgtggtattacaggttatagtcatgtgtttttcatttacaaatatggtgagaagtagtgtttttgcaatattcctaaatgagtaacatatgacacaacttgttagaggactttttcttggttcataaagtttctgagtttttgtgtctttagtgggatgactttatcagaaatcctcagacaacacagctaaaatctaaatttctgtggttgaaacacagccaccctcaagagaaaccttagatgtaaatgagaggtcagtaaaaagtgggtatgaaactaattgctatagagggagtaagacttctctcaattgtttgagcccctgaaaaatagattaatttaaaaaaactgtctaggatcatcaaattgcaaaagtagttagcaaggaacagacagaatttgtgacatttattcatagacactaaatgggtgagtgtcgctctacctcagcaaaagaacgcagatggtccatagatagtctacttcagaaaataactgtgaaaataaatgaactaagtagctgtgaaagttctctgaaaaatgtgcaagactctgcaaatgggaggcatattagtttcctgtagctgcaacagaatatcacaactgagtggcttaaaacaagagatttatttgctcacacttctggagaccaggagtccaaaaagatgccacactcattcccaatactctagagagaatatttctttgcttttaagtagcttctggtggccccaggcatttcttggcttgtggcagcatcatgacaatctctgcctgcatcttcacatggtcttcttctaggtgtgtctctctgtgtcctcttcttctaaggacatcagttattggatttagggcccaccttatatcccagatgattcatgtctagatccttaactacctccatctgaaaatactatacatgtatccaaaaaggtcacattctgaggtactgagtggacatgaatttttagggactagtattcaaccctgtataagagaggtcattcttcccatttttcagactaagaatagagggagtctatgctgtgctcaatgtgaaaagcctaagccagtcttttggagggaggtgggcttctccacctcagaactgacttcaggtttagtccacaatgcttctgagccaaatctttaagctgttcaacttgactgcgactatgagaaagacaatggctctggataaactggtaaaatataattgtgcaaaaatgagatttaaaaatcttttagggaagtataaagtttcttttcacttagataatagataaaaaataatttattagtacaaattgacttttttgtgagctagagctaggtgggcaaaccttttctgaaaaataattattttctactatacgggctatatggtctgtctgtcacaaatacttatctctgctattgtagcatgaaaacaaccaaagacagtacataaatgaatggatatgggtgtgtgccaataaaatttgatatatggatactgaagcttgaatatcacatatgtccatgtgtcatgaaatattcttttcctcttttacaaacatcttaacagtgtaaaaaatactcttaacttgggagccaaaccacatcaggcagtgggctggatttggctggcaaaacttagtttgctgacccctgggctagatctagacaaagtttcacacagcagaacacattttgcttcttgtgcctgttatcaacaggaagatggtttttagaaagtggggaaagtcagttttgttcttgtacagagcaaaatcctagagtcaggagaggtatctatagtcaaggaagaactggccaagggagtagaggctctcccaggtctaggcctacagacaggtggatgtaaatgttgtgtacccaggatttgaaatactctttaacaccacaaatctcaccctctattcaagagaatctttttttcttagtgacttatagggtgaaggtcattttaccttttgcttccttagaattagagtgtctggactcccagcgcaggaaaccatttgcatacccagtcttggactcagaatcacaagatgtaaaagaggtgaccacagagataactgctaaaaggaagccagccctattattttatctaaggagaaggtggcctaggccaaacccaattgacattctggaatcccctatagatcagaaggacaaaagcatgtatttgacttgggtgtggggaggtagagatttctaagattcttagaaaaacaagtcctcttgtatagcctacgactttgagtcaaattaggtgaaagggttgatggtctgtggcatcccctacaggctttgcatagctgatgtgtaggggtgttttagtatgtgcatgcacgtatgcatgtgttaggtgtccatgtgtctctttggggagggggtgctgagaaagccagtggacttctggaggaggctagaaattatggcattcttggtactttctgaaatttttgcccagcaggcagggagatatctaggttcctaagtgatgtagaatgaaggagaaataacagacaggatctgtttagttaaggctttaaagatgaggtgaggttcagcaagggctttgggaaacacatgggttgatggagaaaaaaaaaaaggaggctgtatcttagatgtaatgaactgcataaagccttgaaagttagcggggctgtaaggtccatgcttcctatgaatgggatcatgtcactcacatcttaaagtaggtatcatagaagaatgctccaatgatgttgcagtttcatgaagaagtttggtgttgggagaagtagctgctatgctgtatagtttcaaagtcactgttctcatagaaaacagggtgaattatgacttccagagtcagttaaggagatggccccagttctagattgaacctatgctttggccttcctctgcttgtcaggttctcttattcatctagaccttgaagtgaacttactggggaagctgatttcctctgggacatccagaaatgccttccttgtgcatctgctggatatggagaccaggatgttcatcctgagtggggtctgactaaatgttctctcctgtgtgttgagacccccaaaactgcctttctgcagttctactctatttaacttgaataaatgtggccttcagattcttgggaagataagaagctctaacttcccttcccagtcaagattgatggataaaaagggcctacaccagagatgtaagcctgaacccacaatccacatatattataataaatctagaaggagtggtcttattcaatactggaggaaagcatttagctcaaggacaaacatttttaaaaacctagtgtaacattttgagtgagtagttcacactgagtttgatactatgaattgtgattttttttttttttttttttgagacggagtctcattctgtcacccaggctggagtgcagtggcaccgtcttggctcactgcaagctccgcctcccaggttcacgccattctccggcctcagcctcccaagtagctgggactacaggcacccaccaccacgcccggcttattttcgtatttttagtagagacggggtttcaccatggtctcgatctcctgacctcgtgatccacccgcctcggcctcccaaagtgctgggattacaggcatgagccaccacgcccggcccgtgatttttttaaactctgaaaatattatcttacagactgtttgaaagattcactcgatacctgtaaaatccagtattttcttttattcattcatttaccgaatttgcattgagtgcccattgtgtgccaggtaccatgccagaagctggaaaactgagatgatgacatgttgccttatcttaggtagcttaagtccagagatatagacacaaaaacagaaaagccacagtgaagtataatagaacagtgtttggtattctctttaagcagacaaagaatagctatctgaggtgtttagaaaagctttttcaaggaggtagtaacttgaggctagctcttggagtatgattggaagttttcttggtgaagaagtggaaatataagctttcctgcaatgtaaacccacatcaagttgtaaattggcttgatggcttctgggattcatgagacacaagagtcagctgtgtttggagagaaaaagaaagattggttgggaagactcggggcttggtatcacctctacatgatggggagtcttttaaatcattaaaaggtaaagggcataaggtataatcatggtaaataatgtttcagaaagtccatcttgacaggatgattggcaggggagttgggggaagggagtaacatgttagggctggtgagattcgaggcagaaagattgaaaaggctgttgaaatattccaggccagaaatgctagcaatttgaattagggtcatttctgagacagatttttaagtctgattcaatggaaatcagtgattaattagatgggccattgaaaggaagcccacatagaggaatttaaaatgatgctgagatttctagcttgggcaagcagtggatggtgataccattacccaagattcctttctttgacactgagagcttcagaaagcaggtaagtttttccctttatctcttttattgtcatgctgtcatgatataggctttgaatgtcatgatatttgattaatgtttgcacagtgcttcttgttgtaaagctatgtacaaaaaatgatcatttccttatgcttcattgaaagatttatttcttacaaatggcctttttggttcaccacttaaaaattaatgtcttacctcagagaggtttgatagtactttagagagcatgggaaaatatgctgaatattttcttagaaatcatagaagtgataagtttctattagtaatgcagtatattaaatattaaattatgttttgtcttttgtagtttttgaagtcaaatgaacacattaccagttgaatttatcttgtactgatagctgtggacttttctatgatacttcctgactttgtttcttttagactgaagctggctacacagggaacatgtttacaatggagagtgggaatgactttgcactcagtgctattctctccctcagtccctatgataaaatattgatggagaaatcgcatcctttgattttggtggagttggtgtagggttgttctgactatctgtatataaattgttacctcaaaaactgtttgactcagctcccctgcctttatttggtgaccatggacattgccttttagttaagatcagtgaatttctggtggtagaagcaggaggaaagagtggaattgaatgtacaatatttttgcactccatagttcctaggattgcaattatgtttttttcaaatatagagaaattaatcataatgtatttacttgactttacttatgcagtcagtctcagttctcaactatttgaaatactctgtaactcccatatacttttgtattttgaaattgctgtaaacacagagattttgagatctgaaagcttcacttcttgcagtgaagaatatagaagcctggcaagagaaggcctcaccaaatgcctcaccttggctaattacagaactgagccttgaactctctacccacaaatctgggcattaagtgaaaagaaaaaaaatcagcattttgaagaacagcttatattctgttaattcacatgaattgaaagagcagtactctgagaaaacggaatcattattttctttgagtgggggacaaggagtggcagtaagactgtagaggtgatagtggtactatttataaaattacagattcttgattctgagagggctctgcaaagccagccagtccaattggcttaatagaaacacattagtctgcttttaggctgcatattcctcactcaggaatgagaaagtcctgaaaagtcacaggtgaaaccttcatctgagagagcttgcatcaaaaataatcaagtgcagtgtggaacttggccattttccataacccaaagatacatataaaagttccttagttggtaggctccagcaaacatattagccatatgaaaaagcaacatctaacttctatattttgacttatgaaggaaaaggcctccctgtcccataaatatgtacatttcacctcctgtggggaaaagaaaggaaattgtagctacagtgtgttattgaatcttcctgaaattagcctttagagttttagagtttggtaagattgaacgattgactgccaatgccttccacacacaaaaaacaaaaaagtattatatgtttgcatcaacactcgttcaatgctgaaatacagctagtcaaaacccatgttaaagtttttcatatattacataacaccgctgtataatacattaaaatacatactggattggagataaattactgaagaaataccagatttcgtttgtaggttttaactgcaacataattcattgtgtgatttacataggtagacataagtacatttctttccaaactatatagcaatatacgtataaaagctataaagtaaaaaaagcaaaaccatactagatgactgctaagaaaagatgaatgttaattttttaaatagcaatctgatagtaattttaaatagcaatctgatagtaaacatgatacaagaggaaaggttttactaatagacatttaaaaattatgtcttcataaatcaagaggatatattacttagagctagaaataacagtgccgtgcttcctgttttgaataagccattatgcatttttgtctttgcatccctatttaatttgtacagtgttatttattccaataattagtgttaactttcttggcagtaggcgttataattacctttaaaatttaaatgggataaaaatgccttgagaacatggtttaggaaaactcttaatatttattttcacttgtctctttaattattcatttatgtagtatttgaaagaaaatcttgagaaatggaaggccactgacagaattacttcccagatgagcagacttggtttttcagttggttgggtgacattctggactgttgaggcattagtgatgccaaatggaagctctactacccattcaacattgccaatctaaatacatttcacttagaacagcacaggccactttttcttattctctttcttctgaaagtaagtcattatttaaaataagccattattctgaaaataagccattcacatgacttctgatttcaaatatacatatgcaggtgattattttcctaaatatataaattaatttgaaactagtttataatcttgataaatgctgtaactctgaataagcatactagtctccaagaaaatcaatgtttcaaaaggtggaagggataaatctagcctgtcctcagccattaaaaagtacacaagcaatgtcaaggtaaggttgacagtattcattcatttattatgtattgagcacatctacatgcataatatagttttaatctttacagggggatccaaaaactttagaagaagagatgactggatttttgccaattccagtcataatacctgacacagaataggtgctcattaaatacatgctgaataagtgaatacatcccctggagagctgaagagttcatagcatatctgaagcaattagacaataataataagaaaatgtgtatgcagttgtgtgataacaagttataaaatcagggtattgcatgtgcaggcctttcttgaagatgacagcccagagattgaccagaaacaagtctgacatttgaggaagttagccttctaggtgagaggaattagataatcaaagatcaagagtaggagtaagcgtggtttcggtaggtaacaaccagtcactaaattaaaaaaaaaatcaacttcgtttgacctttatcaagcacttatcatatgcagagtatggtgctagggctttgagagacacaaaattggaaaagattgtgttctgccttcaagaaacttacatctagcaggacaattttgatatattcacaataacagcaaagcaacaaaatgaagtaaaaaatcagggttgcaggagagttcagagtaccctgggagcccagagcagacagaggtgcatgctggcaggtggatttaggatggctctagggaagtatggtattggcatctgcactaagccctacaagacactaggatgaaatcatgggcattcataaacttttggggacttcatcctttctgagaagctggtaaaatctctacccccatgtctcagaaaaatgtgacttggaaatactcaaaccatttttcatgcaattgcttaggcttcctgaagtcaaactgtggacctccaagggaatccatatacccagagttgagacctttgcggtagtgagagaaaacttgctttggaaagggatagagccatatttaaattgcaactgctacctttagctttgtgatttggacaagtttctcaagccttcagagtctcaatttcctcatctgtaaaacaaggataataatacttacttgagattattttagcatagaacaagttaacagaaatcaccggatcacaccaggcaccaaacacattctacttttcacaataccttggggctgcttatgttttattgagagcaggggagttggctgcatagctgggttattatcaagtgctgtcttttttctatcctttcttaccaattaacagattatttgtattttagaataatcctcaacatgcaaaactttatgagtacacagggcgaaattaactgagaaatatcccacactggattcttaggataagaacaccagaaaatgagcctaaatgttcagttgtaatgttgatgatcacagtgtgctaaaagatgtgtgtgtgtgtgtgtgtgtgtgtgtcagtgtgtgtgtgtgtgtgtgagagagagagaatgaagaaaggaaagaagaaagaaagaaagaaagaaagagaagagaaaaagaaagagaaagaaagaaagagaaagaaagaaaggaaagaaagaaaaagagaaagaaagaaagaaaacaaagaaagaaggaaagaaagaaagaagaaagaaagaggaacggaatgttaaaatgggactttagtagtgtctctgtttttattttccccaccagagggctttgggctttcttaggcctcaggtatttccatcttcatgtatttccccatggtttgttttgatttactgatggatgactcaagattttggtagaaacatgcatactcacaaagaaacacacaaacacacacatacacatgcacaaaagcatgcataataacagaataaaagcagcaggtgacaaatacatactttagctgttgtacaaacttataatgtagctttacaaacatgatttttagtgaagaaataaaagaagggtagtgatgggtggttaggtttagaatcaaaagttactcagctggttgttgtacaggtggctcagtttggctttgtatactgtgaacgttttgattgcagggcttaaaaatatgtaatcctaattttaagaaaactaatggaataaacactcattatgcacacaaaagcccttccattcagcttttcattgctttgcagttattttctccaaaataaaatgagtaattatttggaagtactttcagcacatgcaccatgtgggctaagcttgttcccgacatctacaatcctttgaatggaagtgccaaaggcctcctgccaccatgggccacagccaagtgtcatgtgaacctgagtctcacaggttacatgggaaataaaggacagccagaccagcccgcttctgggaaagatgcaaaatgcaggaactagagaacagcgatgaggtgtttttggagactaggcaccaagtacgtatatcttatgtttaaggatgggtggacaggtggatggatggatggatggatggatggatggatggatggatggatggacatttcaagcaagcctaaggacatagtaagtttaggatctacataatggctcaccagggcatgctaatttacttacataaaaaagaaatctttttcaaaacattatacttgtgatttggtttaccaatagttaacattctatattttttagcaaaaacatattaaaaatgttcctaacttgtattatttggatgtgttttttttcttgtactgagaaattccaaaaactttacttggatagataaatacctaaacctcatgtctttggtagagtatatcagggaattgtggtgctcaggaaatggcagatactattctcattattattattgttagaaggacaaatagttctagagtatcaggaaatgagagtggatatagcgtggtaacactcttgtctgaggtgacctgagtagagagatcaacagaggactttgccatcatctagctgatgagttgtgtggtcttggattttcttgtgttggttacacatacactgagcaggttgcgtctaccctctgagctgactttctcagctgtatcagagggagaagtaatctttgctttttactttctttaaaaggctgtgtgactatgtcctgaggttgtggattgtgagtgctgtgtaaactgtgaagtgtttcgtgcttgcaagatgagggcttcatacatcttcagtagagctccccagatgcttttatctgtgcaattaaaattacatatgtgttcttttcaatttctatggttgcaaaaatgaatgtatcagtctacgtagtactcaatgacagaatggatttacttttaaaataccatgttttgagctctagctttgcatatttatgaacttctggagttgtccatgtggatgtttcctatgctaccctgctttcttgcgaatgaagaggtctgaaatgcttctggagtacttctatgtcagttttgcttatatgcatttaacatgttggtcttacaggggagacatgtcttttttaagtataaagtacatatttctggcctttttcttccttctctattgataagttgtaactgcagtttttgtttgtaggctttccaagcctggtgatttttcatctgattcaacctttctcttgacaaaacaccagcctcaaatgctttgcccattcctggtcaaggcttagacttgcacccttccctagtggcaagagactttcagttggcttgttgcctctcggaagactactttcattgcatcgctgacttttttttggctttggaggcttggggaactatttagagcatttatttatatgaggcaacattgcccaacagaaagttactttctgtggactttccatcattaagatgaatttgtgcctggtatacattaatttcacccatacttaatatctcagaagttaccctgtgagacaccctgtgcaaacattttaaatgaattagatcatctatgtacaatctaggtctgaaaggcattaaaagtttttaaagtgtcgtcattagagaagaagctatggaggctacttttaataagagttatgacaaaagacatgtctctgacataagaccaacatgttaaatgcacagaagcaaaattaagaatagattattattgtcataaactaattaatgcatattattggcccttactaatcagaggctttcaaattagaaatagttagctctgagatttctgacatttttgaatttagcaatgtccagcagtgataattttgaaggaagctattggttggcctttaagtttgtaccttcagcttcaaattcagcaagttcatgcaatattatatgggagcctcggtagattttactgaaaatgtgatacatttcttcaaaaaagttttaaaaggcagtatttcaagtttgattgataaaggaagtatccataagttaatgaggcagtcccaatttctaacctgggccctttcttataagcacaagtttctgtaactgctcaaaatagcacttaggcacttagaacaaatatatacctggcccacctacacacctatttgattttctaaatgttggagctaagctcctaagattgcaaatgaacctcaataagcaagtatcaatgtgaagaataagcaccccagtagctaaattgagaagtgcaattgtaattatttggtgaaatagaaatcaggtcattgcagctgcacattgtcgtagaataagctcaaaaggaaaatgtcttcattttgactaacattgccatattttaactttgggattgttataacttgttttttcacaggtattatctgtattatgtatgtttaggaatcaaagcagttcttacatttcaacagctaggtaaaaataaatgtgtgtaattgttgaaaagtatttttagtgtttaaggagaaagcaatgctttttgatctaagtagcataactcaggctggattccgcagtagacatccctgactatagacatttctgtaggcaattaagtgcaaattaagcatgctaagacccaaattagagtcaaatctgatgtgagccaatttactctgaactacagtcctggagtgagaagtgatctgctaggttgctgcttagctcagatcttggtgctacctccactgggacaggaggaaaaggggagatggaaggaagaacaatgaccagtggcttaaagtaatttaataattaactttccacattggttaatttgtgcattatttacacaaaaccagaaacatttttaacccagtgaattatccctgcccatagcaggaattattggagaatgccacaggaatatacagggctattgaaagcatctgcttagagcctttaaagcttgaaccatgatagcagaaatggtgactttatttttataaaaacttgaatttttgttttttaaaatattctattaagcattcagtattatcattaactaaatgacattcccaaattctagaatgggagagtaatttctcagtggagaaatagctattcttatacataataaacaacaatgattctggtgaaatactattgtagataggaaccatttaggagccaatgttcatgtatatgtaatagtttcagaatctaatgttcagaatttccaaatatctcccgttttctgcatagctacctcccagacccgtatcaaaatatcacttaatcttcattttttttaaaattaccggtctatttatctcttttgtaaattttcagggctttgacatagaatgtgtccaggtgaaaatatattacattgtctctctctttctctctgtctcaatctctttctttctttctctctctctctctatctctctctcacacacacagacacacacacacacatacatacatatacacacactcctatctgtaaccatttttcttctttcttttcttctcaggagattttaagcaaaaacagctatgaatttttctatttaacaaataccaacatggaattcagtagtatattaacagtggaaattttgaagtctgtattttttttagcaaagcctaagtgaatctgtgagaactaataaacatgataacaaaatgttgcatctcattaattgtttttattctgacaaattcctgatgatttcatatatatttgagacaatccagaaatcgagcaatggggtgaaaccattgatcttattttacatatgctgaatgaaaggcccaggaagagagagatgccgtaattgacaacagttcttctgactctcacataaatgtatgcagcagcagtgcccttgtcttttgttcttccttcatttagactgagtcaatccatcagcacacattgattgagcacctactctgtgctagatagtgatagggtgactgtatgagttattgttctgagcaggacagttttgaaagtgaaaaggggcataaactagtgaaacagatgcccgactccagctgagggacctttgacaagtgacttcgcctctttcagtcaatttcctcaactgggaatgatgataatatatgtatcaagtggcatgtgtatagtgcctaccagtacctgctacacacagtaggccctccagaaggttttgatttcttcctctttcctggaagcattcctacttctggaatcctgggtgtttttgtccaatacttaatggcatttactgaatgctgcctcctattggggtcctttgggtgcatgcctgtattctgttagtgctgtttagaccagaatttcttggagagctgggtctatgtctttttatctttgcatttactttgatgctgctagttaattaattaattcactagctatttattgaatactctcatttagcaaataatatatatatttaagatgagtacagaaagataggcaagtaaaacaaacctgtgtcaaatgaaaaaataagaacctgtggagcttaaaggattgatatagtctctatagatactttaacgcttaagcagtggcttgtgactctaggggaattttcctgactacattcagatgtgcaaagcatcagttttgttgtcatatatgttggcattttcattggaacaagaagataataaatacaaataaccatctctatatcatagggtttccttttttaaaaacaacaaattatcaggtttcattttcaactattaaaacaatcttgccaagaacttatttttaaacctgtaattttgtcaattttgagatttatttcaatttttttagatgtccaaaaaataatttatgcagattacaaaatctagttttcacatgaaggtatccttgtttctttatttttaattcaaatcaattaggtacatatcaatgtgttgatttggtagcagaaaatataatatgtaatacctttcatactagaaaaaatgttgaagggcatattttcaaatgtcatttagctgatgagatttagagttttctacatatttacttcttaagatgatattggtacttaagtaagagctcattattttaaagcctttgatttcccttctgcttgatccttctgtgaaaccagaagcttgtgtctttagcttcctagtctctttttatgcaatgtggatttttttttggtatgtgtagtacaaccaaggatgtcaggaggtgtgtcgctttgtttaatacacattgatgtttaaacatttaaatattgctaaagaaaaccagctggcaaataatttagacgtatgtatggtaagtcattcctttttcctctttctccgcttatccccatctctttcccttctttctgtatttgatagctactatgcactagacatcagatatgtatatgcagctgccttgtacacatctctatttggatgttcccattgggacctcatattcataataattaacactgaacagctgatggcgctactatctatgccagaagcctggaatcacctacaatctctccccctccctcatgttctatagcctatcaatcaccgaatcctaccttcctcatttactttgaaactgtagttccaacactttggccatcaccttacaacaggtaagcatcatgactcagctgatttctgctgctggttttcttacctctggccccacactgctgaacccctgccttttccacgttgcagccagactgatctcttagtgccacccattgcctaaagaaagaagtcaaacctctggagatccccttgtgacctggcccttgctgcccttgccagcttcttctaacttactgccttccagctatatgaagtgtgccatcatacttttaccagctaatctcagtttactcttgatatcctttgggaagacttctcaaagcaggtattcctcttttctgttcctgcagtttttgtagtccttacgccactgaaactcgtctcacattctattttgattgcctgtttacatatgttactctcccaatagcctggaaactccttgagggcaaggagtatagtgaaattaatttatcattgtatcccttgtacctagcacagaacgtagcacttaagtaggggcctaataaatatagtcatgaatcacttaacaacagggatgcgttctgagaagtgcatcattagacaatttatcattttgtgaaatatgatggagtgcacttacacaaacctagatggcatagcataccacacacctaggttgtatggcatcctattgctcctagtctacaaacctgtatggcaagcgactatactaaatactataggcaactgtaacacaatggtaagtatttgtgtatctaaacatatctaaacattgaaaaggtacagtaaaaatacattattataatcttatgaggccaccatgacatatgtggttggttgttgactgaaatgactgtacttgctatagtgttccttgttgtattagtttgttaggttggctataacaaagtatgtactacagcctgtgtggtttaagcaaaagaaacacattttctcccagctctggaagctagaacactgagacaaaggtgtggacagtgttggtttcttctgagccccctctccttggcttgtaggttgccatcttctttctgtgtcttcacatgatcttcctgtgcaagtctgtgtcctaatctcttcttgtaaggacatcatttagattgtgttagggcccactctgattaccttgttttgcctttatcacctttcttaaggccttatgtcccaaaacagtgacattctgaggcagtgggggttaggatttcaacatacaaatttggaaggaggcgacaaaactcagcccattgcacttgcccttcagatattttcagactagtgcttgattgtcctgaaggcctgtcttacgagatatgaatagaaatgtttggagtgggattttcacaatggcctcctggagtgtctgtggttgggaaggtcccaggttttaagtgtgtgtggtccccaggaccactcctgggcaatgagtttctctttttctagttcatggattcaactggtttgattgcttaaggagcaatgatgataggctgtgttcaggaaatcagagttgaacagatgtcttttggtaatattggctatactgccagatctgagggcttttcctttactttcagtgcccagtgaatgatattataactgtttagaatgtgactattatcagaatgcaaacatgtttgaaaaactttacccttagcttctctgaattgacttactactgttaaggcaaacttggatactcagaaagtatttggctggctttgttgcattttcaccttcttgatgaatggaatctattagttatttgcttattcagaaacatgtgaatcatctatagccgattctctctgtgtgtttgactgactgacattgtctgccatctctcaagtattctttctgtatataaaatcctagactcctgtgcagtttaaatataaaattaaaatgttaccaaaagactcaggtattttcagcctggcctgacagcccatcttatggaaggcctgtttgaactgatgggcccttgatgtcagcagacccagacttttcaggtcagaggaaagaaagtgtctagaatcatagatcttacagagaaaagaggctacttgccttcactgcagtttgtagtgagggactgttgtgatcaaataatcaggaaagagcatgcctcaagttgtcagaatgtgtaatcattttatgccaagtcaaggataactcagtaactgagcaaaaagctttttgttttccagttaactagttagttacaacccgctctctggcagtgtggaccatagaatcatagaaccacagagaatgtagcagtaaggacccatagataccatctagtctaaacctcatttagacatttagggaaattgaggcccaaagaagagaatgaacttactcaggactatgtgttgggccagagactgagctggcacctgcatttaggtctcctgaccctcagtccagtctcctttcttcattatatcagagtgtttaggcctctgccagccatctcaccatttagaggcactatggcttaccatctcagttgagaggcaagagtgtttagcagttaagagcatgtgctcaggggctaaactgcccagatttgtatcccctactggctctatgacattcagcaaggcacttcctgtctgtatgagtttgttagcattaccagaacaaagtaccacagacttggtggcttaaacaacagaaatttacttccccacaattttggaggctagtagtctaaaataaaggtgtcagcagggttggtatcctctgaaggtctctctccttggcttgtagatggccacattctccccatgtcttcatgtggtcttcccctgtgtgtatcttaatctcttgttcttagaagggcattagtcattttggattagggcccacccatattccctcatttaattttaattacctatttaaagaccctatctccaaacatagtcacaatctgaggtagtggatgttaggacattcatatatgaattggaagggggcacaattcagcccataaccgtgtgtctacgcctcagttatcttatcaacaaaacagggatgataatagattctaccccaaaagggtgtgaagattaaatgaattggtccaacatagaatgcctagaacagtggtagtgtgggttgttaattcataaactgacaacaacagaatctaggattttcatttcattcgcaagtatgaaatctaagtgtttaaaatgtcaaaacatttttcctactttcatttacttattcaacagttgtttattttatatttgtgtatcttatattgtggtagttgccattctggtctgaagaaactcatagtctagagcggagacacatgattacaatgtgtacaaagtgcaatgaaatacgagcagggagtcactaagaagaactaatttgacctaggagaatctaaaaggcttcctggaggatgtgagtgaggagccaaatcatgaagtgtgagtaggaattggtcagcaagccaaatgtaggaaaaaatttagacctagggcacagcatgaataaagtctagggaatgtggtggtgagtggacccaatgtagtttggtacagctggagtatcagctgtgttggggaaagtggtatgtgatgagactggacattttgccatgctcagtaggttagactcatattctgtacgttgaagctggctaatagtgatggctgacattactaattgattacatcactcattctcactaatcctgattgagaccttaaaatccatctcaacacagctgtttaggcaaccatcaccattcaactggagttggcctgtatcccagctgtagacagtgacaattattaacgaataaaattaagtcagaaatattcattttacctaaaactactagacttgagattattagtttaaaactgcatagttccttaggttgcaaaaatgttcttttttttttttgcctgatttgtagatgtgataggaacattcgttggaagaactgtaagtagataacatgtagtaaattgggtttacaatgattttctaaaaaaaggaaaaaagataaaactgtctcacattttgatctgaatttatcaggctcttgaagttcaatgaaatgttcaaatacatcatcatatcatgaccattggaatcttggcctaaaactcagcatcggaaagtttcaaggaataatacgtcttagcgtttttgcttctactaagggatacatgattttcctcaagaatgcaaacaaagcaaaatctttaggattgccctctatcgtaataaggcaagcatttaggactggatgtattggtcagcattactgatttgtgtcacaagacccacagtattccagaaaacttgacctgcttttctgtgtgccatcttaatacttatgtttttgttcagaaaagaaaaggttcctgttagggagataaactagattaaaatgattattctcagttttggtgagttgtatacaatttttataaatcatgtactattcatttctggcaagataaagtcatttattttgtgtcatacatataattatatataagcatataaaacttacatgtagttgcatgttctatttgctttcttaggttttctcttatatgtgtgcagagacaaaggatggtatcaatgaagccatctcaggtcagtttcttgaggaaattgattctgagatgaagatttttgcatgtgggaaggttcttggggagtgcatttatggtcaacacttgtgaaggagtaaagaaaatgaaatgactctttagagttgtcctgaattgaggcaaggtgccagggtttttgtttttgtttttgtttttgtgacagagtctcgctctgtcgcccaggctggagtgcagtggcgcgatctcggctcactacaagctccacctcctgggtttacgccattctcctgcctcagccttccgagtagctgggactacaggcgcctgccaccaggctggctaattttttgtatttttagtagagacggggtttcaccgtattagccaggatggtctcgaactcctgacctcgtgatccacccgcctcgacctcccaaagtgctgggattacaggcatgagccactgtgcccggccaaggtgccaggtttttaagcccctgcatcaactagtaattggatgtgggctgccccaggaagtaggcacaactttgagtcaggagctttcttagggtaagggaaattcttggaaaggtgactcagtggagggcagccagcagcccgctctcccagaagatgaaagaattagtgtttctgctcagaaagaggcagggatctgggacacttggaacacaccatggacgtgttcatctggacaaatatgaatatcctttgcatcttatggaaacctgtttttacattgatggtggtacatttaatagatgtttagcttatgatttcccatgtctaattttagttcttctaccacttctctccagagtggtctgatatatgcttcttttgcttatattgtcttcagttgactcaacttgatgtctgtttctggctctggcctcctggactaagccacataagaaaaggccatcatttgctgtatattgatataattctcccttctgtacacatcagatcttgtccgcccaaggaaaggaagttagattgcccagaaacaatcagtcgtttcaatggaatgcatgttcctggcctcacctggcaacaagttattatgtggcatgaatttacaatgaattcaacttcctttcctcttgccatacttcaaagtgaaagtaaaaagctgagtcccatttaagaaccaacccaaatgtccaacaatgatagactggattaagaaaatgtggcacatatacaccatggaatactatgcagccgtaaaaaatgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtcggggggggggagggatagcattgggagatatacctaatgctagagacgagttagtgggtgcagcgcaccagcatgtcacatatatacacatgtaactaaccagcacattttgcacatgtaccctaaaacttaaagtataataataaaaaaaaagaatgaaacaccagcagacaggaagctgtccaattggctaggaccaacttattgatgatgccttatgaagaaggctttattagatggagaggactctcaactcaagggtgtgggactattgcatacaatttaatgtccatcaactttgctagataggggatggaggagggtcaagtggagttcataaagttcaatagctacaataagtaaattttttagtgttttcagtcttaaaagaaaacattggctttgttgtgcccaaatcatctgtggtttgtttgcatgttttgctgctttaactccaagagataaatgtacataagcactatgtgttcatcctgctaatgtcatttaatttaatgagtttagaaaaattacttgattaaccttttatagtaagggttttgagaatttatgtttacattttaaatttgaaaataaaataatctatcttcaaccatgaacaaggtatcacaaagcactttttttttttttttttttttttgagatggagtctcgctctgtcgcccaggctggagtgcagtggcgcgatctctgctcactgcaacctccgtctcccgggttcaagcaattctcctgcctcagcctcctgagtagtggggattacaggcgcccgccaccatgctcggctaatttttttgtctttagtagagacagggtttcactattttggcaaggctggtctcgaactcctgacctcaggtgatccacctgcctctgcctcccaaagtcctgggattacagatgtgagccaccacgcctggccttcataaagcacatttttaactaccatccagccattccagttaccatttgtgtgggctaggttttacttttagcttcatttcaacttcaccaataatcttttgagagcctattaagtacaaattgtattcgtatggtcaggccccatctggtgacagagagactatgcatttggatgttgctgacacctggtcatgatggaatctgtgccattggaaacagaggcccaagtatgtctgagataatgacactctagtgtaatgcatgtatatagaatccgaagacaggcctgatgaataacaataccatctgacagcaaataatcaacgcaggaaatttaggccacaacagcttgcttgctctttacactgtcatggttgattggttattctcatcaccctttgtttaaaatcatttcagaattaattggcattcattaacgaaagtctttgcagtggaattgcagaaacagtcattaatgtagctaataaacataaaaaagaaaaaaggtcctattactgggtccctacaggctgttaactaacattttgaataagaatacataaacataaattaaacattttttaaactgctaagaatgtgggaatttcacatggtggtctgtaataatgctttgaactaatttgttccttttttaacatgtagtttagagaaagtgattctgtttagaaattattattgtgggtgatctctcagagaagccagggcaaagccaaaggtaagccatcttatcagccaatagattttaactaaaactagagcactcaaatgtaagtatgacaataacaaagtctaacatcatggagttatttgatcacttagtaggtaggtttctaaggtataaaccttaatgagatttagaaaagcactcattccacaagacaaagaaacaaatctttcctttcaagaagtaatgctttattgatcaggtgcctcagttttggtttatcagtgttgcataatgttgtataatgttgccattagaacaaactccagagaacatccacattattttggaatgatgaaatggtgctgacttctgtttcagttcaagggcctagggcttataaatattttcaaattagttctcactcataggtgggaattgaacaatgagaacacttggacacaggaaggggagcatcacacaccggggactgttgtggggtggggggagaggggagggatagcattaggagatatacctaacgtaaatgaggagttaatgggtgcagcacaccaacatggcacatgtacacatatgtaacaaacctgcatgttgtgcacatgtaccctaaaacttaaagtataataataaataaataaataaataatattttcaaattagtttctgactcatatctttatcttcatatacatagctctggttaactccaaaatgtgcaccattctagcagagcctggatagaaaatccatcaaattttcttattcttctgtaacatgactaggcatttccagttatccaaagggaaatggaaaaaatggcataaagttttaaaactttactttcctatttaaaggatatttgtgtcacatgtcagtgttgtgtttttaagaacaagacaaggtatggagagagtctgtgctctaacaccaaatacagtagaaactcccttaactcatcacccaattcaaaatttgcaagattaaccaacactctctgaaccctgtgggaagtatgctgactgctgcccatgatatatacattgttggccagaggcaatttttgggtagactgccacttctgctcccaaaagttgaattggatggctagtgggggctagttgtgtttgctcccaaccctgttaatgccagtcatacatattattgtagttatgtaattaaatttagtattgcataaaccaaagaaaaatgagtggaaaagaagaaagttgtttcccctataaaatgaatgttttggaaaagtttagtggtatcagtttcctattccttctcaaatggctttaagttcctactccactttcaggaatctcaaatgagcaaccttagagcatgtattgtagatgtgtatgttgtggaaatccagtcagtgagtctgtactcaaaggccttggccttgagttaaaagatttacaattttatggatgaagttataatataatttttaatataccaaatgttgtgataccccatttaaatacaatcctttgatttgatggccaactgagggttataatcaattccagttgaaagagcttctcctctaactggagagtatcaccattgtaggctgagatttactgtctcaaatgaataatcagtattgagcgttatagatcttgcctttatgtcctgctactacatctacagcagatgggtcaggccatttaccaatccgatctcctcaggcacatttctttccctaggccattgttcataccatttttccttatatacaatgttccttctgtcgccacttttttcaatctttccccttcctcttcaacaggagacatttatctaattcctagttcccattagaaaaaaaaaaagaaccaatttaggtaaatttataattctgaactttggttatttgaggttatttgatgtatcatcttcatacttgagtagctgaggtcatgggtctgcaagcacctggtggggttgttgtatacaggatgcaacagagtccagcccagggctctgagccttttctacatggaaaatgattttactgcatttataaatgatatgactatagctggtttgaaatatatgtcatagctttaggctagaaaaatgttttgttaatgtatttgaatgtaaaataccaggacaggtaatttataatgggatattgatacacttttaacaaattccagatctcctcagaagtgcaaatgctgaatgtattgcaaccatgtataattgtattatggcaataaacatatacgtgtgtgtctagagtacacatgtcattgcaggcgtcatagtacagtggatttgtattgaactttgactaaagtcagtcctgatttcatttaaaaaattgtgttaacctttggtaattagaatataaaaccaggaagactcaaaattgttagtctaacttttgtttattgactagaacatctaaatggctttaggcatcacaaaagtataaaaaaagtggcttcctattgggtctttgatccatcttaatttatttttgatgctgtatgcagtttctgaatatcttttgtggcttgtaataaaatagccacagtgcaattttgcatgtatgtcaagcgacgcgtgacctgctatgcaaatttaataccaaggtgccaaagctgaattcataatgtttctcagctacagagctgtttaaggcagtttagaaatcaatgaatatgtaatatgaaggtgataagacctaaataaaaaccctatttatctactatgaaaaagtatttatacacagaatacttagcacatgcaaaaaatggacagagtttccaattatatggtttgcataaacaaatgttaaactgcgtgctctgaatagataataatgtgaccagtccctctgcattgtgctttaaactttgaaaatgtttacagatgtgtttcccctcttaagatataaataaaacaaaatgtgcagctgaagcagtgggatctaatctgagttctagtgttttttttttttttttttttctgtattttatgttagcctagattctatacttgatatagggctgaacttctttaataccagggtaagcagacatgtgttttatgaagtcttgtgctttattttgcaataagaaagatcaactgacagtgattgattaaagtgagaaaattctaataacccaggttactgtagaatgtgtaatattatttggatctgaacttctgatatgccactatttaaatctatatgatgctattgtttctgttggagtggttatgccataattctggtaaacatttgaggagtttgtacagtagctgactacagtgtgagaagagattaacagggaagacaggacttgattgatgggagtcagtcctggctttttatcatgggaaaaatatatttgtgcttctacccagagagaaggataaagcaagtgagtgtgtttttgtatgtgcaatgtgtgtgcttacatgcatatggaagtgcgcataggtatacctgcacatgcatgcattcacacatacactcagtctgtactgtttatgacgcccctgccagtcagattccagacacatttatatcctctggtttagagtaagctgctacgataatgacaaatagtgtttagagcagtcaaggaaaatgtaggggtgatatttgaaaatagcatctataatgccatctgggtggtgctgatactttggagagcatggaatacacctatctagagggcaagtgctctcaaaacaaagtcagaagaaggtctatatggtagggaaagtcatgactcttggtagataatgatgaactttcactcagggtctgtatttaggtctttgaaggaggaaaatcaatttctagaaatttagctcagttaaagccacagttggtccttagataagctgccagaatagacaccacagctagaaaactgatgggtccctgtctttgaatttttacttgccatatgtttcctttggatagcagcatactcaataagaatgcttaaaaaccagacagtaattctaaggaaggccaaaataaagagcaagtataagtatatccgatcaaatgtcaatgttttaatgttaaattttatttagattgttttgggccattgtattttcttttaaaaagcttaaacacacagtaatttatgcatttcacctgaaggttacatatcgttttacaaatgggatgtgatttcaggcactgttcatcctgtttaagaaatggagaaactgtcagggtatgtgatgtgattctcaaaatatcagtgacatatttgggttgtggagactggtgaaatggagatgtggcaattaccagggtcatttcaacaacagagacagccaaacttgataattcagacaaaaaattatctaccttggccactttcattgagcagatgaactaaaaagttgccaaatctcaacttcctgatgctctgttcaaaccagccttccctgcaacaggaccaggcaagcaggctgactcccagggcaggctctcgttctacttagcttaattaaatgtgccaggcacccgaagtggtggagttacccaagggagtatttgagccccatattgatccaaaggaagggagtactgttgaagtgtgtgtgtgtgtgtgtgtgtgtgtgtgtgtgtgtgtgtgtggtgattgcggggggattctattctgaagtgcccaccatgtttctaaaagagcctcggtcctggcactgaggcactccatcctccacaagctccactcccctgatatgttctttccaataagctcttctgtccttggctttttgcagatgctgccgtgaagaggaagttaataacaggtgttttggaatataactacagaaaagcattaaaaattgttgttgttgttgttgtttagaaagaacatctgtagactcaattatttttcaagattctaatttactgctgtgcaaactacagggcaaattatattatatgtatttagccctactctgttgctatactcctgagaatttaattggcaagcaaatgtcctgtcaaaatgccttctgtggctggaaatctttctagctcttagagattataaggctcaaaattaactagaattcccctaataaaatttcagttcataatttggggcctttgccctttgtattctgtgagaactttttggtaggtatgatgggagagagagagagagagagagagagaatgtgtgtgtgtgtgtgtgtgtgtgtgtgtgtgtgtgtgtgttttgtgcccatgtgcacatgtgcccacaccattatggtaaattgccttggtggattccactcagctgtgtaaaaatctgtaattctggcaggaacaattatatcatgtccataatattgaaatagacctcctaggtttagagaaaagtggtttttcgcagacaaaattgtgttctaagggatgtgctagtaagcattttgatgagcacaagcttatgtgtggaaaatgttcgacccatctctcaacgcctggtggaacactcactagttttaacatttaaagtgctttttaaaaatggcactttaaagaatcatatagggtcctccatctgttctgatatccattccttcatagataagaaaaatatgttcattgttctagaattcattgccatgataaatgacaaaatttccagggaatttatataatgtccaaatgaggaaagccaatccaggaagaatctgcattgaaaatataaccattatttccaaccattatccatgatttcagatgttcaaaaatagaaacaaaattttgaaattattttaatactctacagaatagcactattttcctgaagaaacatttttctagaatcgttgctttagaatgtagttttcagtgcatctttattgggaacacattgtggtacactcacacactcagttttaaccctgaagtgtaatttacttggcacttaaattgattttatttgtggttgtatgtctgtgaattagtctgtaacttactgtgaaatttgccatctctgccgtgatcaacccatgaaatttatcatctgtctctctgatttacacaaaactccatttataatcatcaaacccaatttacaagtgaacagtattaaactaaaattctgaacattgaagcattttgacattgtatttgctgtgcattgaaaaagtaaattacaagtgtgaaccatgtatagatattttgacatttatatttttaggtttcatttgatcttaagtgtgccattattgtgaattcatttgctattactggaaaagtacttaatataatggattcattaggtatccacgtggatgtcacattttttttatatattctactatagttttacttcaattccactctagaattggttgatggattctctcataactatagttcatttctaaacatctaaaactcctaactaaattttctcatacttaaaattgtttaattatatggcttggaaataggaaattttacttggtccttgtcagaaatattgagtaatggcagttccattagaatggcgttcattgttgataactgggaacaatgtggtgcaaatggtgttaaagagacattggtgaggaggaaaagaaaagaaatgccatttccaggtaagtttttctgcatcttttttggtaaatgccaccataccgagccctcatttgttcttgtcttttcttaatgctttatctgttccttcagtgccgcaatcaggcacaggtggttcccttcaccaagtgaatgaatatttagtgctgtcaggagtgtcccatgaaaaagcccttccagatatctccaaactaggctgatttgtcatttctgaacaggggattcctgtgagtcacttctacacttaagcgaaatctaaccagcagaattacctaacactgcagttcaagcccatatgattagtgatgaatcttcctagggcattttaaacaaaagtggcttcatatccaattgtactggaaagggcagacagtctgcatcaaagctttggattgttgagaaacaatagcatacggttatgattttagcttgtttgtacagctacagtgaactgtttgctcgagatacgatttcgggtaaacaagcccctctagactcacttggaaaagcgaacaagttcattgaaactctttgcctattaggctcaggaagaaaattgaggctgaaatctgccagtatttataatagagtatttgattcagttgttttatcttatagtaaaaccagtgagaagagacaaagaatttgagggaccagaacagacaaaagtacatataaaagtatgtttaataaaggcatagtgtcaaggcatttagacctctctatcctaccttcagcatttcctgttacctttaacaatgtggtgattctccactctaatatcaactgcaatcttctaatttcaggaataaattgcatacaaaagttattttcatattacagggcccggaagacaaaggaatgccaagcctggaccaagatattcagattataatttgttttctttttctaaatcctcactaaccatgaaccatttctcccattcatgaactggtaacaggtgtcatgccaaatgattcttttaaaaataatatctgtttcccacgtttcaggtgtgtgcatatcccaggaaaaataattgtctgatttatatggatcccccaaggtacattaaacttggatattaaaacagtaggtttattctaggtgaggcatggatttagaagtttagtttttgtttcagagtttttgagagtaaatctcttgctttagaattactgatgcagtggaacagacagcgtatcaatggttgattctaaggtaatagaatttaatacagctcactgtatggttcacagccttttcctctaccctcttcttgctacctatgctaatccttcccaaatcctatctcctgtccacacttagatttctaactttattttatatttccacctggataccccacacatagtaaaaaacccactaattttattcttaagagtttcacttattagttataattattaatgcaaccttaaataggccagaaaaatagaactccatcttcttttttattgagacaggatcttgctctgttgcccaggctggagtgcaatggcacaatcatggctcagtgcagccttgacgtggacttcctgggctcaaatgatccttgcacctcagcctcccaagtagctgggactacaggtgcatgccaccacaccctgctaatatatatattataaatatatgcctataattatatatatattatatatatatatatttatatatgcctatgattagggtgactgcaagtggttttggaacataatttattttcagaaatttttatgttgggtgaaataggaagtattggaaatcctatatatatatgtgtgtatatatatatttatatatatatgtgtgtatatatatatttatatatatatgtgtgtatatatatatttatatatatgtgtgtatatatatatttatatatatgtgtgtatatatatatttatatatatatgtgtgtatatatatatttatatatatgtgtagatatatatttatatatatgtgtagatatatatttatatatgtgtatatatatatttatatatgtgtatatatttatatatatgtgtatatatatatttatatatatgtgtatatatatatttttatatatatatataaaaattttttttgagacatagtcttgctctgacgtgcaggctggagtgcagtggcacgatctcagctcactgcaacctccacttcccaggttgaaacaattctcctgcttcagcctcccgagtagctgggactacaggtgtgagccaccacacccggctaatttttgtacttttagtagagatggggtttcaccatgttagccaggctggtcttgaactcctgacctcaggcaatccacccgcctcggcctcccaaagtgctaggattacaggtgtgagccaccacacccggcctattatttttattattatttgtagagatgaggatctcactatgttgcccaaggtggactccaactcctgacctcaagcaatcctcccacctcggcctcccaaagtattgagattagaagcaagagctaccgtgcccggcccccatcttcctttataacataatttgtttcacacaggcacccaagttcaaaaccctaccttcaacagccaatccagtactgcctgacaatttaccaatttatgatgcattcctctttggatattttaaatattttaattgtaacatatatcccacttcaattcttattctgatacttctaccttttcttgtataatgtgtattccttgaatagatcatttattatattcatcatggtatccccactccccaacacagtatcatttacacagtgagtatgtcataaatgtttgtgaatcaagtcaactggaatcaaatggaatccaagtatataattgcacaaagtcaaggtgccacagtcaagacctcatagcagaagcagtacacttcttagtggttaacatgggatgtagtgatcaaagagcaaacagaatcttagccaggagaaagtgtattattttccaaaagggcagtgatcacgttgcagttgactctatactgttaagactgtgccacaggagtttcactgaggactgtgtgccacagttaaaggcaccataaactggaatgagttgagaagaatgtgagcagaggacttagctttttcatgtgaagccaagtcagataacttagggaacaacggagttttcatcatatatctgacagtctgttgaatggaagggaagagtaatatggcttgttctatgtgggtataaggaatgaagtccccatcaactgatgaaaacttcatcaaggccagtattggctgagtggtcaataatgtgtgcctcatcttgagttagaggaagtatgagttttctgtcacagaaagtgtgtaaagagaggctagagaagctcttgagaggggatgattcatagaggagtcaagtataagatgaggatcctcatcaactagaggtctacaattaagagatccttctgactgtgcaatcctggggctctatacattcacagaattaggagatccttctaactatgcaatcctggggctctatacatttgggaggagccctccttatcatctcataaaatatttgtgaacttcagttttagttgtacattttgatcctctgtaaatcaactgcacttcttaaacccttaacttatttattctagcttctgatatcactcccttcacttcagtgcaagaatcatttgtgctctccagtaattaactccaaaatcttgtttctcagagccttgcattaaaattgcattttcagaggtgagtgcttctggtagccattctagctacagttcttcctgggaaactatatggacatgatgtctgccatttcggaacctgtccattcggcaagaaaacaagtcattcacctttgcatatggagcaatagaattgtaggccagaggaactgttgatagcttctgtcaagggttctcccaccattgaatccaccagcatcactattgccaaaaagctatctgccgtggtaaactcagctatttaaaactttgagaaagctcacatgtcatacgacattcatggcacacgcttccactactgtaataccttcactttattggagttgtcccagatacatttaagtacctgtgtgattccttttccagatcaagaatgttcaaattaggatcaagagggtgtgttgatgtgatagcccgcaccagaatataaggatgctctttctttgaggcttggaataaaatgaaagagagatcacttgaaatgcttatggcttcctatgcccttatttcagctttactgaccatttgcaaggatgttccatagttcatgaatgcaactcacatttgagtgtagtggggaaaaatcattggccaatttaaaaagtcattgtctgcaaatgttttgactgagttgtgcctaaacagaagattctctttttaggatagatatcattctttcatcctgtctggtgttagagccaagctgcttctttcagtagtctatcgtttcttttgaggacagagattatgtcttgtctttcactatgtagacatagcttatcagagtctcttgtactcatagtaatggctttggacccatttactagattgaatggtttgaatttgttttggaaagttgtgatctgttctagtttttatttcagttttagtttcataacaatagctctgatttgcaaattggaagaatctagactgttagaagactgtcaaaatagaatgtgaatatacagagacaccatctaattctcatttctagggatagtaacatggtaagttctaatgttgccctaaatacatatttttgaggagttgaaatcgttctgcttgctgtatttgtacagagatatcttttattcagttttatctattcgttgtagagactaaaatctgtgtattgtaggcattaacatattaatctttttaagttctccagaatagaatctttttggcactttcatgtttggaaattataactcgtaattaggcatattatcactttatagaaaaataatatatcactatagaactgaaaataatatatatattttttttcctttttttttgtcatttgggggaaggaaggtggtttacattgagtatctcttatttgccaaaaagtgtgggaagtttttttgtatacatcatttcatttaatttttgtgattctttgaagcaggtgttatcatcatcccaattttattaatgttcaaactgagtctccaagggattaaagtatctggcttgaggtcatagaataaaggatttaaactaaaaatctgtccagtttccaaaccaatgtttctttaaactacaataaatccatgcaattgggcttgttgtctgtggcatcgtgctttgtattagtgttttacttttgatccaatgtcatcattagaattttgcaatgcctctcatttattctaagaatagctcatatttaaagaaatgcagaaagaatggccactcaaattttaatggtggtaatgttagaggacagaactgcaaatgattcatcacaaatataaaataagcacatgaaataaaaagaacaaagcatactgttggaattaccctgcagccccctaaatcttttaaatcctactaacttgcaaccacaattgttggcttattcttgttagtactccagtgtttcaattgttgttttttaatgcttgctcactcattgttgcaaaatgttctggtaattggatctttaaaaaatcttcagaatattatagatgagcttgtttgcaaatgtgcacatattagagtctgaactgtgcactttaaccattctagagatattgaaaacatgctagaaagttatgtcatggaataaaaaggagctaaatcaaagatttaagctgcctcctgtcactccattagagacaactactcacatgtaccattgtggtctaagtgaaaggtaaatcttacaagtaatggctttattctcatattctttgatcagctgaactcagttggagctatataagcaacaaaaaaatccccagcaggttaaatctttgcctttcttctaatctaaatgaaaatattacagtcactagaaatatggtaatatggtgcaaaatggatcacttcaggtcaagatttcatgggtcaacttgtttgtttaaatgtagtcccagatactcgagcgactgaggcaggagaatcacttgaacctgggaggcggaggttgcagtgagccaagatcgcgccaccgcactccagcctgggtgatagagtgagactccgtctcaaaaacaaaacaaaacaaaacaaaattagacaaatgctacattaatgtttgggtggtaagattctattttgaagtctgaagtttgcagatatgcctatagatttttggagtttaccactttcttagtctgtatcactaatgaaatattttaaattactatatattttaccgtttttctgtatttagtaagaaatttgcatttttgatttgatgtaacaaaggttttaatgtaatttatgttagattttgcatttttttcgttaccattgtactttaacctgacggaatgactgatctctttgtattagtattgtgaataatcatgtgaaatgttttgagacagagtattatatttgtgaatataattttatggctttttcacttagtaagaacctttctattattgtggaaaactaagaaaattgctttctgctgtacaatctggcattcattgtagattaaagcttatttttctgtgaataaaacttattcaataaaatactaaaaaaatttttttaggctaatcaaattttggattgactgccttgccaaatgtgccattaattaaatgcctccctgaccacttttaacttgaatgggaaaagataggattagaatgactatttttaaggatgtctcttacacatccttggcacctggaacagtcgttggcacacaataaatgtcaatgtattgaatgtataaattagtgtgtttaatgtgagtgctcaccaagggaaaaacacaatatgttatttgtcacctctgcaaaattataatcgtacctatctcatagagttacagtataaggataaaattatataatcatgttaaatcctttgagtagtgtatgatacattgtaatcactcagtaaatattacggtgtaaagtacatagtagaggatttgctttttacaatgactttgctgtttgaattgtgagatacacacatacacacactcgcaggcaagtgcacacacatagtgtggcacggtagaaagggtagcatactagtggtcaggagaactggattgaatgcttattccaaagtttgcatgttctctgaagtcaggaaggcattattacttatctcgcttcaattgtctgtcctgtaaaatgggaattgtaatacttgaactgctggaaggcagggttttaagataaactctctttagagggcttttcaaaggtacttaatggccctgagtcaatgataaacctagtataaattgagaaagcctaaaataagaataggttcatgacctataaatacttaatctaaaaatcatcacttaatgatgatgatcacagaacctagaatagtcatgggctatttaaactggaaaaatcccttactcaacagattcggaaatggagaccctgttaaataaagtaaattgcccaaagccagacacaatttctaagaggaagattccaattagaaattacgcattcaactagtgatgaaattgatcaggttgttctcattgcataactgacttggattaaaaaatggcacaacagaactgaagacaaataaggctcttaaaatatatgcagtgataaaatggatctctttcaaaatggatgattctctgcacccttcctctctgcctccctacatagcagtttccatccatcacataggcaatatagacttgagagcaatacttataatttttctaggcttctgctccatctttctgcttagacaaatggaaacatttaaattcttatgattttataaataacatagcattacatatttattcttgtggcaaaacatatatgacatcaaatttaccattttaaccatttttagtgtacaattcagtggcattaagtatgtttgcaatattgtgtaactgtcatcattatctatttccaaaattttacttttttgtcacctgaaacaaaaagtctaatataaaacacattgagaaataaaatatatgttgatttttggaaaatttgttagagtagtgcattaacctcatgtagataatttgcacaatgggtttatgtttctttttctgttaaattcagtttaaaccatgatttatttgccctaggtatatgtcatagcccttggaggcaaatttcacatatttttgagcctgtgaaatagtaccagtttcataggttgggccaaggtcagttgactggatgaactgtaagaattatctatcttaaaaataacggctggactgggctcattttaatactcttactgatcaccattttcatatattgtttaattatttagaaacctttttctgtaatgaattatacctgattaaattatttgcattaccatgtgtttaaatgtgccaaccatagtcaaatattatcattaaaatgcttaatttgccaagtatagagtcaagagcaactcagtaaataaaggatgaagaaattttctctatgtagaatagtttttcctttgcttgaatatatcatagttaaaaatttttctaatggagaacaaaggctagaatccaattcagctctggaaaaaaaatcattttgtaaaatggataaactgccatttttcttacccagtgattcatcatgtatttctaaattctgataagaattgttacaagtcttttctctagcattattagaaaatctacattattatgtatgacagaccatgtcaaaataattgtgtgtgggactagtctaggttaaggggaatcgtatttgatgttactaattttcacattatttcacctataaaaattcttctagcagcaaaagttttattgcactgtatttcagagtctctaatttattcatgggataaatgtttcatataatgaattttcaagtaaatgtattctgaaattcatgcataaccatgcctgctctaaaactataaaaatttggttaaaattgaggcatctcctcattccccttggaaagtatattggggaacctggaagattttatgctaatgaaggcaatatggttcagcttttctttttatccaatatatttcttttattgagttcaaaccattgtcctaattaataactttaaatggaagcacttcatcaattgtattgaggcactaatactgcttaaaaggtagtatgtgctaggcccatcctgtgtcattcaacacatgccttgtgatagagaaatatgttctacattttcttctgaatattttgtgtggtttaagagccctctgccatatgatcttgtatctgcctttcttccctcactcactccctgcttcatctcctcctttggatttttgtagtggtggtggtggttgctcatctcgatgctgtgctacagtctgtgggcattggtaaggagcatctctctggtgtgatccacacacaataaacagacatgaatacaagtaatggtttaaagcatgcagtcacatctgcctccatcttcacatggaagggtggtctgaggttattctggcaggattttattctactatttgttcaatttgccaatgtaagagataaacataggatttggaagtatagaatctatgtttatcctcaataccaagaattcttgtgccttgggaatgttgccgtatgccaaacccaaggtattatatttaaagattaagttcctgaaaaaccctcattttcaaagaataacattatattgcatttgtaaagttgtaaagtagaatttcatatataaaaaaatctgtattcactcccctcaagacagcgaagaaggtcacttttcctagggaaaagaacaacacaaattttaaaagatcacacagtgtgtgtttctttgcctagacagcctctttggtttggaatccttccctgaaagatgggcagtgatcagactgggcaacccctccctcaattaaaaataaagaaaaaacagtctattatgtgtagtttttaatgagtataaaactcaatatgcaatgaattcaatatacaatgaaatgtcagaaatacaatatataatgaaatgtttcatttgaagagagaggctgttgtgcatttatactcattcattcattcacgcattcagcgacatttattgtgtacctactatggactggtcacttttctaggttctagggacataataatgaataaaacaagtcaggactctgccgtcttcaaacttgcatccttggagcggtggcagatggatatcagagaataatgaaaataagtgtgtaaaatataaaatatgtaggatgatgacaagtgctattaaaaacatgaaatcagggagggtgttagagaatggctcaggggctcaatttctaagagtggttaggagaggcctaacggatgtgacatttgaacaaagacttgaaggaggtgaggaagcaagccatggactatgtgtgggaagagccttccaaacaaggggaacagcaagtgcaaaggatgtctgaaaaatataaagaggccatagaggctggagcagagtactcaaaggggagaatggcagcagatgagacagggaggggaaggttgtttccattttgggtaggtagagaacaggtcttggagcagcatcttgcagaccatttataagggccatggattttactctaagtgagatgagagccgttgaagggttttgagcagcacgagtgaggcacctttgcatggcactttggtggttatagaaatgcatcaaattttgtcatttctcttgatgtgatatagtaaacttcgataatgggattttataaaactcatgtctcttagggctagcaccttcagtgttgggggaggttggtcttgcagtgaagaatgcacaatgtgccctgattaaataattagcaataaattttacagaaaataccttcagcataggatttccagtacttcctatttcacccaacatacaaaatttctgaaaaataaattatgttccaaaaccacttgcagtcagcctaattataggcatctctatctcttctatccattggcaggaataaacttgaaaaggctgcccacttattgagtcttgagtccaaaaatcaatgtgaggtagtcagttctcaaataaaagagattgggaagaaagcaggaagaggattgaaaaattggcctcctcagaaatgcacgaaggggacatttgcagtcttaaggggcatatttcctagtagcatgtcttgtaggggccctactgaggtaaatgagttaatcttagtctgtttaagaagttccattataatggttctttcagggtatgaaaatgcaaagaagtgaatctttcaatgaccagatgcatagaagcatgttttaaatgactgcaatgtaattgatatatgctgccatcagttgtgacccaggtaatagtgcagctaaaataatttcaagtgggtcaagatatccctggagtacttcctgcagtgttataaaaaatctcccagcaatgtatcttaagttctgtaaatcatgttaaacttaatgaaaccttctgcaagagcattccatttctatgatgcatttaactgcagttgttgacatgttgtatcttaattgaagaaatatgtaaacttttgattaattgcttgtggtaccaggaatataaaatatactgaccacttttttaaagtaagatttagggtatgtgtctttatgtataattgattactccctaattaattaaaatatgctcctttagactttgttttccatctcagactaatatttgcattcctatgttgtggatttagtttatgatgcttatttttttaagatagaaaactctgaaactcaaggctgacctgcagtatgttcatcatgtttattcttactgctttggcacagttgagtttgataataataatgctagcttagttcagtcagattcagtgcccttggagtacctactctgtgcagtactgtgttttgtggaagtcgtgcagtgtcttcaattgaacaagtatataccatggctacaacacaaaaaatttactgagaaccaaaattttatgccaatggcctgtcgatagtctccttcctcctaagatgtcgcctccagaatgtcaggagcttcctctgtctcattcacttctgtatccctagccagattgacacatcaaattaaccatcatagtgctggacacagagtaaatgcttactgcatatttgttgaaagagtgaataaatgtgagaacaaacatttgctatatacctactgtgtgcaggggtctaggccaagtaggtcacagtccctcctattgagtagtttagtcttgatgatgtgggaaatgaggctgaagacagaaatcagagaaacaaaaataaaataaagggaagaggagagtgaaagttcaaaaatgagttgatggtgtctgccaggaaaaaccaggaatgccgtcactgcagaggtggggttcaaggaagcatcccaggaccttgaacagcagaccttgaacaccaggatgaagcgtagtctggctgggagaatgacgttgatagaagcgctaacaagggaaaggacacattatgtttgcagagcagcaagtgatctgagtttcttatcaagcaatttataaaaatgtaggcatgttccttatcaagcaattagtaagcatgttcttctagcacctttaatgtcactagatttagtttctggttaggtgtacaagcaaaggggaagaagttcagcaagtaatacatcaagaaagccccagatcagcacatatatgtacaccattccactcccactagtgtgtgctcgctggcacacacagacatacacacacacatgcgtgcatgctccggatgattccaagcatagctctctcctgttgctgccagacttgacctcttctaatgatggggagcagaccacagagaagtctcttgcacatatcccaatatgaggatgataggggccatttgaacacatatgtccaaagagaaaccatgaggttttaattgtggtcaaaagcattctacttatagacttgaatccagatggatgaattcactgctcaacagcataggtatgaatttgtttaatcaacttcgtaagaaccaagtcaagttcagatacacttactttgcagtctaattttctaggggtcccaaagttttaatacaatcatcttctctgatttcccacaggaaatgatgatcccatacatttaaaatgttttaattactcaaggaatacaggaatacatgattaaacacaaacactacagataagcctcaagtgcccttttgcttctgtctgaaattcttgtcccttctcctgcttttgtaggtaaaaactgctatgaatttgatgccttcaaagcatcatttctctctctctctctgtgtgtgtgtgtattcacaaccacattatatatattattttgcataggtgcattttacataaatggttatatatacatatatatgtgtatgtgtctgtgtgtacatatatagtaagtgttgctgttttcagctaactatatgtcatagtaatctactggctttaactcaatcctttgaccagctgtcccaaattctaggctattaaatatgataatgcactgtttattgtgccatccccttgttggaggacactggagttgtttccagttttttggctgttggaaacagtgctacacttaacacatttctatactatactcctagtgcccccagggaagaatcaaaagagagaacgttggaccctacaacttaattttaaacaaatgtcttctgatagaagaatctatgccagtgtaagatgagcttccttatttccttaacttcttatttcaggtgatatgaatgaccttggttgggggagtgtttctagattagtcattattggtcctacatatattttcccatgacatacagggtggcaggccattttctctctgagtttactatggatggctctgctacagtgtcttgttttaattactcaaggaattacaactcaaggtgttgaaactgcatatcagaggggatttctaaatgcagggagcccctctctcagttgccttatctatatatactcttacataggaatagtgacttactacttgctctccccactcaccacagatgccttttgtggcctctgtcttccttctttttctcacaaatagttcttggacacctttatgtgccacacactattgtagacactggggatccatcaaggaatacagcaaactaaattcttgcccatgtggaggttatattttagagggaggagacagataataaatgataagcacaataaggaaagtatagtatgttcaagcatgctaagtgctagaggaaaaaaaggaaaacagtctggcaattctgcaaaaagttaaagataaagatatcatataactcaacagttgcacttctaggtatacatttaagagaactgaaaccatacgtccacacagaaaaatggcacgcagatgttcataatagcattattcataatagccccaaagtggaaacatctcaaatctccatcaatggacaaacgaatacacaaaatatggtctatccatacagtggaatattattcagccatgtaaatgaatgaagtacgaatacataccacaacatagatgaaccataacaacattaggctaactgaaagaggtttgaaacaaaacgtcacatatattatttcattaatatgaaacattcagaaataggcaagtccctagagacagaaagcagcttatcagttaccagaggatggggaacacagagtaactgcttaatatgtagagtctctccttttcgggtgatgaaaatgtttaagaatcagacagtggtgatgttcacttaacattgtgagtgtacttaatgccactgaattacacacttaaaaatggttggtgtttaattttatgtcttgtagttttacctacatttaaaaaaatggagcaggtcaaggaggacctggattgcagaattggagtgcaattttgaagggtatcactgaacaggtgccatctgagctgcaaacataccaggtagcgggggcagccattcaaagggtcataagaaggggcattgcctggtgtgttcagagaacaggaaggaggcaatgtgcctggatgtgagtaaaggaagggcaataggaacagaggcagccttggtcttcctcattcacctgctgttttagacaccactggctgcaattgcccacagttagttacctgcccaaagttgcagtgatgatggtactggcagtggtgaggaaaagaagggaaaaggcagaaaaatcactccagatacttcccaaggcccagaatttgatcatacattatttcttttgactatgagtttcctttacatgatatttccccttagttttttttttttttaacatagaatgcatctttcagtaacactttatctcatataaaggagtgtggacttaccttttgtaacatcagtgaagaaaggttaaggttcccaacaatttaaagggatattatttcagtgaatctctatgtgagaataaattaaataaaacagacatgcaaaagaaaaagtgaattcatttagagagagatcatgtccctctgttctcagatgcttttgaagaaaacataatcatggataatcatccactgttgcattctcaggtctcctctgaccccacaaaatgagcatagggtcatcatttccttttcagaaacacttataaataattgagcgaggcaatgatgtgaactgggaagggcaatggacctaggactagaagcgtggatttggggcccaacacttgtatttataatttgtacaaccttgggcaagacacctaacctcagagctgcaggttctttatcttcaagttcgaaatgatatcatccctacctatctaactgggtcgccgtgaagttcatatgaatcaaaggtatataactgctttgaaaagtacaatttcataaatagaaagtactactattagtcttcaaacataaaagcggttatcaagaaaacctaaaacctctctccttctatgtgtgtttgcatatttataatttttttttattttatgatagtacacatgtggagtctctgagccccttgagaaaagggaaacctgttttattcatctctgtatccctggcactgagcagtgttctatacacacagtaggagcatagttagttaggctaggttgagtgaatggataaataaaccaactgtattttgaattattctcatgaggtaatggtttacagtgtcccacgatttaccatgcacactgtttgatagtttgagtattcaggtgtctaagaatggatggaggaagctaacaaaacagagtttaaattgagatgatgtcataattagcttatttattgtgacctagaataaagaacatggtgattccacaacagttttggggcagtctgggatattaaggtgagttttggttgtggcaacccagaggaaggttgcagtggcccatctatctatcccagatgtaagatatgcttcacccctctttcttgatccatgaagttcaaaaggaggcaccaagcatttccgtccttcttcaagatgaaggtaggcaatatgagttggctgtagaaggtctacaatcagccaaaggcttaacaagtagcttttctctctctttacaaatgagtcctgatcacagtgaggtatttcctttggcttaaagctatccaaagcactgatttaaatacagttccttagaggtaaaattgtatggatttccttctcactaagtaaggaaactgagacaaacaccagttaaaggcctcagggtagtcagaatgcttcactgactgtcccttttggaactaaggacaaccagagcataatggattggatctgagattctcacatcagaaagtgaacagaagaaaactgaatgtcattctgagacttcagtaaaggataatgtccattttctcatccaccaaatagggataattatctctaacttactaagtggtcgtggggatcaaaacaaacaacgataacaaaacagcctatttgtctgctatttaagtgctcacatgttccagaatggatggtgcaggccaacaacatggggctgagtttgaagtcagaattagcttctttattatcagctagatttgttgctttctaaccagcaacaatgacaacaaaacttagcatatggaggggcccagcagagctcctggcatgtagtaggtgctcactgaatgttaagaaatacagacctataatgagggatgcttggcaatgggtatgtagaatgctaaagataaccactcactttgcccatttacatcagttagaccattgccaccatttgcactcccagcctcttccattcccccaactctactctatttccctctgtgttctcttgtgtctttctctaatttttttcaactctcactttttttcctcccctactttttgcttggttcctcagtgagatctatgagcataatatactccaactacagtaattcaccttgctgaagtggctgctgagttctgctttgaaggaaatttacttatttaattttggtggggggaagttgtggctggaccacttatagaaatgtaggtctagttttctgggaatgtttaaagaaaccatgcgcaaatgtacattgtcttcctccctctctccttccttcccttcctttcttcctttcttctttcctcattcccatcctccccctttcttccttccttccttcaatcaatcatatatccatattcatatatagatatatatatttaatcttttacctataactcttgtcaattctatcttcatttttcccctttgggcttatgagtatttatagttggtgctccataaatgtttattatgagtaacaatgataatagtgatagaaagagcaacacatgtgctattcctcagtgctttttatctcatgtacaaaattaaacactaatgttgccatcagttactcccaaaaagatggtggaagcatatttgttagtaatattttgataataactatataaacagatatttgtcatgctattctgactcctacatcttcattcacagaagaacattttatttacattgtcaagtaagagggtggcaatttaagtgacacttgcaatttatcacttgctttgctttccaaggcaagtcctaggagttgcatttttgaaatgggtctagaatcattcttttctaagtgttttcaaatatactcagaaggataaaacagatctctatatccatatctcatatttctatggagggttcatagagatatttgtcctccatagagatatgagatatagatattacctgaacttgcaccctggaatattttccttgtctcaggtagtttagttgattgaaagcctccagggtttataacatgtctgtctaactgcctcttgacattataggcttaaagtctatgtgtaaagaatccacttggtggagggcaactttcttttgggtgtgtattttacaatcaaagtgagatattccaaaatgcaaaggaaaatatatgcacagaaagaaacatgacactgaacaaaattggacaggcctgacaaaaaataggtgtggataaatgaaaacttgaacctggcagtgaagagcacatgatttggagtgggccaacactggctctaccatttatttgctttggaacactggggaaagtccttctctggtcctcagtttcctcacatgtgaaatggggataataatcgtctctacctcatagtgtcattgtgagtcacaaatgaaacaaatgcattgaaaatcattgtgcggataacatgaaataatatttatctagtgcttagcagatagaacattggataaataggggcagttatcactattatcctatcagacaggttgtctgtgtcagcccttcgttaggatggcatcatctgcctaggaccaacagtggagggcagtgtagaggcatgattttatttgactatttcaattagtaagtgtatcaggttgctagtgctgctgtaacattgtactacaaaccaggtggcttaaataacaaacatttattgtctcatagttctggagactagaagactgcggtgatggcagggccatggtccatttgaagcccctaggggaagatacttccttacattttccagattttggtagccccgggcgttgccgtagcacttcagtgtctgtcaccattgtcacatgatattcttctctgcatgggtgtgtgtcgatgcccaaatttccctcttctcataaggacatcagtcatattggatttagagtgcaccctactctagtaactgttcatcttaacctcacaaattaatctgcagtggccctgttcaaaaataaggtcatatacacaggtaccagaggttaggatttcaacacatcttttgagggtgggaacgcagttcaactcataacagcaagtgtctgttaaggtcttatagtatactaggtgctgatcttgatatggaaggactggtcagaagggcagaggaaagagggctttaaatgagggaaattgtgtgagttctggttcaggaacaacaacaacaacaacaaaaacccacaagattttgttcagcaagtaacactgtgttgtcagagtatggatttcccagtgagcatggtgggtagagttgctgagaagacaggctaagtgacacgtatccacgccttctgatatttggggttgcactggctctttttttgtcttattccccctcttaaagaatggcccttccctccactcaggctcgcaagaactcgaccagcgagaccttgtaatttcctacctcttctcatcttcatgtgagatgtcctctttcatcaatcactgtaggctgtcaagctggcctgtgcctgcatcattactgcttggaacatggcaatgacttctttctaacttgtttttctgtttccagtcccttctccctagttcgtcctccatactattgcatatctgaacatgtcaacactctgctaaaaactccatcaatgattgtccaacactaacatgatgaaattcaaactccttagtttagcataaatgcctaatatgcctactccctcaattcttagccatcctgcagtgccattacaatgaactaccactgtagcatctcaactgccccaatgtgtgtcatgcctcactacctttgtataccccagtcctctgggcaatgttctcttcctttctctccctttaccatcttgctagctctttctcaagtcttcaccactcaagtattaccttctccaggaagccctccttgatctagtgtctagtctgagataggttctcatttttctcatgcttcatgagtatagggctgtggtcagtcctctaccttgtcatatagcacagtgtaccacagtccctaattaccgtggttttccactccaccacacaatgagaagtgtggcttgcaaaggcctatggctcatgtctctctgtagcccccatgctgagtgctgggcctagcccagggcagaaggccaatttaaatgttcatgggctggacagtagaaaggtagcaggctagccaacctcatggcctgggagttacctctgagatgattgattccctaacgtcctctggcaaaaatgtagatcaaaatatctcttctaccacatacaaacactttgataagggagaaatttaatgcaactgagagatacggagacaaactttctaattatacagctcacgggcctggcatttggcagggatcatgtgaagcattcacttttctccattttaagtcaccatttcccaaagttgaattattgagagcacattaggcagaagatgaggagtgagaataaaaaaaaaaataacttcagtagacaatcaccttgtaaacatcttgagatgaggctggctattaaacaggaacgttcggtaccaactgaagctcaggtgagtttagccaagcaaatcaatgcaagttaatcttccagtgtcagctggctgagttttggactagtgatgaatgccttgactggaaagatgaaatgctggaatgccagccagtgttctgacagctacagatggtgccaattactgccagtggagcctgtcctgctgtgagcccaagatgtctgatttgtggccacaggaaaatgaaaaagaggccttccagctgggcctgtcacctgtccttctgtcctttattgttctgtaaccaaaattgtattcaggtttgaaaacctttttttttctttttttcttttttctttttttttttttttggtgatgatggtgggggcattggacatggggcggaaacaggaacaatgttactcatgttaatcatacagccatgctcattgccaagcgtatgcctgaggaggtgaagcaagtcactaccaaggttggccacttcttcccatcccgttcctagcaaacaaaagactgtcaattaacctgaaacatggagaaaagcaaatgaaaatagccccaaggctcatgatggccatgggattttgtacacataagcatgatctattgtatcttttgaggaggatgtttctgctaggaagattgctgtgcctctctcctatggcagacctcagaactgggttctccttgtgtttaggccatggtaacaaatgaactcaggtacatgtttggagtctaacacccaatggccctctactgtgctcatcctttgagagagtaggctgcactcaaactttagaggtatccaacaatgataccttggcataaattgcataaattgcatcctcattataagagtaacaatataaaaaataataaaatcaacaacaatatctgcagtcacattcatttattgagaacttatgatgaataaaatattagaccaggtcttttacctactttgcccttaatcattttaacaaaattgcctgagagatattactatcccattttacaaatgaaggcactgagtaacagagaggttgaatggcttgcccaaggccacagaattactgagtaatgccacctagatttgaacacaattctccaaatcttacaagggagtacaaccaagaagtgaaaagaatactattactttcatgtcatatagttagagtaaggtgttcaatttatgttgcaatgagcataaaggagctaacgctaagcgctttagtagtagtggaatagcaatagggaggacagaagcaacagcggagttagtaattaatacatcatttagacttttactattattactgttagccaagttttgcttccagtaggtcaccactgaatattatggttctggtcctagataatggatagataatactaggcacacgggtagttttttttgtgaagcaggcaagcatatagggtcagctggtacccagtttgagtcaagaagagacatcagcctagtctagttgtcaagccatagggtggcatttgactcttacagcacacctaaagaaagccactctagccatatccatcaataattccatcagtccttggagaacccttcggaggcagtgtgaggaatggaaaagtcagtcccaaaagccctacccccacagggaccctgtgagcagtgtcactcctgcatggcctaatcttctgctccacatcaactgaactctcttaacctggatgttgtcctgcatccagtgtgatttcctgggaggtggagtgggttctgggatcctcttaccaggatttggtctggaagatcaggtactctaataaaagaccatttcctcctttaataaaacatggagcacaaacaggctccagtgccctctgagaaaatcccaagacaacacagtttcttaaaaggcacttcctccaactttgtgggcaagcagagattagagtttgggtcctaagaaaacttagcttactaagatatggctggtgcctctagaacacttttacttctctgacataatgtccgtctttgataaactttcagtgcatttctcccttttcctgttctcttactcaacacaaatcgtcattgactgcacttcgacatttctttctgtctttgtcgagacatctgtgatctctaattgattttttctccaaaagacaattgattataaaaacttaagtgactcaaaattattttacttgtaatactttaaattattatggatagtatatcttggccactttagtttgcagtcctggcttttcaagatggccaagagtttcttgaagaactagcaacaaatcagaatgattttttagttttaaaagaactttatatttttaaaaaatagagtgttgaagggctataggccagttttcctcagtaatttccatgtggcgattgtttaggggttttccaagaccacccagtattcattgacttgctagaaggacttgtggaacttaacatgcagtcaaactcaagactgagagacacaacaagaataaatattacagcaagatcaataaaggaaaagacacatcaagaagagtcttgaggaatccatgtgcaggcttcctatgctctatccctgccatgaggggccgcacagcaagctctcaccatagcaacaaaaatgcagccacatacgtgcaatatttctttccaggaaaatccatttgagacttagcgtccaaggtttttactggggtctggtcacacaggcccactctgcctagcaactaccaaaatttcagattcccagagggaaaaccaatttagggccccaggtgggcaaaacagtcttgtcacggaggggaaatttcttatcggtatagggaactgtttaccagtcaagtgcccagacttcagccgaagaccaaccttataaaaaagcctttctaaggagagcagtctcaggcctgccactttaaactctgttctgcacataccatccttttgtcccttggccaaggtatctttatagcaaaatcactatcagtatgaccccatttggcagggtgagactaacctgcagtattgatctcagtcgtgtcttttaggggtcatggatttagccagttaaaacaaatcccaccaatcacaaaggtctgtgttaaaaagccaggtggcttccttcttaagtttttgtatgaaccattttgatctggcctggggtattgatttaggtgtagcacagctctggcagtgtgttggcagttgacccaaaaaccttgcaagcctgaagtggtatccagatagccagggcacacacaagaaacacaatcccccagggcacacatggtccccatgcagacacacaacttaacaattgttagggcatcctgggcagtacagattaacagagcccccagtgtggcctcccacccaaaaaagatgtggcaggcatcctttttcttgtgctttctgaaaggcggaagcaatgctttatagtcagatttaaatgtttatttatttatttcaaattaataatgacctataatcattggctttatttaagcataataaaatggaaatctgctttttttgttttagaattatctgactggaataacctaactgctaaaagcttctaaattaagatggacaaattttttttttcattttattaaatatgtcctataggaattgagctattttgctctcaacttcaaacacaaatatttatcaaattttaagattcatttaacaatcgaattataccagcagacaaatagccttataaaatgaccctcagcatctgggaagcatgtcacagttgtgcatgttgtatttccaccatatcactttgcagaattgatagtttctgctccaaatgactatgaatgctaaattgcactctcttaaatgggaaattggcttatacattagaacttttggaaataaagataaatggagagagtgaaaaggaggtcaatgatgatacagtgctttacactttgcaaaacactgtctcatagattctcacaattgtcctctgaggttggcattctcattgccactttaaaagtgaaaaaaaaaatgagtttggaacacgttgaaaatcactctaaataaacgagtagcaatgtatagaattaaagatagatattctgactcccaactctaccttttgagctactattaataccacaaggctagctagcttttaagccttcagcctctcatcttgcttcagcatggaaattgtacagcactagagtaagcctagctgacaatttgctagtgttctttatagccttatagtgtctcaaggctgatgtttctgttgcagatgttcctcacttctttgattcaagatcaagagagttccgataaaaagatactgtattttgtatgttttctgtaattgatggtgttgatgtctttggtgttaatacatgagtgcttttgaagagccattagaacagggaaaaagttgcaagacacaaatctcaacttaacactattccgagacactaactagttaatcaattgactgtacataactagctgagcttgggcgtggcatgcaattctcactccaaaaagagctgctgccacagcgtcatcgggtttactgtccattttcctttgttgtaggctgtttcacagcaaatctttagccttagccttccctgggactggcttcttgttaaagaaatctctgctgtctactgaactcattttcatttcctgccagcaagaagagaggggataaaactggtgcaatccataggccataggccccaagtggacagttttctgtagagctgaagcagacgatgggtgggtttatgtaacattaaacccaggtgggtacttacccactttgccttggtgcaacatgttttggacttggcacaaattagtgtgtttgtctttcattctacttggctactagccagcaaggatactctattttcattttgaaatttcacctggcagatccttaaaagtcaccagaggacttttcctgagtaataaaaagcaacttttattgaaaactaattattttttccgatgaatatgccagctgtttaaaaatgctgcagtcatgttaaagcacattttaatagtgtacttgcaaatgcagatccaggcgtgaaatgctttttgacagtaacttgtaagcaccttattccaatatacctctatgcctagttacatgcaggtctggaaatctgataaatgccaaaaaatatccactaggtgagtaaatcagttatttgaaaatgggcacatattataaagttcactatataactaacaggttccccctgcttaggaatgaagactgacagaagaaatgcataccattattcatcgagcaattttaagcttttagaagggagtaggattgaattacttgggaaggttgcggttattctgggtatacttgggtttgtgtgtcactctgcatctttgcctgtgtctacacacgtagttgtgtattccctgtgttctgggctccacactaaccactgagatatgtatgaaacactaaaatgaattaaacattgtctttgcctgccaggaatttacagcttcatggggtgaatcagaagagagacaagaacagaaatgtaaacaagacagaattatgcacgtgtgaaatagaggcttaagggatatcttggacttacacaaagcctggtgtacattctgacttaagggaccaaagaagagcgtgataatagaggtcccatttgagctaggtcttcaaggatgaaaatggcaatgattagtggaatgtagagaaaggacatttttcattcattgaaggaataataacaaagacaccaaagaataaaggggcatggtcgggaagggagaagagcaaaggagatgaggctggatggagcagatgacagaaagtctcaatgtgacactacagacgttattttcttttctgtttagatttgtgagagggagaatggatttgctctctgttgagtctaggcctgtgaaaagggaactggcatacccaggctttcattctggtggtgagtagaaaatgaattggagagacagggaatagacaagactagagacagggaaacagaccagttaggagctataacaatagttcagggaagggacgacaagggtttgaaaggggcattaaaacaattatccagtgaatttaatcaatgcagagagtgatctcgctaattcggggagttgggaaggaggcactttactctcaattgcttgttttttattggcttgacttggccagataattgtctcaactttccactttgctatgcctatgtcaccgccactgtatagtttggacaaattgcttagtatctctaggtttcattttcaccagctgtaaaatagtgatgataattcttgctaccaatggtaattacctcataggaatgttctacgcatttgtgtgagtggtagcatatctgtggcatgcaataatcattaataagatttctaatacttctactaatgtgcttgaagatcttctgaaaagtcaacacacccaaatactaaaacacttgaagtgataaaagggtgactccatttgattaagcaataatccctgatggcctctctttaatttgcaaatcctctctgatttaattcaaaaattttattttataacataaatgtaatatccaaagttgtcttaagaacctttctaggatttttgcagcagattggaggctgctttccaccagctccaaagccgttccaaacaccaaagatttcctagatgatgagtttgcctgtctgtctgcaggtaacagttgaagtccagaggtgttttagagtttagcagtgtcctttattgatgacctaaggacccagtgacagaaataagttttgttatttttctaaatcatgatgaaaactttaagaaaaaaaatgcctttgttgactgacctcagattattgtagagtgttaagaaaattaggggaagatttagatgacatttcctttcaggaagtcagcctactcctcccccaacatctactccacaaaacaaaactgcacattcatgagatgcacatgcattgacatgatccgaactatgtttttcagaacatctgggcttggttggccagtattagccatacttacaaaacaaaacacccaaagccaatgttgcatgtcagttctactactaacaagcaaacaagtgaaaccattcctggggcttaaaactagttcaccaggaaattcaggcaagtgagaattgagctccccattgccagtgcagctttctgatggtggtgtggtctcaggaagccaagctgtggaagacagaagctccatttcagctattaacagcctagatgttgaagcatgttattccaggatgaggtgtttggcagccaggaagattgtgtacataaatctgggcaagactttaaaggcctctgtctcagatcagctctttctgacaagtcatttcagtgagaccatttcaaggtatggcatccagttccttgagtgacctaaatctccccgatgctgctctacccccaaaaagatcccaaagaattcatttctatctatgcctagccaagtgtcttagaccaatttatagagacgagttctgctgcacgtgtccacacctcagagtttagcagtagcaagccaggctgtatgtatcttttcccagctggtcttggcaaagcaccagtcccaaaggacctaaactgaagtggcaacgtttgatttatctaaatgagttgctttcataggaatgggaagattttctctgtgagtgtgtggggctggccctcacttgatatctgactacaggttcactttttatactccatccccaagcatctgggaaattgcattttccttcaaagtgcaacccctaccttttctcagaaataacagaagaaaggaagcatttcggacaaagcacttactttagaacaaggtagaaaactctaaaattttagaaggaagagtttaaaaaccactggatacagagtcaaaaggctcattgttcaagagaaaattctgccattttaagcacagcaaaagaaactaccctcagagtgaacaggcaacctacaacatgggagaaaattttcgccacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacatatgtttactgcggcattattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaaccatcattctcagtaaactatcgcaagaacaaaaaaaccaaacaccgcatattctcactcataggtgggaattgaacaatgagatcacatggtcacaggaaggggaatatcacactctggggactgtggtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaaaaaagaaagaaatacaagcagatgaaaaaaaaaaaaaactactgtgattttggggtaagtcacttcagtattctgatcttgtttagcttcttatgtatagaatgggagtacctagtacctgcttcaccagcctctcagcattgcttagagggccagaggaggtgatccatgcactcattctttgaaaaatataaaggattgcttatttggaagtttctttttgggatgtggtatgctttatgagcaaaaggcccataattgtccagattaactacctgtcactagaggcagaaataattcaataactcagcagccaactctcttattcaaacaacactgaatgacatgtttgtggcttccttttccttgtatataaatagcaccagcttcaaaatgatttgatctttggtcaagaggttattactgactctgatttagagatacaattaacttcccatcaataactgtgttcaacctaaaataattataataataaatattattttattggcaagatttttgtctggaggtagggttcactgttttacccttgtaagtgagctgctgagaatgaagtaataaaaattagttattttgactactcatgcaacattgtctgcctgcttggcgttatgtgttaagaacatttaattaaggatgggtgaaattgtcattcatttatttattaaaatatttgtgacacaacacccacatctccagtactgtcatcttaggtactaagtactgtaggatttttctgccctcacacattgtatccctttaaatctagtatacttttccttcttttgtgcattcattcattcattcatcctttcattcattcatctccttaataaatattggaatgaaccctttttctgtctgagaaactgtgttagtgctctggaagttggaactccgtaggcttgcctatgataagacacctgacacaaaggagacaataaagtaatttttatgaaaaataaaaaattgaaatattactgatgagcaaaaatacatattttatccaagcaaaagccatactttctgaaactccacgatttgtgtttttgtgcttgtacgttttactttttttcctttacagtgctgccactgagttaacatatcaatagatgcacaacccaccagtggatataattaatgcttggaaattgtggctttcagaaagtcccaccaagcacaggaaaatgtcttaatttgacagtgggcctgaccaaatgctagtttgtttggaaagacaaaactagccagttatgcagtgtatggtctataatctgacagaaggagaccaaaacctacctagctatttccatccagtggccttggttccaacaatagtgccatttacagcaagactattaaatatccttgcatggcatcaccttatataaacatagtggtgagggaccagaagcctggggacagaacatgtgctgcagccctcttgtccacccagtggggaccttccaggccacattagactcacacagggagggtgatgaagtgcttgctctgcactttatttgcctctagttgttgtctatggattcctttcctgtaataggcacttgtttggctactgtacttgagctattgtatgatttcagctcaggagtttggatgcagtagccggcgaggactatgaacatagtagtgagagaccagccattaaaaatggaagaggaaaggaatagttaataggcatatattatgtgcttggcactctgttaggcctttatgcacattatctcatgtgtacctcccaacaatactatgaacaatactatgaagctagtattgtatccctactgtgttgcagagagaacagccactttctcaaagccacacagtaaagcatggagccaggataccatcccaagtattccaccatatgctttattcaattcgccacactgactactacattatcttcctttgttgaatcaggaaatgacgtatatgatatctactgaagatgggtcattctcttgtttgtcttaggctaaccagtgtcacaattttgaaaatgttaactaaaaacattttaggaatcttaaaaagtctatctcaatatttatgaataagagtcccccttcctcaccacttccaccaaataacagaggcagtgaaacccaatgtctactaaatggttctttataaacatgttttttcataaattttgtgcatttgtattttttgtgtaccttcaactggtttgagtatgtacggagacacaggtgtgagaactggaagaacactgaaagatcatctagcatgtctgacagatgcagaaatttagatccagagaaggagactgttattctctccaaaaatcacccagcaagcaagtgaaaacactagaacttcaccttgaagaaaatgtcattgtgtgcctatagctataaattaggtcgcccagacttattaggcatcgattcatataagaatagacccttagttttgcagaggtttgacagatatgcacaagtggcttgcttgggaattacatgtatctcaggctttaaagcaagagatggcatgttatctttgatgctggaaagaccaaagacccaggaaaataatttttcatccaagaatgtgcaaacaaatagtttctcagattctctgatgcacagttctctttgagagtctgtgtatatttatgcacatatccacctttagttattctttctttcaatcctatgtttagcttttaggaatttaaacaatgtgcaatttttgttttgttttgttttgcatttcattaaggcacatgaagactatgttggaacacttgggctaaaatgtggttctaccatatagtttatcaattttaaacaggtaaaatattggtacatatgagaatattaaaatttgtttttctagtacctccatcttttttcctgcttatgtaaacaaatgaatgcaattcattgagatttctttatagtaaaagtaagtgaattgtacaaataagtttctgtttcttttgagtacctaaatatttattttattttatttttctttaagttattggggtacaggtggtatttggttgcatgtgtaagttttttagaggtgatttgtgagattttggtgcacccattacccgagcagcatacactgcaccctatttgtagtcttttatccctcacccctctcccactcttccccgcaagtccccaaagtccattgtatcattcttatgcctttgtgtcctcatagtttagctcccacatatcagtgaggacatacaatttttgtttttccattcctgagttacttcacttagaataatagtctccagtctcatccagatcagtgcaaatactgttaattcattcctttttatggctgcatagtattcaattgtatatctataccacagtttctttatctactcattgattgatgggcatttgggtttgttccatgattttgcaattgtaaattgtgctgctattaacatgcatgtgtgagtatctttttcctataatgatctgttttcctctggttagatacccagtagtgggattgctggatcaaatggtagttctacttttagttctttaaggaatctccacactgttttccatagtggctgtactagtttatattcccaccagcagtgtagaagtgttccctggtcaccgcatccatgccaacatctactgttttttgattttttgatcatggccattcttgcaggagtgaggtggtatcacattgtgcttttgatttgcatttccctgatcactagtgatgttgagcatttttttcatatgtttgttggtcatttgtatatcttcttttgagaattgtctattcatgtccttagcccattttttgatgggattttttttttcttaatgatttgtttgagttcgttgtagattctggatattagtcctttgttagatgtatacattgtgaagattttctcccactctgtgggttgtctgtttactctgctgactgttccttttgccatgcaaaagctctctagtttaattaggtcccagctatttatctttgtttttattgcatttgctttgggttcttggtcattaaatctttgcctaagctaatgtctagaagggtttttccaatgttatcttctagaatttttatagtttcaggtcttagatttaagttcttaatccatcttgtgttgatttttgtataacgtgacagatgaggctccagtttcattatcctacatatggctagctaattatcccagcaccatttgttgaaaagggtgtcttttccccactttgtgattttgtttgctctgtagaagatcagttgggtgtaagtatttgggttaatttctaggttctctattttattccattggtctctgtgcctatttttatagcagtaccacactgttttggtgactatggccttataatatagcttgaaatcaggtagtgtgatgcctccagatttgttctttttgcttagtcttgcgttggctgtgcaggctcctttttggttccatatgaattttagaattgtttttttctaattctgtgaagcatgatggtggtattttaatggagattgtgttgaatttgtagattgctttcggcagtatgctcatttttataatattgattctacccatccataagcatggaatgtgttttcatttgtttgtgtcatctatgatttctttcaacagtgttttgtagttttccttgtagatgtttttttctcctttgttaggtatattcctaagtattttattttatttttgcagctattgtaaaaggggttgagttcttgatttgattctttgcttggtcgctgtggtgtatagcagagctactgatttgtgtacattaatcttgtatctggaaactttgttgaattcttttatcagttcaaggagctttctggaggagtccttagggttttcaaagtaaatgatcatatcatcagcaaacagttgacagtttgactttccctttaccgatttggatgcactctatttctttctcttgtctgattactctggctagggcttccagtactatgttgaagaggagtggtgagagtgggcatccttgtcttgttccagttctcagagtgaatgctttcaacttttccccattcagtattatgttggctgtgggtttgtcatagatggcttttattacattaaggtatgttccttgtataccaattttgctgagagttttaatcataaagcgatgttgggttttgctgaatgctttttctgcatctattgagatgatcatgtgatttttgtttttaattctgtttatgtggtttgtcacattagtcgatttgcatatgttaaaccatccctgcatctgtggtgtgaaacccactagatcatggtggattatctttttaatatgttgtcggattcggttagctagtgttttgttaaggattttagcatctatattcatcaaggatatcggtctgtagttttctttttggttatgtcctttcctggttttagtattagggtgctgctggcttcatagaatgaattagggagggttctttctttctctatcttgtggaatagtgtcaaaatgattggtaccaattcttctttaaatgtctggtagaattctgctgtgaatccgtctggtcctggactttttttttgtcggtaatttttaaattaccatttcaatctcactgcttgttattggtctgttaagagtatctaatacttcctgatttaagctaggagggttgtattgttccaggaatttatccatctcttctaggttttctagtttatgtgtgtaaaggtgttcatagtagccttgaatgatcttctgtatttcagtggtgtcagttgtaatatcttctgtttcacttctaagtgaggttatttggattttctctcttcttttcttggttaatcttgctaatggtctatcaagtttatttatcttttcaaagaaccaactctttgtttcatttatcttttgaatttttttttgtttcaatttcatttagttctcctctgatcttggttattttctttctcctgctgggtttcggtttggtttgttcttgtttctctagttccttgaggtgtgaccttagattttctgtttgtgctctttcagactttttgatgtaggtgtttagggctatgaactttcctcttggcaccacctttgctgtatcccagaagttttgataggttgtgtcattattgtcattcagttcaaagaatttgttaatttccatcttgatttcgtttttgaccccatgctcattcaggagcaggttatttaatttccatgtatttgcatgtatttgaaggttccttttggagttgatttccagttttattccaccatggtctgagagagtacttgatataatttcaattttcttaaatgtattgaggcgcattttgtggcctatcacttggtcaatcttgaaacttccatgcactgttgaatagaatgcgtattctacagttgttggatgaaatgttctgtatgtatctgttaggtccatttgttccaaggtatagcttaaatccattgtttctttgttgactttctgtcttgatgacctgtctagtgctgtcagtggagtattgaagtcccccactattattgtgttgctgtctatctcatttcttaggtctattagtaatcattttataaatttgggacctccagtgttaggtgcatatacttttaggattgtgttattttcctgttggataaggccttttaccattatataatgtccctctctgtctcttttaactgccattgctttaaaatttcttttgtctgattctaagtatagctaccccctgctttaccccctgcttgcttttggtgtccatttgcatgaaatgccttttttcacccctttacttgaagtttatgtgggtccttatgtcttaggtgagtctcctgaaggcagcagacagctggtgacttcttatccattctgcgtttctgtatcttttaagtggagcatttaggccatttacattcaatgttagtattgaaatgtgaggtactgttgcattcatcatgctccttgttgcctgtgtacttttttttagttttttcttttcggtttttaacttgtattttcgttttataggtcctgtgtaatttatgctttaaagaggtgctgttttgatgtgtttccagaatttgtttcaagatttagatctccttttagcagttcttgtagtggtggcttggtaatggcgaattctctcagcatttgtttgtctgaaaaagactgtatctttccttcatatatgatgtgtactttcactggatacaaaattcttggctgataattgttttgtttgaggaggctgaagatagcgccccaatcccttctagcttgtagggtttctgctgagaaatctactgttaatctgatagatttgccttcataggttatctggtgcttctgtctcaccactcttaagattttttccttcatcctaactttggataacccaatgacaatgtgcctaggtgaggatctttttgtgatgaacttcctaggtgttctttgtgcttcttgtatatgcatgtctagatctctagcaaggccagggaagttttcctcggtcattcccccaaatatgttttccaagcttttagaattgtcttcttcctgaggaacactgattattcttaggttcagtcatttatcataatcccagacttcttggaggctttgttcgtattttcttatttttttttctttgtctttgttggattgagctaatttgaagaccttgtctttgagctctgaatttctttcttctacttgttcaattctattgctgagactttccagagcatttcacatttctaaaagtgtgtccaaagtttcctgaattttttattgttttttatttaagctatctatttccttgaatacttctcccttcacttcttgtatcattttttggatttcctttcattgggctttgcctttggtccttccctgattggcttaataactaaccttctgaattctttttcaggtaaatcaggtgcgtattattggtttggatccactgctggtgaactagtttgatatttgggggtgttgaagatccttgttttgtcacattaccagggttggttttctggttccttctcatttgggtaggctctgtcagagggaaggtctaagggctgaaggctattgttcagattcttttgtcccatggggtgctcccttgatgtagtactctcctctttttcctggggatgtggcttcctgtaagccaaactgcagtgattgttgtctctcttctggttctagtcacccagtgaatctacccagctccaggctggtactggggattgtctgcacagagtcctgtgatgtgaactgtctatgggtctctcacccgtggataccagcgcctgttctggtagaggtgatggagggtgcaatggactctgtgagggcccttagctttggtgatttaatgctctgtttttgtgctggttgacctcctgccagggggtggtgccttacagaaagcatcagctgtagagagggactggtagtgggctgggccctagaactcccaagattaaatgccctttgtcttccactaccagggtggatagagaaggaccatcaggtggggtgggactaggtgtgtctgagctcagactccttgggtgggtcttcctgtgactgctgtgggggatgggggtgagattcccaagtcactggagttatgtacctaggagtattatggctgcctctgctgagtcttgcaggtagtcagggaagtgggggaaagctggcagtcacaggcctcacctagctcccacgcaaactgaatggtcagtctcacccccactgtgcctcccccaacagccccaagtctgtttccagaggaagggcgagacggacttgaaaacttgcccgaggctttcctcctctcagctgctgaagaaaagggctttttagttcttcaccctgcctgtgaagtctgcttgcaggattggcgccctcccctgggttctggccaggaggcttctcaccccattcaaattgttacaaagtccagctaaagaattccttctccctatggagttttacaccctgctcctctggccaatctctcaatggatccctgtggtgtcaggcaagaatgggctgcttggggacccagcgagctctcaggacctttctgctgcttcctctacccctgtatttcacttggctcggctctctaacttgactcagctgcaggtaaagttggaaacttctcctggaaacagaccttcagcttttcctgtgggagtgtgtattcaggagaggagggtttccctttcctacttccacagttgaggcactcacagtatttggggtgtctcccgggtcctgcaggagcagtctccttccttcagagggtctgtgggtcctctcaggattgctggtttgttcttgcattcaatctggagctaaaattcacaatgctagcctctgcatgctgctctgtctggagctgcaatctagtcctgcctcccacccaccatgatccccacaagtaagtttcaagtagtgtccatgagttacaatcaagatgataactccatacacttcaagccaagacttctattaatcttttatatattaaaatacaaatcataatttagcaatgtttactgaacatatttctgcgaagaaatctcttactagtttctggatgaaaattatacttgattgtgtcctcccaaaacttggacctacccatgtttgttaaaataggaaaggagaaagtaagattttggtttaatcattctattatgtatgagtttgtaggaggtattagacattatctgtttcaagtacaataaaaagctctaaaataaatgtaagcatttcagttttagtttgctgaggaatatagcatgctatagtggagtaattactgcatcagagtcagaatccattgaacttctgtttttctgtctataaagtaaaaaatgggactaatagaatccctaaaattctaccacattgttggaaaacttgcatgtgctttgcaggtaagggatttaagaacgatatttgctgtaaaaaatgtgagatgagtattattttcccgcaggaataggatgaccggttgctaaatatcagtgggttatgttctctattcctagacttcccatttccttcataaactcttatcagtccatctttctgcaatcactcaagaggtctgtatgtgctttccaaatttcttctcttggcttcagaaattttatttgggttttgttccagcttatattttatttgtttatgtaaaacttgtctctactcctcttcctttttacttctttttgtgatttgctgctattttgtgtttcttgacagaggtaagtcatgtattgttcacctgtttatagctctatttctagccagctccttctgtctaaacgttcaggctcactttctctctctaaaactgactttaaaactaatattttcttttcagcttgcagttcagtatgtctgtaaagtttttgtgatactattttctcatggaccagagataaacaaatggtattacattataatgctctaatacaatcaactgttgcatgaatgaggtgtttttcaatgagtaacaatatttgtcaagcaggtataattccattctgactaatggaaagaattttgtgtccttcaattgatgaaagtgaagattttacagatcaaagttttaatttaaaaaataactactgaaaattgcaatgcctgcaagtgtttaaatatagcataggagcttctggagatacacatacacaaataatttttcttattatgtacagatattttgttcttcatggcttgttaaacaatgaaaatgaacattcggtaatgatatttaaattttgtttgatgggtgggtatgtttgtgagtgtgtgtatcgtgatggggagtgggtgagtgcacttgatttatttcctattttcttcttgtttctgctccttgcattttgctggaggaccctgaatgctttattttctcaaccatgtctactcccccagtgacaaagaacattgaggaactacatgaatagaaaaggcaagagctctaatgaggtctttaaaaaggactccattgggtggtcagagtagggtgtaatagttatttgatttaaaatgaagtccttaatggcgtctatcactaatacattctgaattgattatgggagtgtggaatgcttgcaaagaatggagaaaactgccaaatacagactgaatttgtttgaaaggcttttaaaagagggggcagaaacataagtaaatatgtgtatatgaaatatatagaaggaaatgggtaactgtgtgcatatgttactattttctaccatggtaggatttctgtatagaaacagcccaaggaatcatatctctaattttttacgttatatgccgaaagaaaggtgtaattaatggtgctaagaatccaagcagaatacccttatatttttcaaattgataccttctacctcatctcatttaatgctcacaataggcctgtgaagtagaggctcctgtgaagatagagatcctgagtctcagcacggttaagtagcaatctgccttggattacacaaccaatgagtggaagggctgaggataaaacatggcacataaccaagtgtccttgtctattttttgtaataaaattgtattattttattatgataatttagttaagaatcttgcatgtatgtaaacgtgtgaagaagaaaacaagttaaggcataatgtcatcacgcagcaatatcaactactaatgttttggtttatttcctttcagatgcatgcatgggtagacagaagacaagaattgaggttatcattgcaatcagagttttgcgccttgttttcctccttgtaatacaatatgagcttttcatcatgtcattagatagtcttcagaattataattttaagctcccaatgcctttctcctggttcatgccaccccttcttaaatgaattcatccatcattggtgacagtccaaaatggaaagatgacacatgccagcgatctaagagccttctaatactcatgatcatattgtcatggggaggtgtcactttagtgagttttgttttgtttttattttttgttctgtttcatgtttttcacagacggatggagagaaaggcctctaagctgttaggttttaaagcagaccctgcttccattcttaatcctagacttgtcatgattttctctctgtgatttatctataaagtaggagtgcccctcactggtgagggaaggattcaatgaagattcaggatcccttaatatgtaggactttggctgaggaaataaaggataggctaggatttttcaagttgtctctaccatggcacagggaatagtgagtcttgtgcctggctcccgagttaggtggatgtgttggtggattattgctcttgtaaatatccttctgtatatatcctttggtaaattaacaggtggtcagcactcctaggtttccatgttcctttaattctcattgccatataactcagagccagtcatttcctcaatgtggtttcatctctaaaatgaagatgttggattagctgatctccttattcctacaagttctaaaattgttgtacatctattgtatgctgttcagtaaatggatgaccagacatgagccctctaatgcagctccacaggcagtgatggggaagtagaaaacattttctaatttccattaaccccttcccccatctactctatctccggaattatatttttagaagccaagtgcttcttgactttttgcaaaacaatattttgatgacttaatttaatataggtcagcaacatatggactctattttacttgaaatgtccactggtttaaaaatgaaacaaagattttggcaaatgtttttaaaagtatcttgaaacttaacccaggttttccgtgcctatgcctttatatgaatgtgattattgttcttgtctctttaaatactgaagcctgcagtgcctattacaattacatgtccactaaagaacaagtaggcatcagctgacaatcatactgcatttttattattattattattgttattatttttagacagagtctgactctgtcgccaacgctggggtgtagtggtgcgatctcggttcactgcaacctctgcctcctgcgttcaagcaattctcccacctcagcctcccgagtagctgggactacaggtgcctgccaccacgcccggctaatttatgtatttttagtagagacagggttttgccatgttggccaggctggtcttgaactcctgacctcaagtgatccacccgcctcagccttcctaagtgctgggattacagttgtgagccaccgcgcccagcccgtagtgcattattgaaagggaaaaacgcctgcataagcaagcacagtgtagcttataaattaaaaaatagtagccaaagcaaaaagaagaaatatcagttgaaacagctactttattagtaatgtgtgatagtgctataggcagacaaatagcaatagtcttctacttacatatattcttaattaatcttgaaaccctgacaggcttttcactgaaaattccattttgctcctttggatatcagaccctgtttgtaagatgctatttagttttctcctagctacagcctaaccttttctctctcaagccttttaaaaatgaatatttcatagcataatttgccttcctttgtaactagagtgttttggaaagctacaaataagaaaacacaggttgcaaagccaggcagaatccctcctcttacttctattgtatcaatcagaatgttggtttttctaaagggatcaaagccatttatctgttggagcacattaaacccctgcctaaaggatttaggctactgttttctcttccagaaaggaattaccacaaccatacaagtcagcatagtaagaagctaagaacattttgtcaattctcccattcattcattcattcactcattctacgtttcctgcaacttcctatcctgggcaggagacagataagtaaataagcagtgatgataccaagctttctaatagagggatgatgcaaggaggggcttactgccatcaggcaagttttctctagtcaattcctttctggcagactgagggccaattcactggtagagactagttgggattgacataccaatgaggtagaaacagattgtaccaaagcatggaaatgcaaaatgatctggcccactttggaaagaaattcagcatgtgtagtcattgacatagtggcagagaggtagatggactggggacggggttcctagatacagagaagcattagatatttgattatttctttaagaaaaatacaaataattttcaatgaccccatgatttctacatgaagctctcctgactcacacacccagagacatttatatcaataaaggttattgttggcagtaaccaagactcctcatgaactcctattcacccttcaagacctagcttaaatagcacttttgtaaggaagcttcccttgatcctgacttcatgtcccctctcagagcactgctcaaacatcatcttttgcgctaggctgacttgcctatattgctcaccattgtatctcaaagttcaacatggtgcctggcccctagaaggagcttgacaaataatttttgaatgaacaaaagaatatatattatgcccattaaaactctatgaaggatacaggtacaaccttgagcactcacgcaaaaaaaaatattgtagctaaaagagtaaatggaagtaacacaatttgaatctttattataagacatttaacttaaaagcaccaagttgaaagtttttggtttttgattcgtctttcaaagcccagagtcactttccaaataatctgcctgggactgttttgttgtttacacatctctttattttttttcctgctgttattttcattaacaacaaatattttaatatcatactaaactgagctacattagatcaactcgaaatcttttagactctcaaaagctgggcattacatattcaaaacaggacctaatgtttcagagcttcatattctactataattatatggttcaatgcaagtgattatatctcttcttcagtaacgggctgaaaagttttggtttgctggttccctcataatttactgcctaggtataataggccagtcttgcggaaaaaaagatgataaatgatgctggctaggaatcatagatttattaaatttctatcaaacagtgcaacaaaaaaaaatctgcttaagttagaaatgggctcaaattttttaatcaaaattcatgagtcctgatgcttggttcagtaggtccaaggaaggtttgaattgaagactgattaaagaaaataaaaggcttatttgaagtaatttttcaatgacggcttttaattggatgttaaatcaaattcttatctgcctttctgcagatagcacattatataaaatacagttagcggcactaccactgtaacggatacactgaataacaattgacttctcactttacactgagagggtagaagggctgtgtttgtcagcctgtcagaaattaagtatgtaaattaatgcttaagtgtatgaatatgaatatgatttacaagaggcttggagtattgttggggaaaatactgaggtttttctttccccttcaaggttaacaagtactcagtgacctttacagacagcgtgcagccatgagtgtgttagtgtgtgtacccacgtgtgcattttgccagtgagcttgggctgggagcttaaatactcccgaagagcaaataccggactcattctctaatgtccctttctgccatccatgagtgtcagcccataaaagcaatttcattagcatttcctcattttccaatataagcagtcagtgtggtactaataatgggtccttatccatcctttgcagaggatgggtattgtgccctgtggagggaagatgggctaccttgactggggggctcagagagcaccctggccagcatatgtaagcacttgagaccctatttgggaaaaatggttggcattcctgaaaaagtgcttaaccttttgcaggccatagtggggacggggatggaacagattcatctttcacagctgactgagatgaggttggtttgcaagagttaatggaacttttgttaagtactgaattaactcccaggatagcgtctgcagattgagggaatggagtttgcatagaatggttttctcacatacatttttaatggtagatctttagtagacagctcattaatttcatgattcattaccatgaataatatcctttaggcttgggaaaattttctcccatttttattctaatttttggaggaactgtaaaagctgtgcttcacagaatttaaaaaggggaaaccccagtacatagtttagttacaaatacatattagtttctctgttgccctaaacagaatagcttctatgttggctttccatgtttgaatacacacaatatcatcattttgctgattgagaattattatttaaactagtgaaatttacgttgccttcctaaatagtcttttttttttttttttaagtttagaaacagagtctagctccatcacccaggctggagtgcaatgacgtgatcatagctcactatagcatcggactcccgggctcaacagatcctcccacttcagccttccaagtagctgggacttcaggtgcatgccagcattcccagcttgtctgttccattgcatattttctttaccacttttagagtaaagttattttaattgacaaattctaaattgcattaataataataatacctacatctgctatatattgagtgcctcatttggatcaggctggttacttgatattgatggttaacagcagcttgtggtgagtcctgtagcgcctgaggaatattccaaggccatatggtcagaagtggcccagcaggcattgcagccccacttggattgaccccagaccctacgtgctgcaccataatgtagcatgcttctctccgtcaaatcttcacagcacttgcaaggtagttggcattaagcatcttttacagatgatgaaactgaggctcaggaatggtaagtaatccagaacacaattaagacattggtgagacatttgagcaaaaagtatttccatttctacccttcacccactgcctcctcctcaccttacaccgtgagcactttctccaccatgatgctgagggcctgcaccctttatttatttatttatttatttatttatttatttttaagacagagtttcactcttgttgcccaggctggagtgcaatggtgaagtctcggctcactgcaacctccgttccccgggttcaagtgattctcctgcctcagcctcccgagtagctgggattacaggtgcccgccatcacacctgactaatttttttgtatttttagtagagacggcatttcaccatgttggccaggctggtctcgaactcctgacctcaggtgatttgcctgcctcggcctcccaaagtgcttggattacaggcggagccactgcgcccagccgcctgcacccttaacatttattcagagactcctatgcagtcgtcttttctgggacctcatctttgttggttttattttctggggggaatagcatttgacattttcccatccttcttttgaagactcttgacattgtattttcttggctctcatcccgcctgtctgtctgtgatttgctgtttttcccttccatccctcagcatgaggtatcatttcagtactttaactttgagccttttcagtaatcagatgtagtcattctcttatccagtcatttcttactgtgccatctctcccagactgctgtctcacacttctagccatgctctacttgtgtcagatttggatttaaatctggatcctatgcaaccctggaaaagtcaatgaacatttctatgtctcttcatttgtaaactgggaataataatagtttttcatagtgttaaatgaagtgtaatatttatagggttaaatagttcttgcaaagattaaaaaaatgagatggtgaaactggagaactgagtacagtggcttgcacataataagcagtcagcaaatggtaactcttgttcttgttactagcatccacttttgggtcacatggcacaacttgccttgcattgtcattcttaatgaccatatcttgtctccgtgagagaccatgagcaacttgaagctgtagatatccatatatcattctgcctcaatcaaaaggtatattcttgtcttctcttttgataacaagcatttagagtggtttattttcattctgtgagctgagtataacaatttatacttatttccaaattctccagtgtttgctgactataattgaaaccacataaagatactctgtttaaatcccataagtaataattctgtgctaacaacatttttgaatatttcaaggaaatagccagtttctccagagaattgctagtatcaccaacatttttggtgaagtttctgtcttagtttgtttacttttgtagccagtttgaaatgctagatgtggactgctgtggacagggtaaaaaccaacaacaaagttctctagctagttcattaccttcattatgatgtatgtgagagctagattattccctctatgcaatagttgtgttttctaaattagggagttgctttgggaatgaggggcctgtggtacttctagagcattcaggatttccagatttgtaaacagttatgcacaatcttatgatgccctactcaccatgacagagaacatatggccagactggcctttctgtaggagaaagcacattacaggataagagtgtgctaagcaacctctagtagacagggcttgttctctggagaaatctgcctattgtgattgtgtgggcatgtcagtggacatgaggagtttctgattagaaagcccatcttgtcctgggtagccaaatagcaggtgcttaaaaaatggtggtattgacagccatcaccatttcttaactaggcctcatggattctgcctagttaatttgcctgctttctctgacatgatttatttgttcactctccgtgcatgttgcttatttcaactggggttgctgtaacaaagtaccgtaaactagaaggcttataaacattaggaatttatttctcacagttccagaggctgagaagtcccagatcacagtgccagcagatttgatgtctagtgatgtcctcttacattcttagtatcttcttgcggcaatcctcatgtggcagaaaatgcagaaaagcaaggcagctctctgaagcctcttttatcggggtaccaatcccattcatgaaggaggagccctcatgacctaatcacctcccaagggcaacatcttctaataccatagtattgagggtgaggatttcaacatatgaatttgggggaatgtaaacattcagactatagtacatgtactattcccactgccaggaataccatcctattttccctgctaataatcgactctacctttgacaacagagcaaacaagttataatatgaactttgttagtcattgtcttttatctgctgctgggcttttcacctacctttgtatccagtacttaccaggatgtcctgaacccaggatgagctctcttaatgtctgcagaaggaaggaagacaagggaggagaagtgggcaatttagtcaaaccactggggaatcaaacaacttgttaataatcccaactatggagtttgtccatctagtcctagccctgaatagcatcccaattttttaaaaaatgaatttcaagtgagagaatgtcatgttcacattagtattgaatgagccacagcacgtccctgatttatttatgttgtgtgaaaatttaagtagtgatgtaagaacatatcactttggggacatttgctgttttttaatttaacctttgtggcagcagaaaccatctcctcaatgaagacccctaatgaaagctggcagaaattcgtgtttttattttaacttcatggaagaaaaatagtatgttacttacataatgtttctaattatagctttttcgttatactattttaattgtcttcttaaatgcaatatttgacatgctgccaggaacttctcaatgatttcttcattgagcaaagggttcttagacatcagctacgtttcttaaaactgtacactttcgcaacattaaaactcaatcttttctcccagagtcatgttgcatcttatattcctcccttcccaggacacatcatgcccctttgcataaatatggagggtgaggtagggagaacttgagcagccatttgtaaggctcacttctttttaagctttaagaccttggggatgttgtgatgatatagctgtttgtctgtgggggaggaaataggattaaatgaaatgaaaccataccagaatcactcaactccacatttttatagtatgcataatctgctttttttctggaagtcatgaaagatgttctttatttcttgttttacaaaaatagctgcctctgggtatcgataatactagtttaaattcttcaaaagaatccatgaattgtaactgctctgatagttctgcagctattttttaatttgtatttttgctgagaaaattataagctgtggagtaaattttaagtgcaattatatacccctggaggaaactcttgaggcagtatcataaatggacttatgaggcaacctcctgataatatgggacagctgattccataacatatgcatctggtcttacatgctttggcacattttcatttatctcattaaatccattctgacacatttttcatgtaatagcttttctgataacttcggtttgtaaaacattaatattgaatcttttgggggaagacagtgatgtctctgttttaatctcctgtagctatgatgtgtatcctgcactttaccgagtggcagaaggcacagcttgtcactgttaattgtgactgggatatgttgttgatgctaagactctatccaatgtcctgaactgaaaagttttccgtagaccactgacaaaaataggccatggagtctgtgttccttcagtttagttctacattccatgaaagccactactacctggcctgttgcttagcctttcagacatctctcccattccttctgaatacataattggctctcaatcttactacgtatgtctagctaaggggtgcagaatacaaactccagagcctcccaatatttaggcaaattcttttgcacttgagggagcaaggcggtaagtgggggtttgatcaagagcttcccatccaatcaatcatggctatgatcaaaagtagaccacaaaagaggaaggcataatgataagattccaaatcactgaacctactaaaactattttccaaatcctattagaagagcactaacatacaaaacacattgattatacaatagatgccattatgccacatacaatatgcaataaacacaagtaaccatgctatgtaacactttttatctctactaatctaataagcaagctctaacaagcattaattcaacagtaagtaccaataattgtgttaggcttcttagaatcctaagaaactttggaggattgatttggttttccatgtatttttaaagtctttttttttttctctgggaaacaggagctgataactgttttcttcccgtcaatacatttccctgtagcaaagaccatcaggaaggcatgaagagggcaggaaatttatttgctttgaggatccagaagctatctatgggcttcttctagggatccaaacatctgacctttcttaatctcaactaatggaacgagtcacctttcacctcttcttcctgtgtggcccctcccactattccttttccctacaccaggaggatagagtcctgttacagaatccattcaatgtttggatgttgattatacattgttgaaggaacaattaaccattgttacaaggggatgtataaagtgctgaaaagtggtgacttgtgattagaggtgttccccttctttcttgttgagagactgttcaattcaactgtactattaatgaacacaagaggaataatacacgtaacccctgccctccggaagctcataatctattatgaagactaagataaatatacaaaggattacaatgaaataaataacaggactctttcttataacatctttaaggattctgaataagttgaatgaaggcatcaacatgctgattgagttcatgcactcatagatgggcttttcatgttgattgtagtggtgattacgttttgtaactgtcctagcgagtgtaggagtcaaagagatagattaatatttgaaacttcctgattgcttttcatcttggcatcaggttatcattttacttgcacttataccagaaactcccatgttcaaacacttccttccatattatgtatttagccttatcttgattatgactgaagctgcgtttgtcacttttgttttcaaatcatcgtgacgctgagacagttcaatgctttgtctgtgcttaattatgatattgagttacagaaaaacgtttcccttttttttccaatttgccttaatcagggccttaagtctgacctagctctgagtcatgttgtatttgctcctcagcgaaatagcaaagcagtccctgttcaggttacactaaatcacaaagtgatgcgggggcgacaggttctgcagcaagttagaatcacatgctgttaggtttttgcctgtatggatcaaattctaacagaaaaataagaaaaggtggaggtcactgcatatgtccagatactctgaagtgaaatgacagcattagagtgacagtatcttattcttcagacaaaggaattatacagaatttctaattagaaaatcaaaaatactcaaacattatttaaattatcatacggtaaaatatccagtgattatctgttatctatctatctatctatccatctatctatctatctatccattcatccatctttctgcttctgtttactgagccatcatatgagatgtttcataaattttgcttggaacacccaaatatcttccctgaaacaaatatgctgttggtcatctgagccctttgctccttcaaggaaaattagtggggcagaacaactgaagttgaaacactggctagttttaatgtttataattagagattgtttacaagcttgatggactggacctgagccaggaaactattaaaagaggctgggcccacatcattgtggagcaatgtaggataggggattcatataaaataggctttagaatataacagcctgcattcacattcaggaactgtctctttctagctgtaaggaagatatttaactgccctgagtctcacttccattatctgcaaaatgggaacaataatagtgcctaccttagagggttctttaggatcacatgaaataaaccatgtgaagtgcttagcacaaaaattggctatgctgtatatgtgctaacatttatatagagctggcttggtgtaagaatggcactggctaagattggtgggaggtaagaacagttagcaaattaatacagtgagcttctctccttgtgctgtgtaccttgaactgggaatgatctcatatgaaagacttaactgtgctttccattttgctggtgaattatgagaattctgaactttatgattttggaatgtgaacatttcatttgatagtggtgatttgtgtcctttataatctgcaaataatcaacctatttatttgaaattaaaaagaagacaattcaagaattgacttatttccctctgacatctcagtagtagtacatttgaatcttcattcattcaccatgtctaactcacataaaaacctgcccaagcatgatgaatgaaggtatagttttgaattttaaaaataaaatatatgaaacagatgtttgcagcaagcttcctcactttctggatgattagatatacatggtgctgactgaatattttgtgggctcatctggcagcttaagcacaaagtgcatgcttgcaagttagcaactagaatataagaagttgagacacataaatgtagtaagtgaataaaagtagaacttttgatttctcaagtcattacatttgacctgttgacccctggtcagggtgggagttcataaatgacagagaacaacaacataacatgagcacatggagtccaaaaaaagggtcaggtggggaacataatatgaggagggtgaattttaaaatcatattcaatttaaattcattctgatatatttagaaaatgttcagttctgtaataatcttacctcaaggtataacatagtactggccgccatggccaggattgtattaaagttccatttggtatagaccaggagcttacaaattacaaatgcttgtttttacaaataaagtactgtcagcacacaaatatacccattcatttacatattgtccatagttgcttttgcactgcaagggtagagttgaatagttgtgacagagaccatatagcccacaaagctgaaaatgtagtatttggtctttcgcgggaaagtttgctgactgcgattttagaggaacaagaaaaaagttatcagatacatatatgcctatatgtgtgtctatgtatatgtgtgtactgtatgtgtgtgtatacccatatatataaaaatacaatttaaagcaccgtatatacatattaattagaaaattataaagagtactataccatgctactagcatggtagttggctctcagtaggtgcccagtgaatgagagttattagaattaaaaatagtctgcataaaaaataacctagattagatctttaaaaagtgttttggatcagcaaggactattttataaagaaagtgaggagcaggaagacttgttcatttctggtaaaatgagaactaaccccaatctttactcttctttgccaaaattgagcacaatcattgacttaataagacttaaaaatcctcaaaccattttaaaaatctatctttcactcttatttttgttcttatgctttataattattcaaaaaggttaaactctcatgcatctctctgctttataagctgggaagagaaccagcaatatcaaaaaacaaaagttcgttctcataacaactgtaattttgtcaaaacatgcaatgtcctaaatgctaccacggagctcattcggagtaaattcatatatttagatgaagtcaggtgacattgataactatctgagtaatccattttccatttggcctgctgttattaaaaagtacatatttgcattatttagcatgatcctatgtagggcaaagcctcacactgagcaatctggttgattcctgtgtattgtatttgagcaaaagaccatgtaagtaggggcagaatgcaagaagcagagtatgaagctcttgagagtaatgtatagaacaattttctgaggccaaatgttagcttggaaaatttgagagaagaactgtcaacgtaaatgtcaggttatttgaaacaacatgattcttaagacacagaaacacgtttctcaaatattggatagctgtttttgtgattttgcttgtttagttttaaggttggccctttggcagacatttcctgtaacttttttaaaataaaagtgatagaagttgattgtggaacattgggaaactgcagaaatgaataaaaactagaatgaaaatcacccataatttcatgaataagcaataaccactgtagatagctcggtgatatctatgtctctatctggttatttatctccccaaaacagaatcataatgagtatgtggttttctgtcatgcctttttgagcattttcacttatcattaatttttaaaacttgaaggaagaccttctataaatattatagaacgtgattacatttttgatttaacatttccccttttgttgaacatttagacatttccattctttggtattgtaaatagagctgcaataaacagcattttgcatgaatcatttcatgcatatttagcttttctcccttaggataaaatcctagaagtggaatgattggatcagagagtatgaacatttttaagtctattgatacatatttcccaactgtcctgagattcccaactgagctgggattataggggtccgccacaatgcccgactaatttttgtatttttagtagagactgggtttcgccatgttggccaggctggtcttgaactcctgacctcaggtgatccacccaccccagcctcccaaaccgctgggattacaggcatgagccactgcacccagccaagaatatgttttaaggagtaccaacaacagtcctgaattttcgatgctaaactcggcagtcctgggcagatgagaacagttggtcattctattttgctttgtgtcgcctagacataggacttaaatcccggaaatgtcacgactttgggtttggaatttgagagaatctttacagaaagctgcatttctgtgggaaagtcactcgtttagttcacatgatcctagaaaatatgtacacaattataaaccattctactttctcttaggtttttgtactagacttaactatgtgcatgacattcagggttctgatttcttttgaattatgaaataaacatgtttatacccaaacaagaaagaatgaagagttgtatttcccaagaaatattgtagaatgagttcaaggattattactgagataagaaaggttgaatgcagtgtgacaatgaaggcccagtgaattcagagaagcaaaatggttctgaaagtgacattttctcacatagtcctctctgctgacattattgtaaccactgaatgcacagtgcaagcatggtgttgattttaaatcacagtcagagaaattggggctggacacatttttcattatgttttgaggatagaaggatcattatgttatcctaggaatagttttgttaatggaaatgcctctgattctccctagatctatcataaatagattaaaatagcttcagcagcatttatcctgtgcttcatttcacttccacgatgtactgtgattatgacaatgcctgaactgtgtctgagaattgtaagttacattcagcctggaataagaaattattgtcccaccaagtaaatccagtaatgccatcaactttttaggcacattgtgaaagcaattgtgaattaatacttgctttgagccacagtagacagagtagagagtggacaattcacctgaaagagctttttcacttttctaacaaatgcatctgcccaaaagccattttgactcttttcataatattaatgttttaaaattaaaaataaaacattgaaactaagtcatttgtgattttctttgttccaatttaccatagttggaattttcatcagattggaaaaataattcacgcccaaggtaacagttactatgccaggtttaataaccaagctttgaacccacccaaatcaggatttagaatggaaacagtgacacacctcctgaaagctttaagcagcattgaatggagctgcttaaaaagccagactggagttttctatgggccttcttaaaaagaactccaatccctgcctggttacagaaagcagtatacaagacaaataagaaatactacctttctttcttcttttctgacagaattcacaaaaatttcctcaagctttcaacagtgtctctgtcagtggctcctcaggaagaaggatggccttcaggcatcatcaaatattcacagggaaggaggtttttaagaattgtagtgccaattgcatgctcacagctggactgactcaatgggttatgagacaatggaagggcaagtttttagtgatattgaggagaagcaaaatcagtgaaaataaattggaaatttccgttgtgtaaaacagtgaagtatgctgaggtatagaagtgcatgcctagagtttgtattgttcatctatttgaacaagtgccttaagtgaggcattgttggatagtttgtcaatataataaatagtatacacagcttttattaaaacatgaagtcatgtccttagaatataactaggtaagattttaacatattcctgtgttaagctgacattcaatgccaagtctaaaaatattgaacataaacacctctatttgccaatagatttaagtgcaactcttctgcattgggctctttccatgttacctcatctatttatgtggccctagaaagaatgtgtgaagaaagcagtcttacatttaagaacactattcctatgtattctgacctcagtttccttatatgtaaaatgaactttatatctctactatttaatgaatttgttgtgacaatcaagggttatgatcaagggtaacattgatcctgtgtttcactttacttcctcaatgtacaaaaatatagctggacgaaagtatgggtaggtatagctttgaccagaatggaaatatctggctatttggaaacattgagagatttttctttctttttttattgttttaaactactatttagaactattatgtaacattttacagatagaatagttggggggaaaagtcactgtacttgtcgcttaggcctgtgggtgtatatggggaggtcatttacaaacaattactaaagaggtagatgattttgatggcatatcactcaactgtcctccagttttttttgtttttttttttttttcataaaaacttggcccattattttgccaattgaaaacattcgcaatccagtctaccttgattttctgggtcaactccccatggctgattagctctttagactgcaaactcattcatttgtttattcaacgaatgtttacagagtcctgactctatgtcaggcatgatatcaggtgctggtactacagcagtgaacacaacagacaccttctgtatcctcatggaatgtaagctgtgtgtcttttctgttgtggctgcccaaatgcctagcatagtgcctgttgcatagtagatcttagtgagagtgagatttgctgatgggtgacagatgatagagtgaatcagtatattattaaaaaagtgagctacaatagttccctgcaagtgtagactttgtaagctccaaacactattctctgccaataatgaacctcactatatatatgtgcatgtatatgtgtgtgtgtatgtgtgtatatagatatagatatagatatagatatagatatagatatagatatagatatagatagatatatattttaggagaactgttgattatttttacgtttttaaaatttcaataggttttgggggaacaagtggtgtttggttacatgaataaattttttagtggtgatttctgtgattttggtgcacccatcaccgagcagtgtacactgtacccaatgtgtagtcttttatccctcaccctctcctaccctttcccctgagtccccagagttcattgtatcattcttatgcctttgcatcctcgtagcttagctcccacttataagagagaacatacgatgcttagttttccattcctgagttacttcacttagaataatggtctccaattccatccaggtagctgcgaatgccattattttgttcctttttatggctgagtagtattctatggtatatatatatacacatgcacacatatatatgcttagtgatatatatatattatgtgtgtacatatgtatatgtgtgtgtgtgtgtgtgtgtgtgtgtgtatataacattttcattatgcattcattgattcatggccatttgagctggttccatatttttgcaattccaaatgatgctgcttaagctagatctgccatgcatataacatctcattgtgaagatccaggaaagcaagttccctcagatcgctgaggatagttgactgattctcatttcgtgtaccccatgcatcttataacttctcaggagcccctctgtgctctggctgctagggaactgactgctctttgtgacccacttggactaaatatccaggctctctaagaaagtacttgtgctacttaatcttggcctgatctcaccatccatatttcttacagttttaaacattattgtattgtgtttatatccacaaactgcctgacatctattttgtgacagaacaggattgaacatgtaaaatataaaaatgcatgtggcacgaggtcactgatcttacagcccaggctgacgacactttttctgaatagctaacttctagaactctgtgtttgctttgctgaattactgtatattttaaaataaatataccatgtcccttctcaaaacaacaaatattgatttcaaaaatctttttttagttttgagaatctcaatgcattttataggttaaaggtatctagacttgaccatacttttctgctaaaatttatccagcagtacttgacattgtgttgagcactgataaagtatttagtgaatttaattatactccatattttacttcctgggcttttccacgggagtacaaatcaaaatcaaaatcttagtctctgagatatgtgtagaacatgttaatcgagtattaaccctcaggttggctttcatctctgcatcctagaaccagtattagttttgggatgctatattccaaacactttctactttgaaggaatgggaagagattgctgcaggggtaatttcttatcttccacctgatttttttttttttagagagaagtaggtgatatggcatggtgactctagttattaacaatgtgttgtatacttgaaaattgctaagagacattgtaagtgttctcaccacaaataactaatacgtatgtgagataatacgaaaaaatgaaagaaagaatagaaaggtaggtggaacataaaagaacaacagccaacattgaggaatatagaaatccacctgattatttttatgaagtggcacagtagaaaattagtaagataaattgaggatgaatgcaaggatgctccagttctggacctccagaaggacagctttgaatctcaactgatttttatttctaccactgtttctatattggtgccagtcggaagcatagcatgcaaggtgtcacccaataaatgaatttggccagggaataaactaacaacgataacgttttcctggaagctaagggagtaattagagcaatgacttttagagacttcatttcagaaaagttcatgctttaatattcaaataattacattaatctgtagattagtcagctgaaatattaaattttttggcacaagcttaatgaaaattgtcataatggtgccaaaaagaaatcttatggctgccttttaaataccaaagaaattctccattgttgtgataaaatacagatgtggcatagaaagaacttgcatggtgagcagaaatagaatatataattagaacaaagagggcttaaatcaaattaatcttcatctgacaggaacagttacatttacatcattgagtgcaaagtcatagccaaaattgaaattagaaacagataattatgataagagaggacacttatgctgacttttctcatgcataattggagagcatacaaaatgcaatgctggttctaattagaattagcattaaaagatgccagttttgatgaattctgggttttgccataaaataagttgtctaaataattgaactatggacatgcaaatttgtttgcctgtttgttgtttgttcaagatacaactttaatagtatcagtgatatgaatgctgttaatttcttttgtcaatgtcatattgtaattttgttggctttgttttatttctatttttcttgagaatctgatttaattcttaaaagtccatcattcatttctgtctgcaaagtctcttttcgtacgtgtacttacatatacacatgccttataaaaatacagagtttaattgttcacttggcatgtatgaaaagagtgtgtatgacagtttcagaaatgcagatgtctaaagactctgtgatacaatcctgcttttttcaccttggagttcaaatgtgctatttctgaatggttgtactcaaagggaaaatgcgcatcccattgacaaattctttttgaaatatttcttcccgaattatttactagaatcaaccccttgactgggggacttttccaacaatcctagcagttgagaaaagcaggggcaggtgttggccatcatcttggggcttcattaattcatggtaggtgcttcacaactctgtagtctttgcttttctttcattgttgtcatttttaaaaacttttatttatagagatgggctttcgctatagagttgttgcccaggctggccaacaactcctgggcccgagcgatcctcacgcctcgacctcccaaagtgctgggattacaggcatgagccaccatgcccggccaatcttagcttttctttacctcttgttctgttactcttttcttattttcttttttcttcttcccttttccttctccaaggtgaagcttccagtctcttcagtagtagtagtgggtttggctgtttaactaaatctccaggggctcttgggagcaatttcattcttttccattaaattcattctgtcatacaatgatgcatattattgtagattgtgaaactcctaatttcatttttcttggaactgcatgagtttctgtcaggagaagtggacccagaccaaccaatgaaaatgcatttcaaagctccttaattcttgattttggataaagagtttttctctgcataaacaaaatagatcttagttgtatagcatacagcgtttctggctagggtaacattgaatgcctttccacctagggctctttaaaaccctgtgaaggattagattaaaaccttgtgaaggttgtagatttccttcctaagaaagtctttatttatttatttatttatttttattttatttattgttattatactttaagttttagggtacatgtgcacaatgtgcaggttagttacatatgtatacatgtgccatgctggtgtgctgcactcactaactcgtcatctagcattaggtatatctcccaatgctatccctcccccctccccccaccccacaacagtccccagagtgtgatgttccccttcctgtgtccatgtgttctcattgttcaattcccacctatgagtgagaagatgtggtgtttggttttttgttcttgagatagtttactgagaatgatgatttccaatttcatccatgtctctacaaaggacatgaactcatcattttttatggctgcgtagtattccatggtatatatgtgccacattttcttaattcagtctatcattgtttgacatttgggttggttccaagtctttgctattgtgaatagtgccgccataaacatatgtgtgcatgtgtctttatagcagcatgatttatagtcctttgggtatatacccagtaatggaatggctgggtcaaatggtatttctagttctagatccctgaggaatcgccacactgacttccacaatggttgaactagtttacagtcccaccaacaatgtaaaagtgttcctatttctccacatcgtctccagcacctgttgtttcctgactttttaatgatcgccattctaactggtgtgagatggtatctcatagtggttttgatttgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgtagattctggttattagccctttgtcagatgagtaggttgcaaaaattttctcccattttgtaggttgcctgttcactctgatggtagtttcttttgctgtgcagaagctctttagtttaattagatcccatttgaacgtctttataagcaaggaggattctgatccatcaaggattatttagagtgatgctgcctgaggtttctccaattctatgaccctgatcattgtcagatttcttgttgatttagtgttctctcaaaatttcccagtactcagaagtgccaaaagaaacatcaaagtgtggattctctcttgaatcttggttgtagtatctttccttagctttcacatttttctttgaattgtatttttatttgtttggttcattttggtctaagggctggggtaaagggcaaaggagaaagtcatttcattttagggaccacagtagaatgatacttgaaatgccattttaatataacttctcagataactgttttgtacaggtaaaacagttgttgccaggatgaattatataaatgattcatttattgtatattatgttaaataaaagtaacatggaagagggaaaggattttaaacatccaaataaaaataataatttatcataagaagctccagtttttattgttaatgtggttggatgatgtatgttaaataattgttgattaaaaggtagttgtaaaagctaaacattaataacttaaataacaggattttagttgagaagatgatgtcatggaagagagtgtgattgtgatgcaacaagtggcatcaatgtgaccatgtcaggaagatttttgtttctaaaacgcaaacaaagcatttcaaatgatagactcaaaagagcactttcaattgagatatttagtcatataggctgatttgcttcaacctgaatgcaaagtttctcagggaatttgcccctgaaagccactagcaacctaaagctcagtcttaagacagaaaggcatcctaaaccctgtgatttcataatatccttgtaaccacatgctgaaaaactaatttgctaagaacttaaaagggttgacaaacaaattacagccatcttgatagggggtgattattggcattaccaactcagttgggtattcttaatgaaataagacagctttattttcacaacttgccttgaaatgtaggtgaaggatatttaatgcttttaaattagcaatattatgtagttacatagcacttcacatttgcacatattattgaagtcaactctatttctttttccttcaaagacttctgggaagtacgtcaggataaccaggcccattgtatggaaggcataattgtaacatgtgctctatctgatgagccttgcctatgtaatctgaactcttacatactatggccatccgccctgggaggctgactggtgcctactgccgccttatgcctcctccatgctgtcacttctgcttggaatacttgactgtttccacttacttcctctgcctggtgaacttttattcatcctacgagagactgatcaaatttgtctctcttctgaagtttgttctgccccttttcagcccttttctgaacccctcaatcaccctcacccccaaatccagcagttagtccttccctttcctagttcaaactccctctgttctgttcttatggctactatggcatctatcacgctgtaatatagtgatctcgtcacatatgcttcctgcacttggctggcctgggacatgtgtccaggttacctgcaaatgtctcctctcctgaagaagaaaactaagagtccttaattaaatgcagttcacacctccttgacgtcacttccaggccttcagacgtgaagcctgctgttaactactcctgctgttcttgctgacaattttatggaggatctttaagggctttcacactgggccaaaaatgtgtgcatatgcatacacacacacacacacacccataaacacacatatttgcaagttaatgtgatctgcaagacctttcagtttgagaagaataatagctttggctatagagaagctattcccatagctatcacatagagaataaattaaaattaccttctaaggcacagattagggagggaaaacagcattttgggatcattcaccaaaaggtctttgctgtggcagaaagttatgaggacatgtttttgttcattgtttttctcatttgttgtacaactggccattaaattgcaggtggttcctcccagccgacagtcccatctgtgtcctggatggtggcaagtttgtgatggttcaagatcaagttcaagattcagatcaagaatcagatcttgccaaaatgtcacttcttttttatttcaacttttctcatttaattcctttgaagtagatgttattctttctcatttaaaggtgacaaaattgagactttgaagggacaaggagcttgacatgtgtacagctagagttttatgcccattggactgagccttgaaactgtgcaacctctcatttctttccacagaatggagcagggaccctgcttgaagaaaacttggtagatgaaaaatgatattataagacaagtacattagaatttttatttttaaaaggcttactatagaagtctttacaatttggacttgctttgtggaaggcaagatgtgccttccttctgaagaggttccattgaatacattgggtaaaaggcagctatagtgtcatgaaggctgccagcaggcatggagtgtgagtggttttcatgagtgtgagtggttttcatgaatagcaagaatacaaacctgtaacagaagaaactaaggtaacagggtaacaggcagcagggacaatgatgtatttttgttccctatcgataaactgttgaacacttttacaatacactgttctttatgttcctcagaatgtgtcactgggaagctcagttagaaatgtagagccatttcttagtacataatggactaagacctcagtcttgcccctccatcctcaacttggctcctgtttcgctctggggtctttagtttcaatgagaatccagaacagacgttctgaatgttttgggagagagccagagccgctggagtagtatggaaaatgatgcttctcagactcaggactctaaattaatagaacagattccaaacccagaccccttctccttaacttgatattatatttcagactgactcccaggaagaatccccagatttctagctgctgaaatgggcagttacagacaaagaagtgcattttgcaaaccaataaaaatggttccatagcattctgatctctgctgctgggggcagagctttccatggaaaggtatgccgtctttagaagtccagttatcagcaatttcacaggggccaattcaaagcctttccagattattcagtcttccatccatctgacatacatttgctgagtgcctactatatgcgagtactgtgctaaacatcagtgatgatgtgtgatgggggaaaaactgcaaaggacaaacatttatcatgattggattagacactgccttggtgtggcttgcagattaggagagaaaatcatgcgtgtggcatgatattcacacaagcatctatagctcaaggtagaaactgctaggagaggtgtagattaactccagccagtgttgctggggatggcttcagaagcagaagattatatttgagaaaaatcagcagctcattctatacgtggacatcctgaatttgaaaactgatattttcttatatcaaatgacacaaataaaattgttactcctagatacactttaatcctgtttggcagggtcccacacacttgaaatatcagtgggatttgtaattgtaaagttgggggtatcattccaagagcaggaggtactacaaatggaggaactgttaataaaaacatggacaaagaggtagaaacttgtgcaaatttaaatcacataataagtgatattgtacagcagtccataatctattgataagtgggagggattttcctggctcctgtcgtctggaagggcctcacacaagtcttcaatagaacatatgaagagctgggagaaagcctctcactcctttgtgaggatggtaaaacatgttttaatgcagatacttccttgatctgcttatgatgacctttctgttgctgaaattatttgcagcttaatatggtgtaaatgtatttcactgcaggagtattggtgcagaaaagagttaacattgcagtactgaaactgtagtttcctgaagcgcctgcttacaagattggcctgtggctggcctctgggaatatggctttgaaaatgttccctaacggaaaaaatgtggctcactgtgcctcaattgtttgtacaaatgttgtgattcatgctgaatacctgctttctttcacaggatctggaatttttgtacatgctgggcagaaggtgcctatgtggctagtcccaaatgaaaagattcagtgctaattctataatgcgcttccatgagcagaacttctcatgagatggagagaacacaaggaagcccgcatatggattcctccagactctgcctatttcttttttccttattttcctatcataagccttagtcgtgagtgaactatatgttgaattccatgggtgttcctagtgattctccaaatgtgtgggtggtcttatggaccctgccaaacataattaaagtgtatctaggagtaactatcttctttgtgttatttgagagaagaaaataccagttttcaaattcaggatgtccaattatagaatgtgcagctgatttttcacaaacagaatcaagacctgcatttcctccttacattcattttctccttctcttttccatgtgtaattgcaagagaatggcccctgatttttatattgaactgcctagtaatgagcattcctccaacacactgaattctcagaaaagaagccctttcaggcttgtgaccatcttgtctctgttgtgattggcagtaatccaagtaaagacagtagtaaatatgttttctcctctcacaccaggtgatcctcagtgaatctgattgttgactcatttgctctctcactgtaacagatgttgcttttggagatggaaatcaatgttacaaagtattaacaaggggagaacttacaagaaagtgaacctaaatgattctttgctgatttaatacagcctgatcttggcctgttatgtcagattttgcaaacagattttaaagggtgtaattttaagtaggaaattagttctgtgacgtgtatatatgcatcccagatagccaagagtagtgaaagtaggaagacgagaccccagtttgaaatgtaaagacagatggaaagtttacttgaaaaagaaacctgcaagattcatgcaagactggatgtaggcaggagactattggccctacaaatgtgttttttgacccataataggttacagcctgatttaataggtcacatttcactgcctttatgggcatccttacatcttcttttcagggtaattatctcaacacacatctgatgtggcaaggtaattgactcttgcttttgtacagttataggttaatgaaccagactgacttttttagaccaaatcactcgttttgtttctgaaatgaaatagaaatgtatttagaaggcaatgtttgatacattaaaaattctcagatggctgacaactttgatttctcatcctttatgcatcacagtgtgtagccatgaagaaaggattatagaggcatctgaaagcagcttggatgtttgaaatttagaatccaagaggaaagaatggcaaaatgatgcttttgatgagtttaacgttggctgtatagaacaccatgtgattattatagaagagtggcttacattttcaaagttgtttttttttctttcttttttttctttctttctttctttttttttttttttgaccagagccccctatgattttcaggtataatatgtggttactttaaattttcagttaaagttctttccaaaagtctgtttcagatgcaatttgtttgtcctctgatgaagctgcataaatatttctttattaataatttctaagtggaggcagtaaagatattgaaacttagaattgagattgagaaaacaaatgccttatcatttattttacattgtcatggagttagccctatggaatcaccaacaaaaaatgagcagcaaataataactaataattcaaccattgataaagaagcaactcattatgtatagcataatcatttttgtttaaaaaatgcttgaataacatagacacagagaggggaacaacacacaccaggacctgttgggagagggaacttagaggtcaggtgcagcaaaccaccatggcacaaatatacctgtgtaacaaatctgcacgtgctgcatatgtatcccatgtttttaggagaaatgaagaaaaaataaaaataaagataaaaaagaaagtaaaaaaataaaacaaaaaatatattgcatttgattaacagaaagaaaaacacttgaatatataaaaaatactagaagaccatacaccaagatgttaaatctagtaatttctaagtgaagaagccatggattcttcttttaaaatatatttcctgaatcatatttagatatcatgcaatttttgttataagatgaaagaaaatatatgtatctcttttaaaaagtaataattagtgcagggaggtctgaaaataatagtgactatatatttcattgtggttacatctttttccccaaatcttcatgagaagaaagtaatcctccaaagaattctgtttccagctcttattaactagcctcttaaaaccagttgagggccagggcaatttaacaagcatttgtgaagagggtagcctcctgagtagtaaatgagattcatcttggaaatatgcaaaatttgggagagaattaatcagagtgacaaatgcaaacgatgagtatgctatagagatgtaaagctgctgttcaaaaaggaaggaaggaaggaaggaaaggagggagggaggaaggaaggaaggaaagaaggaaggaaggaaggaaagaaagaaagaaagaaagaaagaaagaaagaaagaaagaaagaaagaaagaaagaaagagaaagaaagaaggaaagaaagaaagaaaacattgtcaaaggtttagtggtagaattagctctcatttcaggagcccttaaagctgggaagaagaggattccaaatgtgcaggaaactgggtctcttatagaagatctgagctacaagttgttcattttgcaaaatgtcagaatctaggagaagtgtgaccaccatgctccaataagttatttcatagacattcttaagctttttggagaacaccaccatttccaagaatttcctctgaatgaagaattagggctcatcttgagttattacaagtataactagcagcacatactcatcagaaatgccaagtcagggtgactgcctagatcctataattttaaactcacttgccattattagtttacatgccaacttttcccaaaaatgaatcaggtcagccacaaagttaaaataatgtcagcaaaaacaattcaaacaattcaagtaaatgattaaagatttataaaaaattatttagcgcaagaggaaagagacataccaggaacctcacatacaatcaccatccaaagttgagtacttaatttagcactggtaatctttttagcatgagatagatgtcatatcctccttgtatgagcacagactgacgtggaagaaaacaagagttcggaaagatttgtctaacaccctatagattcatactggtttcctgtgcttgatgagcactttaataattttatctcttcctctccttttccctcttcctttccactctgctgaattcatattctacattcctctcttatttatcagcctctctgtgtgtttccccggagatatacataatttcactcctgctattctaacacacatggccgctgctctaaaaaaaattcctaatagcaacctgtgcaattcttccagaatactcactctctccgtcttacttatatttttgtgaatatgttggttttgcttggggaaaattttgtttctttgggctcagatcagtacgtagggactgcagtttatagctaactggacaggctgttctctgtaaaacagtagcccaatgctgtgcttattctttggtcaaatggcagaaaagattaaaaacaatgattgttttatcatgtaatgaacttatgggatcttttgagtgattaaaatgagtgaggtggactttattggacttgaaccggcagagtaatttttattaattgtgtagttaagctcttttgcttgattatttgtaattatgcataaccaacacatccttattttgaatgtttattcatgcaaatggatacacctttagtgaaaagctctacaaagtagtatagccctctttcttcatttagatacgtttgataatcaggggatatatttgttataaaaattgattaggtggccagcaaagagtcttatatctatcttggtttataactttttacctataagttctgtgtaatatgcatgttttacctataagttctgtataatatgcatgttctactctggtatctgaaaatagcttataaaattagaactatcgaaacagacaagctggaataataatgacctgtgtgctggcatgcactttgccttctttgacagcacttggtaagtgctatataaatgttagcatttattgtttttacttaaacttttcacattaaatctgtgaggtaggcatggttagccccatttgccagtgaagcaaagtgaggaccaaggttatatagtttctctatggcaagtgtaacaaattaccaaaaactgggtaacttaaaataacagaaatttgtcacctcctagttttgaaggttagaagtccaaaatcaaggtgactgtggaactttccagaagcttttggagagaatctttccttgcctcttttagcttctggtagctgctggcagtctttggcttgtggcctcattgctccaatctgtgcctctatcttcacatcgatttcgtctctgtatgttttgtgtgtcttctattcttctccttgtgtctgtccccaaactccctctgcctctctcttataaggatatgggtgattatatttagggtctaccagataactcaggataaatgcatcctctcaagatccttaacttttttttttcatgtactttaagttctgggatacatgtgcagaacatgcaggtttgtcacataggtatacatgtgccatggtggtttgctgcacccatcaacctgtcatttacattaggtatttctcctgatgctctccctccccttgccccccacaccccaacaggcctgagtgtgtgatggccccctccctgtgtccatgtgttctcgttgttcaactcccacttatgagtgagaacatgcagtgtttggttttctcttcctttgttagtttgctgagaatgatggtttccagcttcatccatgtccctgcaaaggacatgaactcattcatttttatggctgcatagtattccatggtgtatatgtaccacattttctttatccaatctaacattaatgggcatttgggctggttccaagtctttcctattgtgaatagtgctgcaataaacatatgtgtgtatgtgtcattatagtagaatgatttataatcctttgggtatatacccagtaatgggattgctgggtcaaatggtatttctggttctagatccttgaggaatcgccacactgtcttccacaatggttgaactaatttacacacccaccaacagtgtaaaagcattcctatttctccacactctctccagcatctgttgtttccttactttttaatgattgccattctaactggtgtgagatggtatctcattgtggttttgatttgcatttctctaatgatcagtgatgattagctttttttcatgtttgttggctgcataaaggtcttcttctgaaaagtgtctgttcctatacttcgcccactttttgatggggttgtttttttttctcaaaacttgtttaagttccttgtagattctggatattagccctttgtcagatggatagattgcaaaatatttctctcattctgtaggttgcctgttcactctgatgatagtttcttgtgctgtgcagaagctttttagttgaattagatcccatttgtcaattttggcttctgttgccattgcttttggtgttttagtcataaagtctttgcccatgcctctgtcctgaatggtattgcctaggttttcttctagggtttttacggttttagttcttatatttcaatctttaatccatcttgagttgatttttgtatacagtttaaggaagggggaccagtttcagttttctgcatatggctagccagttttcccaacaccatttattaaatagggaatcctttccccattgcttgtttttctcatgtttgtcaaagttcagatggttgtagatgtgtggtgttatttctgaggcctctattctgttccattggttatatatctgttttggtaccagtaccatgctgttttagttactgtagccttgtagtatagtttgaagtcaggtagtgtgatgcctccagctttgttccttttgcttaggattgtcttggctatacgggctcttttttggttccatatgaaatttaaagtagttttttctaattctgtgaagaaagtcaatggtagcttgatgggaatagcattgaatctataaattactttgggcagtatggccattttcaggatattaattcttcctatccatgagcatggaatatttttccatttgtgtcctctcttatttctttgagcagtggtttatagttctccttgagtaggtccttcacatcccttgtaagttgtattcctaggtattttattctttttgtagaattgtgaatgggaattcactcatgatttggctctctgtttgtcgattattgatgtatagaaatgcttgtgattttcacacatcgattttgtatcctgagactttgttgaagttgcttatcaacttaagaagattttgggctgagatgatagggttttctaaatatgaagccatgtcatttgcaaacagagataatttgacttcctctcttcctatttggatacactttatttctttctcttgcctgattgccctggccagaaattccaacactatgttgaataggagtggtgagagagggcatccttgtcttgtgccaattttcaaagggaatgcttccagcttttgcccattcagtatgatattgtctgtggttttgtcataaatagctcttattatcttgaggtatgttccattaatacctagtttattgagtgtttttagcatgaagcagtgttgaattttatcaaaggccttttctgcatctatggagataaccatgtggtttttgtcattggttctgtttatgtgatggatcctgtttattgttttgcgtgtgttgaactagccttgcatcccagggatgaagccgacttgatcgtggtggataagctttttgatgtgctgctggattcggtttgccagcattttattgaggatttttgcatcgatgttcgtgagggatattggcctgaaattttctttttttgttgtgtctctgccaggtttttgaatcaggatgatgacggtgtcatagaatgagttagggaggagtccttttttttctgttgtttggaatgatttcagaaggaatggtaccagctcctctttgtacctctggtggaattgggctgtgaatctgtctggtcctgggctttttattttttaattttttggttggtagtctattaattactgtctcaatttcagaatttgttattggtctattcagggattcagtttcttcctggtttatgtgtccaggaacttattcatttcttctagattttctagtttatttgcgtagagggttttatagtattctctgatgatagtttttatttcagtgggatcagtggtgatctcccctttatcgttttttattgtgttgatttgattcttctctcttttcttctttattagtctggctagtgatctatctattttgttaatcttttcaaaaaaccagctcctgaattcatttatttttttgaagggtttttcgtgtctctatctctttcaattctgctctgatcttagttatttcttgtcttctgctagcttttgaatttgtttgctcttgcctctctagtttttttaattgtgatgtcaattttagatcttcctcactttctcctgtgggcatttagtgctataaatttccctctaaacactgctttagctgtgtcccagagattctggtacattgtgtctttgttctcattggtttcaaaaaacttacttatttctgccttgatattgttatttacccagtcatcattcaggagcaggttgttcagtttccatgtagttgtgcggttttcagtgagtttcttaatcctgagttctaatttgattgcactgtggtctgagagtctgtttgttatgattttcattcttttgcatttgctgaggagtgttttacttctatttatgtggtcgattttagaataagtgctttgtggtgctgacaaaaatgtatgttctgttgatttgaggtagagagttctgtagatgtcaattaggtccacttggtccagagttgagtttaagtcctgaatatccttgttaattctctgtctcattgatctgtctaatattgacagtggggtgttaaagcgtcccactattattgtgtgggagtctaagtctctttgtaggtctctaagaacttgctttatgaatctgggtgctcctgtattgggtgcatatatatttaggatagttagctcttcttgttgcattttttttgctttcaatttgcttgataaatattccttcatccctttattttgagcctatgtgtgtctttgcacgtgagatgggcctcctgaatacagcacaccaatgcgtcttggctctttatccagtttgtcaatctgtgtcttttaattggggcatttagcccgtttacatttaaggttaatattgttatatgtgaatttgatcctgtcgttacgattctagctggttattttgcctattggttggtgcagtttcttcatagtgttgatggtctttacattttggtttgtttttgcagtggctgctaccagtttttcctttccatatttagtgcttccttcaggagctcttgtaaggcaggcctggtggtgacaaaatccctcagcatttgcttgtctgtaaagcattttatttctccttcacttatgaagcttagtttggctggatatgaaattctgggttgaaaatccttttctttaagaatgttgaatattggcccccactctcttctggcttttagggtttctgcagagagatctgctgttaatcgaataggcttccctttgtgggtaacccaacctttctctctggctgcccttaacattttttccttcatttcaaccttggtgaatctgatgattatgtatcttggggttgctcttctcaaggagtatcttagcagtgttctctgtatttcctgaatttgaatgttggcctgtctttgtaggttggggaggttctcctggataatatcctgaagtgtgttttccaacttggttccattctctcctgcactttcaggtacatcaatcaaacgtccgtttggtcttttcacatagttccatatttcttggaggctttgttcattacttttcattattttttctctaatcttgtcttcatgctttatttcattaagttgatcttcagtctctgatatcttttcttcagctttatcaatttggctattgatacttgtgaatgcttcacaaagttctcttgctgtgtttttcagctccataaggtcatttatgttcttctctaaaccggttattctagttagcaattcctctaaccttttttcaaggttcttagcttccttgcattaggttagaacatgctcctttagctcggaggagtttgttattacccagcttctgacgcctacttctgtcagttcgtcaaacttattctttgtccagttttgttcccttgctggcgaggagttgtgatcctttggaagagaagaggcattctggtttttggaattttcagccattttgcactggtttttcctcattcttcatggatttatctaccttcagtctttgctgttggtgaacttcggatggagtttttgcatggtcatcctttttgtggatgttgatgctattgctttctgtttgttagttttcttctaacaggcccctcttctgaagatctgctggagtttgctggggttttccgccagactctgtttgcctgggtatcaccagcggaggcttcagaacagcaaagattgctgcccgttccttcctctggaagcttcgtcccagaagggcacccgccagattccagctggagctctcctgtatgaggtgtctgtcaactcctgctgggaggtgtcagggacccacttgaggaggcagtctgtcccttagcagagctctaacgctgtgctgggagatccactgctctcttcagagcctgcaggcaggaacgtttaagtctgctgaagctgcgcccacagctgccccttctcccagttgctctgtcccagggagatgggagttttatatataaacccctgattggggcttttgcctttcttttagagatcccctgcccagagaggaggaatgtaaataggcagtctgactataccggctttgtggtgctatggtgggctctgcccagtccaaactttgtggtggctttgtttacactgtgagaggaaaactgcctactcagtcctcagtaatggcatcccaggtcgacttcagactgctgtgctggggcagtgagaatttcaagccagtggatcttagcttgctgagatccatgggggtgggatccactgagcaagaccacttggctccctggcttcagccttctttccaggggagtgaatggttctgtctcgctggcattccaggtgccactgggatatgaagaaaaagctcctgcagctagctcggtgtctgcccagatggccacccagttttgtgcttgaaacccagggcccttgtggtgtaggcacccgagggaatctcctggtctgtgggttgcaaagaccatgggaaaagcatagtatctgggctggatagcaccgcccctcacagcttcctttagttaggggagggagttccctgaccccttgcacttccaggatgaggcgacgccccatcctgcttctgctcgccatccttgggctgcacccactgtctaaccagtcccaatgagatgaactgggtacctcagttggaaatgcagaaatcacctgccttctgcattggtctcgctgggagctgcagaccagagctgttcctatttggacatcttgcctggggagtctttaagatcctcaatcacattttttccatataaagtaatataagttaatgttcacagattccagggatttgacgtggacatatcttttgggaaccattttctgatcttccacaaaggatatccaaccaataagtgacagagctgagatgattaactgaaatttaggtatcttgatagacaagcctgtgttcttctaatcctgtagcaaactacccctatctctgctctagaataaatttggagaccagtcaatgttacgtctacattttggaagttaggaactgagtccccaaaaggagagatgttttgatatctggttaagaaatattaataacaaacaaaaagacaaatcagattcacagttaatatagcaggatggtttttcccatttctctttaaggaattaaggattttgcttggtatattttattttaaagacttctggatattgtttggattaaactaagctaaaaataatattttattttattatgcattttagtgagcttattatcagtaatatgtttagcataaaatttattagtgacatgccctttaatttagcctaattggtactaatttagttagattgcattaaattacaccatttaatgtagttatacgtgggtcaagaaatttatttcaagaacttgggtaatgtttcatgaaactgaacagtaaaaaacggcatctaggtggctgaaaaatgcaatgttccaaaataatagttttcctgaagtcttgttagaaaggcacacagatcttgtcttccatctctactcattttcccaatctgtaaaaattagctaaagtataaatcaggaaaaggggactgacgctcataaggatactggaatctttacagacgatccttgctccagccttcatttctgattcactgtgttagggagcaaataacattgaaaaagagaaagaggctgttttctatcctcaatctttatgtcttcctttttggattttgttggttaggtgatggaagtatgatgctattgatatttccccctcggtggtataaagaaaaaagccaatttatgttcagaaaacacatacacaaaaacaaaacactttgccaatgtgaagcctgagccattttctcagactctgctttaaccaccatgaaccaccaagaggtttgggtgaggttttatgaagacataaagatcaaggatgggaaacaaccattttttttttatttttttgatgttatttgttacttaacatagcaaatcagaaatgaaggctgggaaaaggtttatttgtaaagattccggtacacttacaagtgttaatctccttttcctgacttgtattttagttagtttttacaggttgggaaaataagcggagattgtctttcaggggatctttccttgcccacttgttcctctcatttctgttaactctgtcagttccaaacatctcctatagacaactaaatggttgctgtaacactactggagctcattctagaacttaataaccatcccaagatatgatttttttttagcttgtctctagaaggaagcattgccttggtcttgaggggaggtggatctgcaataatcctaatttgacccataggtggctttttctgcagtttgccttcagatagctaacaaatgagggcagacttgcagaagtatagacagatttgacagagacagaacacttctcttaaggggacctgtgagagtacaggtgaaccaagcatcagattctacaggccttttgaactaagggggcatcacacagtattagcagtagccctgggtctctccatgtgtttgcagcacaattgagctgctgcctctcctccttagctttctatagttctgggagcaaatgccccacagcccaactggttttgccattttgcaagttagaaactcaagccttcagtgaatttcctctccagtggctgaggagataccaacatggctagggggtgacaggagttcagagtagattaaggaaacttccctaatgccagagaacttggaaggtgtgccagccattgctgtcaatgtccaacaatgctgccacccctaagcagacaggctgtgagtaccacctggttactgccactgcctttttgggtctcttccttgccagaggcagctgaggtaatgtctttgttcagcccctagtgctgagctcttgtgttactgaacccacgactcaagaaaaatgggacttaattaggaaaagctgcagggagccatcaaagtgtcagcagcattttgaaggagagacaagaggaagttggggatactctggagtcggaaaggccaaaggatagtgtacaggctggcagcattatggcaggggtgcctgtgttggcaaaaccccagggctgaataccttgatgaggtgaagcgttccccagtacctaatgctacggtgcattaaggatgagatagttctcactgagtactgttccttgtaataataaaattaatttgaccatttggaacaagatttataatgggcctcatccaagcctctaaatatgcatattccactttggaactgtacataattgctcaattgcacctgcaaatcatgttgttcgctcactaattattcaaatagtgggggcaattccacaattgtgtatgtaattgtgttaattgttaatgcagttaggtacaggtgcaccgtgactaattacacatgcagaagcggctcccaaacggctcactgtctccatgcacgggctgcccctctcggagacagacataagtgggtgacacaaacaaagccataggccatcagtgggggtccatctggcaagcctttcacttgggagccgcatatacatttgggaaacaatcaggtctttgactgaattcagctgtttttgctttcgcttctcttgctcccccccttcccccaaggcagtgagaggcttggggcaccgggctcctgagcttgtgtgagtatgtgtgtacgcatgcgcatgcacatatacacagagtcacacagaaactagtttgtagggctcgctctactcatctttttgctgatagttcccttgcctgatgagattagcttttagtcctggattttattactatctttctctgtcatccatatggtttcaggaatcaagtttatctgtacccagtatcaggatattaatgccattttcagggtaagagatgcagcctgggaggtgaaatttaggtgatttctgggacattcttatggcttatgtcaatgggaccagaatagggactgctgccacatttatactttacctatttcctcatttcttcacccaggtcggcctcattttgtggcttggtgcacagcattagtaacagccttcctggctacaagacatgtctgaaaactggtgaagtagctcttctgtgtctgtgggtcaggggctggttgcatatctcatgctgtggaaggtatgctatagatatgttccccaaattttaagactgacttctagcagccatcaacatgtacttattgttttgactttgtgctctgtaagcctagctctgaggaactggctctctcataagaataccctccctgctataaggaaggcaggtcagctgtaaaaaattaattagcactggcttggaagctcaatgccaaaaggaaaataagccacacttaagacaaatcagtctgtgactaaaaaaggagaatattttgagggagcactgaagttacgagtaagggaatccacgcaaattggcctcatacaggtagaagcaattcactctgcatcactgttggacaaggaacagaattgactcacttcgtacccaggtctctgtcccagcaaggtgcccaatgtaacatagggataatgtagaactcacatcacaggatcgttgtgaatgttaaatgagataatctttgtagggcacttagcaccatgcctagcccatattaagtatttagtaaatgtgactgtatcattactgtcattattgttattgctgtaattatttctactgttgtccttttactcaataaatatggaaaattaaccctgcactgctgttgcctccccaccccaccctggccagtcattaactctgccctcctgccattgagtattgttcatgccttcctcttctcattttctatagtctgccttgtagtacaggcattcatgtatttgtcttcacccactaactaggctatatgactgaattaatttgctagggctgccataacaaagtaccacaacttgggtggcttaaacaacagaacttcattgcctcacagcctggaggctagaattccaaggtcaagcttttggcagtgttagtatcttcggaggactgtgagagaaaatcagatccagatctctcgttggcttgtagatcgccatcttatccattcttgtgtccgcatatccccttccctctatgcgtatctttgtatacatttctacattttataaggccaccagttatattggattaggtcccagcctagtgaaatcattttaactttattacctcagtaaaggccctataactaaagaaggtcacactgtgaggtactgggggttaggaattcaacatgaactttgggggaactcaactgaacccaaacaatcaccatcaacaatatagtctgcattttatttgtgtttgaaactcctacaatgatgtccagtacagtgcctggactatatttgaagaagcaatgggcctgatgtggtagaagttgacaggcctgggttctaatctcttttctccccacccacggaccagttagccagtctgagtctaattctctatctaaatgtgaggctcctcattcctaccttaatgggagtaataagcactaatgattatatacatgcaaagtacctgcacatattagatgctcagtaaagttagttattactcaaatttttgctgagtaaactaacgaacaaataatgtctgtaggagtgattgaaacctacatatctagtcacaactgttggccagaattaagtttttaacatctttcttaagttggcctctttttcatttcctttcatggttttttacctagtccgtgtgtaatggaaagaaattaatgcactggtttggaatggtgtgagcagccagccaactttatgaaccaattttgtgaggaacaatcaacattgcggctgtgtgtgtgtgtgtgtgtatgtgtgtgtatacatacgtttatttggacagtccaagttgcctttttaggtgtgatatttaatttgtgaattggaaaatccagtttatcacttcaaattaaaatttgtctattaaacttcagaaatgtatgtaatttgtaagaaaatattcccaatgacaacactatatctaaggccatgatgtccagtagttaggaaacagaaaataggcacttgtccagaaacgaggagaattcaaagttcacattgacattgttcttcattatagtttcagttcagtaacacaagagtgtcaaaatcaaatccaatttccttttgcctgctcgtctcaacattgcaacagtggcttaatgtgcattatttgctacttggttgacatagatgggaaaatcagtaacaccaaacagccaacctcataatcactgattttttcacactgtgtcagttgcagtaaatcacagagatatagatacgtatatttgtcatgttgaaggtgattaaaagatgttgaatctgtaatcactacaatgaaagagattgtcatcaataaaaagactctagagcaagggagttatattgatctgagcacaggaatttgcaaactctctttctcagtatcttgcccttccagaactgtaaaagatacagtagcacattttgtggaagaaggttcatattttagttcagagcacttttttcattttcagcttccaggtcctaatgtggaccttctcagtggatggctacattgtcattcatgttatctaaaagttgatctatatctccctactaagctcagcttccatgcatttggctgcacatcctaactgggttaggcatcatggaaaaatcatttggaggagagagggagctatagagactgtttattttcattcagaattatccactggctgcaattggtttcatactaattctataaagcagtatagaattgtgagtaaaaatgcatactaaacaacttaatgcaataaaaatgaagcaagaacactgtacttacattaagttttctcttttcagcagttacatagagccacgtatcaagaacatatgtctgtgtgggcccccattaatataaaatttgcattattgcaggtcagagggtccatcgctatttatattggggcctaagccaacattatgtgtgccaagtctgtgcaccttcccactgtcctgcctctgttctcaccaccctcttctttatgcttgggtggtcatattttgaaatttccccaggaccagtttatcatgcagtcacgtttctcatcacatctgaaggatgttgtgcttcgcatggtaatgaggccctctttgtttcagctgctgcactgctctcagtaactcccatcagttcctgcagtctgagggctagtgctgtgatggtagcgtgtggagggtctctcagggaaaacagcttgcttattacttggttgggttttctaaaacagatttaaatcagtttcaggttttaagctgttatgtttactctggttttttaatgcatgaaaacaatttatgagcatcagttgcaagccttgggtggttatgtttgtccagattattgtgcccatgtatacaactcactgcatattttcaaaagaggctgaaccaagttaccgacactcacttgaacatgttctaaataaagaaatgacactcctggatggcattaatttatttacggatctattaactgtgatagtgtatttctcaccagaattgctgaagaatattattttctgtcttctttcaaagtgattattatttggtttcaaattgctttaaattgcatccaaagaacatgtttcctccatagagatatagtctgtcaattttataaaatatgtgcccatgccttatctcagctaattaagcatctagtcctgcaattcttatctagacccaaggaaattatgagaatttgatgcagtaaaaggatgacaggattgagtttgttttcccattagctgattataccacgattccaacaaaatctatgtcccctgaatttggacagaaatactgcctattaccaaagataatgatttcactgaaaaactctctgagatcttatgaatcacacttgtaaactcatataacatagaagccagaatagaccaaatacactagagagggaatcaggacccttcatttcatagtgaggagactttagcccagagagcataggtgattcaccaaaggcacacaactaggtaaattaaacttgatttaaaaaatggaccctaactgccagaataaatagagaggtatggtccctgtaatatattttgaggctgtcaaaggttgccttgacagaatggagaatgcttgacaggccaacatttaccaagtgttcttaatgaaggaataccatgttcccctgaaaggaatcatcaattgtagagtattataaaatgactttctcttggcattgttaatcggtataatcaatacattttatctcaatttacagtcttacacatctgggaggggtgcaaaacctggaatacctgcttttccagccttttcaattcataggtgaagaacctgacagagatctaaagagggggaagtataaccaggatattctgacctcagctgctgggctctttattatgggtcacccctcttctttcacagtaaacctcccatttaaaaaatggcccattatgagatttacttattgtccaacttagcactctgaaaacagagagctgtaagaataagtccattgatatgttgaattgcccaaacagtggtactggttgtcaaatggttagcttggccttgctggtcagaacggcaattattaaaaagtcaagaaataacagttgctggtcaggttgtggagaaattagaacgctttaatactgtttaatactgttggtgggaatgtgtattttttcaaccattgtagaagacagtgtggtgattcctcaaagatctagaacaagaaataccatttgacccagcaattccattactgggtatataaccaaatgaatataaatcattctattacaaagatacatgtacatgtatgttcattgcagcactattcacaatagcaaagacatggaatcaacccaaatgcccatcaatgatagactggataaagaaagtgtggtatgtatacaccatggaatactatgtagccataaaaagaaatgagataatgtcctttgcagggacatggatggagttggaagccattatcctctgcaaagtaacacaggaacagaaaaccaaacactgcatgttcttacttataaatgggagctgaacaatgagaacatatggacacagggaggggaacaacactcactggggcctgttgggggtggggttgggggagggagaccattaggaaaaatagctaatgcatgctgagtttaatacctaggtgatgggttgataggtgcaaaaaatcaccatggcacatgtttacctatgtaacaaacctgcacatcctgaacatgtaccccagaacttaaaataaaaataaaaagattgagggagcattttaaaggagaccaaattgcaaggtctatgcactttgaaagctttgggagataatactggaaagagcaggttttctctcattagagctaaatggaaccaaccaaccagtagttagtccattagacagaactcgtgagaaatgcagcttttgaaaaattaagctttaaaattcccataaggaggacccattttaccattaaattgtcaattgcaggtcaatacatattattctatgtatactctcacatagactttcacatatgcagagagaaacactaaagttgctatattagtctgttctcatgctgctaataaagacataccccaaactgggtaatttataaaggaaagaggtttaattgactcacagcaccacatggctggagaggcctcacaatcatgatggaaggtgaatgaggagcaaagtcacatctaacatggtggcaggcaagagcatgtacaggggaactccccgttataaaaccatcagatctcatgagacttattcactgccatgggaacagcacagaaaagacctgtcccccatgattaaattaactcccaccaggtccctcccatgacatgtgggaattatgggagctacaattcaagaagaaatgtgggtgggcacacagccaaaccatatcagttgcaaattcagaaatccatagcaggtcaattaattgttttaaaacttccgctcttgaattacttgtctttattcaacagcctcaagataatcttagcttctcatttgatttaatctgttatgcaaaaaatagcacgaagtcctcttatggctgttttaatcagttgctttttgagattttataaaatagccaattgagctccacattgtattttttgtatgattaatttgaagtgattgtattggccatagtggttatgaatgcaaggaaataataatcttatcttgcttatgttactgagccgggtgtatataactttatgctcatcagagcaatggacaaattgggctcatcgaactgcaacttacattttcatgatcattccattgtattatattggtacaacaaaggaattttgcaaaataaaaataatgaaacatcttatatttcagtagtggctactagatttatatatacatataaatataaattcctatttgataatatagttgggaaccagtttttttgtacagtgattaagaacatgggtttgaagtcttacagacatggttttgtttcttggctttatcacatattaactgtggaaccttgggaaaattactgagcctctatgaacctcactttcatcatctacaccatggcgacaataatgcctgtagcttagagttgtcatgtagaataagcaagttaaaggataggcctggtacacctaaatgctcaaaaagcatgtcctataaaaataaccatttatatacaaaaattagccgggcatggtggcacatgcctgtaatcccagatattcaggaggctgaggcaggagaattgcttgaactcaggaggcggagattgcagtgagccgagagcgtgccactgcactccagcctgggcgataagagcgagactccgtctccaaaaaataaaaataatatataaccattcttatgactgttttaacacaaaagtgataacaaagggccttgctgacacaagttattttcatttttgtaccttacctttaactcagtatactattaatcattcagttgggaaaatagttatgtaaaatggcagtgctaagagggtctttatatagaattctgtgtgccctggaggcatttgtgaaaaagtgttttctctaggatggactaagcctgaaggttactgttaggctatgatttggctgatggcatataccacaatgcctaattagggaaccccattgaaagcgatcattttctctttgatgtggcctttccatttaaaggttgaatattagggttacatgaatgaaactagacaaaaaaagaaagaaagaagacaggaaatttcctacactttcagaaacacagctcacagacaaccttaggaaggaggcatgcctgggtcctttacaggagtggggcatttgcagctgctctaatgtatatctccccagaaattaataagtactattattttctgcacttaaatcataacttacaaaataggtttattcatccaactttctcttctcaatacttccaaattgctagcattatattttctcatctccttgttttgaacatggctatgacctcctacacactagctaacctcacctctacagctaaagattctaaggaggagctgcagccctttgcctaacataacatacctggcactaggcaaagctgtattctgacttctggatggtccagtctttggcagggtgggtgggggagggcagggcctacactgctgggtaactggagagcaagtgcatcaaaaaggtgcccacagactttgcctcccttttatgtaacttctgttcttgctttcacactgcttttttggacatctttttgtcacagctttaacaattaccccatcatcacagtatttagaattttttgaagagatactatgttttcagaagatactgttttcagaagtaaggtggggcacaactcctctcctctcctccacccctgctgcttcccaagagaatacagaagagactttgtaggacttccaatagaagaagctcgattagagcttcttgagttgctgaattaaatcgtaatcaattcaatggaaccaaatggaatcatgaagtaacaaatcccctgtcatgagagtcatgtcagcagtacttgtatgatatgatgacaggacttggattgatcagatggtttaaggttaatcccataccttccattcacatggttatgtgaccttgggcaaatcatttcacctctgtgcactgtatttgtcctcatctttaaaatgggacagaaggtagaaggctggagtatataatccccggggccttttctctgtcaggagcctgtataggagatgagagtatccactcatttctggacaagcaactcaaaagtattccattgagaatgaacaagcaacattagctttgcatgtgaatgatggcacatttattatcagatttatttcatgtattacctgtccttcccctccctgtcttccaacagatttagtagatctcagtcagttttaatgctttcggcctctgctgcacctgtagtaactgtctgccagaggcagccctttttcaaagtccctatcttactgtaagtaaaccagaatttctaaagatggaagggttgcccctgccaactctatttcactgtttctctatttcttgaaaggagcaatgaaagggagatggtatcccatgttgaataagcaagtgtctgccttcattccagccttgtcatggctccagtaagctcatttcatcacaaatttatgactcctaaaatcaatattgactgtggatgttggggggaggacaattttgagggcacatctgaattaccagtgaacccataggaattcccttcagttgggtgaaaaatgatcaagaaacaaaagctaaaggaggagtcaaggagtacagcatcaaggtgctgaactcattgttaaacctgagtccttagtgcttagcaactctgaagtcctggatggaggaaagacttggtctgtttgtgataacagcaggtgctttccaaggtacagactgtctgagtcattgtagaggcaacattctctcaagatcttcttcactttcaagttttcaacatgccattttgcaggttcctttttagactatcagtattttgcctttgatgttgatggtcagcttggaatttgtaataacattatttaccatataacagggataaataatctttcatcttgcagaggcaggggtggggggttcatggcagtttatcaaattgtctcctggattgctatggctctagtgggaactacatggataaatctatgttaaacaacagcagcatgaaatagtggaagaaacactggattgtttagccaaaaacccaggggctagtctccaccacctctgactagccataaaacttcagacaaatcatgcaaccttttgaagcctcgcttctttttcatcttaaaaaatgaaactcattttatcttatttgtctacttcagaagattgttgtaagcaacaaatgatactgggagggggataacagatggagacgatgtgaaaggactttgtaacctggcaaggactctaaatttccaaggaatgatttctattagcgatggtcttagtagcagtaattgaagatattctttatatcatcctcatatataaattccctcattcccctttgttttcatatgccaccagggttctgttcttaaagttttgaattaaggggtaaatatcttcactttaaggatttaggagatgtctctcatggggttagattatcatttataaagaactgaaactgaggatctggaaaatgctaattgtaaagcttatcattacagagtagatgttagatgctgccctgaaactttgtagcatcctgataaggtataatgctttccttttcagcatagattgcaaaatgaagggtaaaacatttagaaattaataaagcatatttataaaaaatatacctggccatgctcagtagatcatgcttgtaatcccagcactttgggaggctaaggctggcagatcacgaggtcaggagatcaagaccatgctggctaacacggtgaaaccctgactctactaataatacaaaaaaattagccaggtgtggtgacatgcgcctgtagtcccagctactcgggaggttgaggcaggagaaccgcttgaacccaggtggtggaggttgcagtgagccgagatcccgccattgcactccaacctgggcgacagagtgagactgtctcaaaaaaaaaaaaaaaaaaaaaaaaaaaaaaaaatatatatatatatatatatatatatatatatatatatatacacacctaagtgtcagactagataatttcaagattagtgtgatcataataaatttttatttaccaaataccctcagcctagagcttttcaggtaaccaattaaatgcacactaagtattactaattgcattatttaaattggtatactattttaggtttagaaggtccctcttcttcatgataatgcattttcatgaagaaagaccttaaagctgattctaagatcttcaaataacacatcatagtgtagtatatgttggtgagtttatttatcttgagttgggagcttttatagattccagctatatgtcttcaccacaaatcttgttgttgttgttgtttttgtgctgatggcatgagtgagaataaatggaatttgtggagtctgtgaaggccactggagggaaatttcccaatctcctaatatatcagtgtctcttcctgtctgtttctgatggggtcctacagcaggtcaacatccttaggtaaagaaaagcttcctaagagttagcagcagtcattgaaagtaaattaatgaaaccctgcatctgctgatctatttgacaagaagaaattctggctgccaacagttagaaaccactagaaataatctccattggaaaccgggcttcgactttctgccctgggctgcccaaagtattgcattagacaatgcgaaagtaagttgaactttgaattataatttcaatgactgtctagcgaaatggattcatgctctgacactgcacctttgaggctgtgggttggttcacataagataaaaatctgtctggcctgacagttgaaaaggtcgcaagaacgcttgatgtctgatggtctcagtgtattgccaaatcttgattaaaatggaagacttaggaacaattatgtttttttctttcaaaataatcttttcaaacagagccatttctacatgttttggcttgaaatttattgacttagcaaagtatcgattatattttcactaccatttagcaataacctcatacttaacatgaagctctcacatagttgagatactttggccttggggcaacaggttatttttgaaaatgacatctaattgtcattgtagtatgtttggtattaaaaattgaactatctacattttaatgcttccactttagctctaaagcacgttgcctgtcgtctgttttcgttatgaaaatacttgcaggaatggcttaacatttttacttctgtagatcatgcaggctctgtacctgtgaaatgtgtagcttttaattttagattagagacttctactagctagagattaacacaagttgaatctttcaaattaatctgcttttgggccacagattgacagacttaacagacacgagtcaccttaaagactggattctaagccaacccgcttgttttacatctgggaaaactgtgacttgcccaaagtcatacagtttgtcactgaaccaatagagtttcttcaagacagtcagttcaagtatattaaacagtatctcatgaagtgctaaaggaatcctgagggcagggacaaagtgttacatatagatgtccaccatactcagaggaactctgttcagattaatctaccacattttctgttcttagccaattacatttcactatgccaaaaataaagtactttcaggaaactactttctgtcttttccaaatgccaaagtcactctctatctgaattttttctcttattcaaagttaaggtcctgtcttacttccttgcttgaccaccagatccatggacagtttttcctttcgtgactttctattaaagttattgtcagagccatgaatctggctttttaaaatatgatcaccacataaactggatttccaggatagccctgatttcaattcattctccccataaattggtattctagaaattcccatatttggccatgtaaatcacgtcatgcaagctgactttggtacccactgaaagaaaattttttttctgccaatgtgcctcatttagggatcaaaaaaagatatctgctaacatgcactgtaattcctcactttagatatgcaggtcttgtctactcgtctatagtataccctccctgtcttagtctgtcttgtgcttctataacagaatacctgagactgggtaatttataatgaacagaaatttattggctcacagttttagaaattgagaagtccaatatcaagatgtcagcatctggcacaggccttctttctgcattataacatggtagaaggcatcacatggaagaagttggaggttggggagagagagagagagagtgagagagacagagagagaagcagaaacaaaagagtgccaaacttgtcattttatcaggaacccactcccatgataatgacattaatttattcatgagggcagagcccccatagcctaatcaaccctaagggccccacctctgaatactgttacagtggcaattaaatttcaacatgacgttttgaaaggacaaacattcaagccatagcactccctgtggacagccattgtttatcatgtactgcattttacctaatgcttagcttagtgcactgtgcatactgagggtgcaatgcatatttgtcatttgggattatttcctttacatgaacagattttccaaacgccaaatttagaagtactgcaacacattaattctggtcaagagtaggtctggttagttcattaagagtttattttatcagtaatgtgttgtgcttgtacctgaaattataaatgcctgccaggtatctgtttatcctacatacttccacaactcagaaataatcaataccttgttttcttgtggatgcgagaaaagttaggatcactgatgctgggtatatgctgtccacgttaattggcatagaccgttaggcttcataaaccatggtacaccatgtatcactccttctttgatcttcagcataaaattcaatgggcttgagatgctccacagagctggcccacatttaatgtcacagaccctttatgacacacactatgtctatttcaggggtcagtttttgcagagtgattttctggaaaagtgccatgcccttccatgagccaagaatttcagtgtctcataaatggtggacagacaggaccttggggccatctctccagctaacagaagatactaagtaaggcccaggggaagtttaagaaacaaacttcttgtgtttgttctattgattttcttgccaacaagaagtgtaacaaattgtgatgtttccaaataaaaagcatcaggaataagctccaattttattgagtgatttcctggacacacatgcaggtgcattttggaagaggctggatatagtcagacacaggtaacaaagccaggtcacttaacaaagcaggaaagataagggccacggttgcaaatcattatttataatcaaacaaaatggtaattttgccaacactcccttctcaaatataagatcatcatcatggtaatcaaactattactctgacacagtttacttatcaggagaacaatctgagattgatgacctgaaaatggaggttgtctttcaattcatttgaaatgcaaaccgagtggacaacctatacctactgtggcatatttttaaagcaaaatcaggcacctacattgacctcctatttacatttctttgagaagaaaagaaaatcacataaaagctatcaagaaacacatttcacagcaggcaaattaattggttttacagtatttgaatggagggtttgtcaaataaaacatgccatgacagttaatagtgtcatttagagccagaaaattattggcttatttgttattggataaaaggaaggcaaacattttgtattagaaagttttaatgtgtttaaaatcctcattagggattaatggacatgcttgcttagcatagcgcctcattaatttgaggctaaacagttacttctgtgtttcaatctcagtgttgtttcttaacattttttttttacttctctttaattagatcttgcatttgagtttggtctctacaccattggagatgtagatttaattaatgagatttataaatctaatgaaagtgagttattcttagctatcgtttcattttagtgagcagttaaaccacatgtaagtgggcgcagatctaagagatttcagaagtacagaaaaaatgtgaacttccctgaatatatttagctgtgtcacttggcattaatagataaaagtgttttaattagagtcataaataataggggagctggcgaggattcagttcccatgcacatggcttgttctttaggatcatcactgtcaaagaagagcaattgtaactctgtttctgtggaatttcagtgtcatccactggcaattaagacaatcctaagtgcggagtatagagagtcaataaggcgccaagttcgttagaggttagtacaaaagtagagccactttctatcaagtgtattctgttgtcactgttttattgagggcatctgtgggtacgatttataaagtctattccatttacattgctttaagaggaatttagttaaaggaaaaactgatatctgagtttttggttttcaaaaagacgtttaaatcattagttatttatttgtaagaagaccattgtagtttctttagggcgagggattgtgaatgtcaaggtaagtccttttttttctaaaagattttcaaaaaataagagccaaaggtacatatttaaaagcttcttttttaaacggggttatggaacttaatttaagaccccataatatacctgtggcaatgccttcagaaattaccagaaaaaactgaactcccactttttttttcccatgaggaagtccttgtatcttagacactgtaaatgatttgaagaacttgtcagtccaagacacataaaagataatcgtattttaaaatactacatgatagcaatcacatattaaatgtgtaaaatgcttgcttgaatacaaaatatttcaatgattaaaaatagctcttctttaaacaattcagaaactccgtctaatgttctaaaggaatgatttctctcaggaggatatgagttaatcgagttctctgtgctcccaaagagacagagtagcattcagttaggcccaggggagatcctcaagccttggggcttaaatttggccctgggcttaatttcatctggccttctggataatattacaggagtcactacggtggagtcctggtcattagtcctactcctgcgctttctgcttattgcagtcagaatgaagcctcttctagattagagcatttggagaactgtgaactatggttaattaatcagtgttggaaaaagcagaagctaacagtgaggagcagtgtcaccttcttccaaatcatcagagctacttggcctccaactcccttctttctccccgcctccttatcccttctattatacttccctagcaagtctatgatccatgtttctgttttcgaagacaactattccaacctttcttttctcttccaatttccagtaaccacaccccactctcagctgatgatcttgccgcatacttcatagagaaaaataagatacaatcagacaagtaccatgtcatcttctcatctttaatttctccaacccagctgcttatgtacctaggcactctgccttccctcctgttacaatggaagaagtgtacagaagtgtccatgttcctatttcaggccaacctcttcagttgtgtcttgatcgactccctccttatcaaggactttgcttttacaatcatccagtttctcttttgccacactttttccctcttcactgagttctacgcatcaagtatataaatatatcttaatatcatccctcttataaaaacaaaaccaaacaaaaaccttgactccacatcaccactttatattatttcatttctccacctcctttcacagtaggaattgtttattcactctctccacctctgccccttccactctctcctcaatacacaatcaggtttacatccccaccatgctgctgaaacagctatgatcgaggatacaaatcacctagatattgctaaagccaatggcctattctgcagcctcatccttatttaatgaccagtttttcctggaagcactttttcttctaggctattgtgaccccatgcttgcttccatacacactttaagaattcatttttggctttggaatacatgacatgtcatagataatatgctatgctatgcggagtgtggcctcctggcaaaaggactactacatatagcaaaatacataaaataggaaagaataaagcagagtgttaataaaatcgtagaatccaaaagatgtgtgaaagatcgcataacccggtgaccagcccaaagtgaaagtgttgttattctgtggcaacataagaaaagtaagataatgatgtgtgtgtgtgtgtgccagtatgtttgatgttagcataaatttaactgttctgtattttgaacaaactggcctttattctgagattatgccttattaaccttttggatgttataatgttcttttacaaaataatagtgccaatggtggattttgttttgtaatgcccttattgataaaagaaaaagttagtaatcttatacatatccctcattatttttgtactgttatgtgaaatacaaaacactgggtactcggaatatattctcatgccttcactgtataggctgtttaggctgcaggctggcgagtgaagaagtgaattgtcccaaattacacagctaattagtggtggagcttggacacataactactgtttcctgtcaggttttttcgctactttataagatttgttacctgaaagtgagatcactgctttgtaattgtttactttctctatattatgagagtgtgctatgatctttgaagaggtcaagagcatactacaactttaaaaactctaacatttactctttaattgacagaattcaaaggtgaacttgcctcctgatatatcttttttatatatttagataatgtattagttcaatctagtttgtacatctctagttttgcagtcttctcttttattatgagagattattatgcacctgcacacaagacagtcattaccattaatggcagtacactaagtagggattaagtggaatctagattttgatcctaaatggtctttggttgcagtactaggactttgggacagaagtgggtatcctgtaggccctgaggagttggctgcttacctaggaatttcaaaaggaaaggaccagggccagaagatctgaggattgtagggcaggcaccaaaagaagaaagaaggtcaggaagagcataggcaagagagggcaagcaagtggggtcagagtcacggaggctggcaaagagaagtaggagacagcttgagtctgatcccagaatgatggaatcatagcaagaagcctagagactctaagttggagatctgtccctgtggaaccgggctggaagaccctactcagctggggtatgagtctgggtagctgcagcaacagtaaccagaatggcctcactgactagcccaggggacttgagacagggcatccttgagggaatgtgagccaggcagcaaggtgcttccagataggttcttgatttctaacagtaatatttctagatgtttaccttgtttttgtcgaagactgtaatataccctcattccccccatctccttttatagctcacttttctatcgaaactagttattagaccaaataaatgaacagtgagttaatggctattcagagcccactgaattaagtactcttcacttgaaattccatctgccattaggtactctcagctgatgatgggcctttctgcatatgcattccaccgttgcccatacctaatgtaatcactgaagagatgtcctcataatgaagcatgtcacccacccctcctccacccttctcattcccactctcccttatctctgttgtcatatccacttaagtcccatctccagcctcctttttcacctttaatgagagccagcagatggaaaagcagcctgagactctttacacactgggaccctgaataggattcagtaattagcaacattcataagatgtcatgggagccagtttacaaggcaaccaaactatctcctcagtggttccaaggctcagagtgctgacacccttctaaggacttttgagagaacttagcatacaaagtgctgatggagacttaacatgcaccccctactaggctaaggtacttttataaacctcacttcatttcaacatcacaaaaatcctagaagtggatttttaaaactttttcttacataggtagggatacagaggctcaaacaagttcgagtggcttgcccaaggtcataaagcaagttgaacttcagaaataggattgaaatccagttctatggagcctcaaagaccaggctctttccactgccccttggagcccccagaaaacacagtaaattatctcattcatttgctcaaagaaataaaagttcatggttaccttttagttttatgttcatgtatgattccaaacaaagggtcatttcctgtatttggcttaaaaagacatgtgttaaattattttgatcttcatgctctactttttgttctttttgtacttttctggtgcatattaccttgttttacatgaagtattttgaccaggagacttacttaaaaactggccagaagcagtattttaaagtaaacaccagctctttggatgcccaggatttttgctgtattgaaatgaaattggaagatgagctggttagctggaccatgtaactgttgtgaaatcgtttttgttttgattaaagttatattacccgaggacttctgtctacagcttatgcaatattaactgttcccgtttaatcatagactcatgaatacaaactagaatagggacggttaaggtgaggcaggaagcaagggacagacagatcctaatgtgaactgagtttgtagttttccaaattcattttggaaaactgggactccctggatagagacataggggatttcataatgcatgcaaataagaacttcagaggctgctgtcctctgtttttacaaattaccaacgatgggaattacaaattttaaaaagattgaaaactcatttggtagtacagtatcataacctgagtttttattttattagtaattctgcatcaggggacttctgtgtaccataaatcaatcatggggataaatggggaagtttgttaatgaaagtacaaacggaattagtttggaagccgccatcagtgtctgttgtggatattggttaactgggcccagttatttaatttgcaattaaacttttgatttttaagttttactttgagaaagtgtttgtcaaggtggaatatgcctagactagtggactatgattgccagctttgtgggaccgccctcaggatgattttatgggaaaaaatgacctgtcttctctcacaatcccttggtaataatatactcagaggcatgcattgagctcctctggattaaccatgtgttgatcattattctattaatgttttacgttaatctccatgttttctattagtgatggctgctgcttatgtctctcaatgccactatcagggtgtttttgatatcttgtattaccctaatcgctaagaagtatgctccaaactgattaattccagaatgattaaaacatcctatgcaattcatttattgttgctgcagttaattgaatatttgatgatttaaaggtaccctgattatttcataagatatgtatttatcaccaggcagataatttgtgtgtggtctctctgtggctacatggggtggcagcctgcactgtcagatgcagagagggtaggcacttgtgagggttctcagtaaactcaccacctgcctgatgtgcacctcccttccctggccctcagaggaccacatccgtgcccagcacaagagggtcgtctggggccaggagtgagagcacagcctcccctgtgtgtcgtgcagcttgctttctgctccaggaggagggggcggagagggggaatgagaaaggacgctgcagctctgagtggctaacttgcgctttgtggactatctgaatactcaagagtggatttaaagagaggagaaggtgcctcgggaattaagcagcagcttggcaactcaacgggcagcagttctaatcccagtgccaccactagctctctttctcagtctctgtctttcacacctgtccgagtaactcctccagaattactgcgaagacgtgtgggtgtgtgtgagagagaaagagaaagagagtgcaagagaatagcatttggggccgagccccagccttagctcagctttcttccagtgtgcagagtgaccctggtgcatctccgcagggggctcagtgactgaagtggcctcaggtggccccatcacttctcagccatgtcgaatccttggcctctcactcccatatggagcgaggactacggtggggacctcaacggctgggagcttctgtctgacatggcagtgtcggtgaacccggtaggtaccctttccctggcacttaaatcagacctcctgtttggtcttgtctgtttccccgtaaatgttgtctcctcaatttgcatggagtcttgaaggcagaaatgatgctgcctccagtgtctttaaatcctccctcttggcaccatcctgagcacagtgtgagctcaatcaggatttgttgtctaaagaaataaatgggagagctgatgaataggcggacaggcgaatgaatgcgatcctattacccttgtcatgactaccttacaatgtatgtcccagtgggtttctaattgtttgttttcctatcccatctagacatttaactctgagagaaagaacctgagactccgagtgatttgtattaccaactctccatgctttgcactgtgctaggcacgtaggaaatatttgctggttaattaaaaagcacttgcaggaaggaaaagcacttgcggttcaaatgtggttgtcttacggagaaaacagcagtgggcccgggctagatgaatttgcggaactagtaacttcatgagaatgctggattttagtgttttctaaagaaaaatatctaatcactgagtgtgaatgcatatttatttgactgctcttgcctttagagttctctgtctgtcctgagtgctgccgactccaatagtcagtcattattagatgtgctgcaaagctccagagtccacaactctttctcttctgacagtatttcctcccataaagaagtggatatttatatttcaaagagtagagatgatattttcagttggcaagagtgagtcaaatcttagtttgaaaagacgagaagacaggacttaagaaaagtaaggagaacaacaggacaaggggtaataacttaattcattgtattgggctttgcggattacaaagcacattcacatcacttatttcacaggatgctcacagaaaccctgtgagatttaaaaaggatgggtattactattattctttccttttcttttacatttggaaaaactagaactcagaaaggtacagttattaagtcctgttcccaagtggtagggccaggactccttcccaacccttttgactcatcagcaggtgctcttgctgtgtctgcatatcagtgatatattttcactgtgatttaaaaattaacactgatgtgtttgcgtgggaaaaggcgaacaaagaccttttcatgagactgggccatacatttttagcctaggctgcccactctaatacaatacaacaatgatattgaagatttaagcctttcttataatcctttgacctttgtatttggggaatgtatttgttagaagttcaagaactctcttggaaaatacagttgctgcagcactgaacaatggagtgggattgtatttgcagttgagaattaccagtttagttgtataatcatataaacatgttagaccagcatcttccagtatatattctgcaaacattcattgtgtggaataacagtagttattaattggaaaataaaacaagcaaacaaacaatcaaacaactaaaactaaaaacccaagactgaagccaaggaagttgggaatgtactttattaaaaattttagacaggtgtctcacagctttttatttgcatcatggatctccaaagggggatacaatatgggttgcagcatttcccatacttctttgaacacagaaccttccattttgcataactagtgtccatgggatggtcacctttttgtacttccccagagcttatagttgtgcattaactatgtgattcttcatattcaccttcctattgagcctgtaaactccatgagtgaggaaactgtgtctcctcttgcttcccattgtatctctgcctagcaccaagtggcacagcctttggctctccaaaattatttgttgaatgaatgaatgaattgtgctacaccaaatcaccagtggttctctatatgaaacctgtattttagattctttacaaggtatgcccagccaacttaagtcttttcttctactgtttcttctacctagtattagagtattattgttatcggaaggatgactgtataaatttgtcatccaaactggaggacatttttgagagggaaagggaatactatcaataattacacagataagaagtgtaacctggggctatactgggccatctagaattgatagcccttcattattggtgactgtctcaggctgtctcccctatttgggattttgggcctcttggagcagggacttttccatgtagaaggtcttcaataaatactggttgtaattaatgcatgtacagaagtgaccataatgctgtttgaagatttgctgtattgtttaacttgtagtttttacaggtgaggaaatctagtgccgtattctgttcttcatttacccaagtatagttgagtccatacttaagtctgttggggagttaataatcgtccttgcaagaggcctgggcaatgtcgatgtaacggcagtgctctcttaacaggattgggctttcatctttcaaggcagtgaatgagagacccactgttcttaccagagcaggcaggaagcagatgtgatcggattgcaatcctggagagggtgaaggtgtgaaggggagttaggaatgtttgggggatgcctaaaacctgcacagataatgtagtgatcagcagagatttttctagatggttgcctgactctcaagttcctgatcatgcactgtcttacagctggttgcttattttgttatctcgcttcttgctttcactgactataaagcacctgcaggaaagggctatgggcctgacatggagtaaaccctcagtacatttctgctagtgacttgaatcttgattcattaggaaggtgtcacactgggaaaaatgcatcatgggattcactgagtatacttctgagactttttctaactgccaaggcaagcatgcaatttacacaggccgttatccttagtgttttgtaggtgcctagttggactcccaagttcaaaaagaactcaatttaatcacaaaagtgtttcgtataggccttatatttttaatgaataatatacaaaagtatgtcagagggtcaaagatgccttaaagatcacgagatcaagctctctttggatagatgagcaaagagaagccccaggggatgggggatgggtcagtgcctgaaagcaaatcagtgacagaacaaggagtcactttatttctgcaccatgcactgcgatcttaccgcttcattaaagtaaaacaaaattagtcatttgcagatattcttttgtatttaataggaaaaaaatgatagctagattttcttgctttacagtttgtcctacagagtaaactattatacaagaagaagaagtagattgtgcctaatgttttctgtttattttgtttcaggtaagccttcccagtgatccaagctgtgttgaagaaatcttgcgggtgagtttaaacctttatttttgtgccttttaataatgaagcaatctatctgcttaagctgtttaaagtaattactgttctgtttcaaggagtttcatgatggggaatcctgatattctacttcaagacccttctgcttattccagtggcctcatttcttgcctgtcttctttccattttgtaatcaagctagtcttctaatatcactaagcttctgccctatccattcctacatccttctcagacagagacttaccaccttctttaggaaacgttccctgttcaagcaccataccctaaacctttgccttttacctttctgggatctcagctcaatctcactgctgccgcccactatgtggaacatggttaccgagattgattgtggcctataataaggggaagagatgtgggaatgggagaggaggagaagatgagagacttgaaaatgatggcatgttgtggaaagtgttacttatggaagtgagtgtatgtgtgtgaatgccttgagggcagaacaaagttgaaagaatggctataatctcttctgaagtaaacaatcaaaccaaaagaagaaaccaaagttaagcaagaaaaacatatctgtctgctctctctggccattggcatcataaggcagtatggaatctcaagaataggagtcatggtaatgagctcctgagctcctgtcctggctctaccatttgtcacttctgtgaccttggacagatgactttatctctctgaatctcctttcctcgtctgtaaaagaggacaataatacctgccctaactcccttataggctaccaagtggtatataaatgctggctattgtgataaatgatgaccagtgtagtcatgtaaaaaccatgaaggctttctatctgggaaagaaaataatctatgtgccagtgaaaatttggcaccccctttcctcagttaccaaagtcactccaactccctcctgatccccctctcccagtaagtgccttctcagcagcccagtgtttgaagcaagccctgagcaaatgcagccaaaggaatagtcaagagccaaaagctgtttaccattgaaatggcttgccacccggagtatacctgatgtacacattcgtgcacctgtttcagcccaagaacattgttcttgactattaaagagatgagccagtcatatcactttgatcaacgatgagactatatggattagggcaggggttcccaatcccaagtcaatggactggtaccatgtgttcctcgtgagaatgtaatgccttgatgatctcaggtggaacagtttcatccaaaaccaactccccacccctactcccactccctaccccctcatctgcggaaaaattgtcttccatgaaaccagtgcctggtgttaaaaaggttggggactgctagattaggactatgctgactactttggtaagataagaacccagcaacccctcagtcatctgtctcaggggcccgacgttttgggtggagacgaggcagctgttatgagcaccacaaaaggaatgcacactgggaactcaggcctttcccattgggaaaatacattcagtccttgctcacttgtcaacagccttccttaacagaaggtaataacattgaaagaaatgtcttactctgctctagatagtaaccttgttattcctttcttctccgagtcacaagcataaataaactcagtggcctttttataaactcccaaaggaatgccaggcatatctcaaaatctcactaatttgtcacaatcgaaattacatacttaaaagcaacccagccctggtgcctaggtggttatgtgactaaatgcaggaaggagggtgaacacctggctgaggctggcgacaccagtctcctaaaggagccacttagagaaacaacagaatttcacttacacatggaaagaaaagaagcaggttgccttaataggctcacaaaagataacatgctttgagaaagtaacaaaagtccttctgttattcttgaaagagaatctagagaaatgtctcttttttttgaagggctatagattgtatagaattctttttttttttttccaacaacgctgttaatgagtgggccttcctttattaaagaaagaatgtttcattccccatgcttcgaataaaaataagctttctgaaatttgcgtccccaattttatgactaattgttaaatttttatagaccaccttgcatgtcacaatagagcatgcttgttgggctttttgtcttaattacacattcatgttccttttggtttgagggccttagaggcctgtgacgggttccgcagtaaatttgtcacctcattccccataaacccctttcttagggaaaagtacattttatctttctccctacctctcctggccatgctcgctgcttttcaaactaagcagaggcccaaacaatgtcatctctcctcactgaggggagctatgcagaggaaggagcactagccccggagtggaggagctggcttccagttgctcatgagattcccttatttcctagctgtgttgcttttcagtttcttcatctagaagcatgcgctagttattaccccgcccatctctctacccacctccaatgaaggaatatttaaattatacacattgtttgcatctgcaccatgaaaatctgagtccatttgctctcccaactttcccacctccctgatcccccttttttccctccacagcctggcaagcaaacacatacaaacccacttcatctcacatggggacagacttcttttattaaccaaatgcaacacaaccagcctttccccactctcagcccctcaatcctccaggctatggaaatacttttgccttatgtgttttgttatggccccctttctcaaaatgctgtccaaattcaagccagttggtttctcttgaaagcccctctcaccattcatctggcaatgttctcagctccccttcaaaccagcaggtccacttttctttctttgcccccctgggcaaagtgctataatatgctggagcccaccttgtctggtcttccagcaattttcttcttgccctcatgctctcacagatgcaatcagattataacaggctaacttgacctgatgtgtcaaccttattttcctatagcaggtgacagattgtcaaagcacttgaacctcgttgtcttatttggtcataaggagtaaggtagtttcttattatttcatgaaatcgaagtccagagaggttaaatgacctgcagtccagggtggggctggtatgtggcagaagtaaaatggtatctggcctttgttttctaaatctagtgatctttgcactacacccaactctcaatcaccctctcacaaatctagagtgagaatctctggatgttaaacaaacttgcttcagacagtagctgacatttccagcaactttaagaataccagcaaaccaacataatttgaacagatcttagaaattaattcttcttttttgtcattctttaatattttgaatctcatttcaaataataataaaacaatagcaaattttcttctaataataaaacaactgataatagtaatgtgttgtctattgcatgtcaggcacagttcataagcacattatgtctttgaacctttacaataaccctcaaaaattgtattattagtcatgctttacagaatggtaaagagtgaaagtcagagaggtgaagtaatttgcctcaagtcacagttctccaagtctctgacaagagtcatactatccgttcttctggtcctgttggcttatctgaattcattcttatttaacaggctccagtctgctttatgattaacattatagtggattcaaccaccaattcatttcagcttctgttgtttcctcaatttgtacaaattcagttatgccagaataatttaagtagttttttgaacaaactagaattcactggcctacaacaccttttcaccaaactgaccttctcccacaaaatgagctgtacgaattcaggtgtctttgctccttttcaggcatattatcgcttattgtgaattttacaaatcagaaacttaaaggcagcaatctgtgcaatgcatcccagcttttacacttgcttccgtcagcatgctgtttactctttagagtcaagctaccctcacgtgcaaacggaaatgaaaaataataacagctctggccacagtgatggcattttgcagttacaattcatcaatcatctgagggattcctaggcagctcatctgtaataatatgggtaccagcagcagcttcttttctgagctctacggggttttatggatcctagagtaatcatttctggaagagttaagacaaggagagcagcatgctctaaatgctactagctaaggatggatgctcaatgattatttgttctacagtagtatgatttatttgttcatagaaagaatttactttaaaaaatcaagaaactatgaaatcctttctggaatcaaaaatgcagatagagcatttcttttagatttgatgctaaacagattgtctctcctagcaaagcaccttctgtggttgataatttcataggcaaacatctgtaagggtaattcagtgtttatgagggatgctgaatttgctagctaggatttagggaacttgatttgataaactgtatcttcttacagatttcttcctgccatatggatcaggttggtaaacacctacttggccacctctttttgattacagtatgatctgtgtttacagcattctaaattatggcaattctacttattaggcttgtgttttagttaacagttttagcatggaaaaaaattaccaaatatttacagggcagtgcttgttattttatttttattttttaacagggaaataaatgaaaaagcccatcttgcaagtaagaaaaaaaatggatcagggaacaaaattggtcggacaattatgtctgaaaggaaatttgattatattatcataactatgcagcataatcaagcacctttcagtagaatttcttttataaatttaaccaataattaggcaattgattttatatcctgtcaaattaatgtataaataatgttcaacttggattcatgcaaacgattttctatatagctgtcttaaataggaatccttctggaatgtttcagaaagcatgtatcttatttggatgtggacttttaaaattatagtttcttgaaatagtaatatagtgttccgcccaagaaagacaattcctaaatataatttagactataattaatgttaacattgatggagtcaaatgaatgaactaactaatgatagtgccctttgctaatctgatgactagttcttacctaatggcactgggaaatatgtaaatttgtcagcaggtgaaaatgcccttgactgggtaaattatgtgcagtattcccttttctgaagctaattcaaagcactaatggacttaatacgtagcatgcatatgtgaggtgagctattcatggaaccaaattagctcataagagatattatccattatatgcctcctagtaatcatttcctcttttctcaaacacaaaccaacccagaagaaagatgctaaatttaattataacaactttatgtgaacaatgcaggtaagccatccagtgtgcttccaaatgcacttagaacctgtcaagcagtttaaatatttttatatggaatctaggggtttgcagctaatatatgaggtgaattttaaatgattttacagatgtcattgggaaagtgagtaatatgagtaatgaggtgactgggccagtgaatcatgggaacctgtcaaacatggggagatgtcagggaagagatgatatcaaatagaagtaacttagcaacccagcatttagctgtccagagaatgagcaagagtagcccctttaaaatagctgagtaaatttatcagttcctgtatatcttaggtatgctataaaaataagtctgttctctgtcaacctgtttctttttgtgaatatggtgatttgtgattttctattgaattggatgaaagccggtgagaatttaggccatgtgtagaatttacacctgttttctgtatcttgggtgtaaggagagagtaatgaaacaacacattgttttgccaaaaagcattctaagcttatctgaaagaagtaacagcttccaactgttgtctaagaaccagcatttttgtactagctttgctagtgggattgggctggggaaaggagaagtaatgcaaggaagttaaccattccacttgcatctgtgtaaaggtgaaactcgtgtctctgcaaaacacattgaggaagtagcctcttggaatccatttggtaggcatctcccagttttgaaatgaaagaaagaaggaaagaataaaacaaggcttgtcccttctctcgtttgtcattagaagcattcaggagaatgagaaaaataaactgaaactccatgattgatgtaaccaaagggtatccataagcctgactcacaatttattttgtgaaggtcaaacagggaagaagccaataagtgattcccatggtcttggatttgtggcatagtagatgtaagaaacactgattttcagaataagtggaacatggtgaaaagcaataacagtattagaataatgagaatgggcattaaagttggagatgggagcttccatggaccaagtttgggacacagtctcgagaagtagggaaggcaggactgaatgagaaattacataaatgatccatatttgtggaaggcactttgttagtgaggcaaggtggatgaatgagatgctgctttgcaagtagcctgtagggctgatgtttattgataacagagaagtaaagcctgaaagcatttgggcacacagccttgtattccgaagagaattcctgctagtctggaattcagccacagccctgactggtcctggaagaactcttgacatgaaaaaaaaaatagtaataaaaaagaatcaccacaagatctatgcaaaaaaaaaaaaatacacaaaaaagcatgtgagaaaagtgtaccagaaaaacaatatttttatggaaaaattaaagctgtgaccaacatagtggcatgaatttgttaaaaccatgaagcaattttatctgaaaagacaagaacaaaatcagtgatacaggaacttaaagatgctatttaaaaaatagataaatcaggaggtgtgaattaatgaattatgaacagaaaatcattataattaattaattcaagatccttttcccaaataaaacaataatacaataaaatagatacttggttacttaacgccatcaagaaaaaagggaaaacactaatacataaaacaagaactaataaacagaaataacctcagatacagagaaaactaagagaataatgagtagcaattttctcagctctgtacaaataaatataaaccggtggatgaaatggatggtttttctagtgaaatgtaattgacagagattaactccagaaaacacagaaaatctaaacaggcttatagccatcaatgaaatgaagactctccccaccccttaacaaaagcgtcactcccagatgggatttcgtgaggaaattaaactaaactttcacaaaatatgacagtataacttttacacgacatagaacaaaaagaaaaatttgcaaagtactttttagaaaagccaatctagcttttattttgatactaaaatctgacaaaaatagaacacaaaaaagaaaattgcataatagtatcatttatgattattgttgcaaagctccttaatgaaatactaacaaacagaatcagacagcactttaaaggatatacaatatcaccaagtgggttttattccaggagtgtaaaactggttcagtgttaagaaatccatttgtataatgccttttacaaagagaataaaaaaagaaaaattacacagtcatcttcatttagatgataaaagacacttgacaaaactgaatacacattcttgataaaatagaaataagtggaaacatatttaatgtgataaaatatatccaccttaacccaaaggctagtatcacatttcatggagaaactctcaaagcattctcattatagtcaagaaaaagactagatgttctttataccactatcattttatgtttttctggaggttagccaagacaattaaatatgtaaagaataagaggcattaaagtgagagataatgcttaaaatggttactatttgtacattatacatatattgttttcctggaaaccagaaacaaattaactgaaaacactattatgaataatacacaaattcagccaagttgctctgtgcaaaataaatgtatggcaaaaaatagtctttacatataaagcaagcaactataagatgtaatgggcaaaaaaatccttttacaccttatgaattgatgtaacaagaattgtgtcagagctgtataaacaaactaagtcactatgagagatgccaaagaatacttcaataaaaaggcatacaattcctgaaaaggaagacaatgtcacagacgtttgtgttctccctaagttaatcttggatccttacctcacgccatacaaaaacattacttctagatgtattaaagattaaaaacaaaaacataaaatattagaagtatatatggaagattttaatttatttttaattttccgatcaagtctcataattagatggcagggataagaagcagtcaggggaaagttcagaggttagaggagactggagaatgaaagagtaattgaaagagagagaagtctctcactctaagggaatatagtaagattatgaggcaacatcaaggctccaggtgatattgaagatattatatttatacaggtttcaatctgtagattatataatttcctccagcagtgcttatttcattacccagagaccacaggctaatgggtcgatgacagcctggaggccttagagaggttgaaaattgccccgaatcatatattcatatggttatgaagcagctaacacagaattggaactcatgttggcctgaacccaaagtacatactaatagtagtaccacttacctagcatttttttgtacctggcactgttagaagaatttcacatatagtaactcatataatcactatatcaatgccgagaagcaagtactattatcatccccttgttagataatgatgtggaagtactctgagcttaagtgactttctaagtttgacagctaaccagtggcagagccaaaatttcaaaccaagcagtttttggtgattatgaataatgtgggtattaataattatatacagatttttgcatgaacacatgttttcatttatctttggaatatacctaggagtgggatcgcagagtcatatgcttagagtatgtttaaatttataaaaaccatactaaattgcttttagagtggctgtaccattttgcacttacaccagccaagtatgaaagaccacttactcagcatgtacttatttcccatttgtatatcttttttgatgaagtgtctgttcaaatcatttactcatttactaaatcaggttgtctattaccttataaatgaatcttgagagcttttattgtttctggacataagtcatttgtcagatatgtgatttgcaaatattttctctcgggctgtggcttgtcttttcattctcttggtgatatccttctaagagaaaaatttcttaattttgataaaatccaatttatctttgtttcatgttatggattattattttgctgtcaagtcgaagaacttttgggttaattcaaggtcaaaaaaattctcccatgttttattctaagagttttatttaagtcttcattttggattaatttttatgtgtgatgtgaggtataggttgagatttacattatgttccagcacgatttattgaaaagattgtatttaatctttctccattgaattgcttttgcatttttgtaaaaagtcaattgaccatatttgtgtgggtctacttcttgactctccagtctcttctacttgtctgtgtccttgacctttcactaataccataatgtcttaatttctgtagatattgtaagtctgaaaatagcataatgtgaatcttccaactttgttcttttcctaaaatggtttagctatcctagttccttttcctttccatatgaattttagatatattatttatatttacaaagaattctgcttaaatgttggctagtattgcattacatctataaatcaattttgagggaattaacacctttactgtgtgcatctttcatctcatggatgtggtcaatgtgcctctccatttatttgggttggctactctatttttagagggacactggtaatttataatcccactttagaaaattcatgctatgagaaaaatccaagctcctagaaaaactatgtgaacaaaattattcattacacaattctttgtaatagcaaaaaatgctactatatatttaacagtgggagaatagttaagcaaactcagatttatacattcagaatcataaccaaccattaaaaagatggctttgccggtgatgtaacaacatgaggaaaaattatgagataatgtttactgaaataagcagaatataacattttatgtacttaagtattatatctctataaaaaatgactaaaaagaaactgaaggaaaatattttgaaatgatagttcttattttgttagagttagaattatgggtgagtttcttcttttttatattttctcaatttctataatttatattactttcataaaaatatttaagaggcaatttactcatgtaacaaacatgcatgtttaccccctgaacttaaataaaaatgaaaaaacaatttaagagttatattgctgaactaaaatgcacttagcaaagagtaaccaggatagtgggtagtttccaaactggaacgtctaaagagatagactagattaaacagcagaaaattgaactagaagagggagcaggctgtggctgcctgagagactaccctgtggaagcaagagactcagaggctgcatttgggatagaaggcctcaaatggtggaatccaacttttgaggggcacttatagagggataagtattagggcaatacaagcaagaatgttctggggggtggggcatcatggttaagacagtagagctcagctcttctcccttgctgaatgtttttgggtaaattaaccttttcgtacctcatttacaaaagtgagataatatgccctaattctcagaattatagggacaattaaatgagatgatgcatatgaaacctctggaatagtgcttggagcactcaattagatccttcctttctcccctgttctaattggtagatctgtccaagggtagaaggaggtgaggtctttgtcactgaaagtgttcaatagaggcactgtgctcccccagtacctagaggataaacttccaaacccagatcttggcagtcaaagtccttcctttatgtcaccactcatgcctacctcacatattgccaattctcccaactgtgtgcccttttccacatccactgcagacttctccccctttatcaaatgtgccatctcctcctctgcctctgtgtgctgccccctccctctgcctgtgatctcatccactcctgtctttgtctggtgacctcctatctacaccatgtaagatccaccacagagatcacagatattaatgaattaatttctctatctgtcttctaggtccccatagcaatttttatatatctacacttggcctttgtatgtgtgtatgttggggagttgcctcttatggtagaatgtgaggtccattaggtcatagtctgtgtggaaatccttattctgtctctttggccaattccagaaggcccccccacatacatgcacacaaaggtgacaagtgtaggtgcataaaaagtgcatagattagatgtaatgtgtttattaaatgacttaaatttttagaggaatggttagagaaaatgacctcatagtgttatttccacccaaggtacaataatgatttgattttccatgaaaatattacaagttaataagcagataatagtgcttattgagtagaataattatacaaatattaggcattttaatgactccatttcttatttctccaaatgatatattatcaccatttgtgtgctttttccattgccaatttctttttaagaagggcaaaatgccgcatgcagctccaatcgtttagatgtgtctggattcttggaaacttgactaccctatgttctcctagaaatggaccgtgagagcttgcttggaggttgtagcagggaagcacagctgctcctatacctttgacctaagaaggattcaactctatagataagcagtggtaagagcgagaaatgacacccatctagccagccagatcagttgaatcaaacctgacgttcagtggggtaacagatgtcgcagccagatagtcatcacatcctcaattgcaaattattatttaataccattgttatagtccatttttaatattgttcctcaaaatacaataatgctagcattatcagtgtaaacaaggtactgaataaagacagggccccatatgctactacaatgggagagattttcaaatctctcaaataatgttttggcactattcactgtgcttattatcactgtgatcacaagaaaagagcttccacaagatgtgttttcttccctaaagtgattcctccagggtgtgtgtgtgtgtgtgtgtgtgtgtgtgtgtgtggctgatagcctgtaagttgcttccattaaacactccattccccaaagcctttcattattggaatgaacacactaacacgaacagactcatcctgctcttttcctggcaacatgttaactggaaattgcagaatcataaaataaataactaaggccaatctaaaaccaaggtgtaaaaacagcatcctggctgtctgggcctctgattattttctattgaactcccttactacttctcaggacctgttgcgttcagaggatacccgaaaagctagtctatcctccaactttgcagcctcctcactgctctttaatccaggagctcccagcacatcctcacacccctagtgcttttgatgcaaaagtgaatagcaggtctgacacctggagaatccaccctgatgttagagcctggtctgctcctgtcctgtgttacagagtggagaccatgcagcatcggcctttgaaagaactgggattaagatgaaaacaatgtgccagtgacactggaccagacatcaagagacctcagagctagttctgaccctgccactaccttattctgtgacccttggctagtctcttaaccattgtgtgcttcaggttctccatctgtaaagtgttgaattttttgcactctccagtacagaaacaccaaccacatgtggctggctatttgaatttaaattaattaaattttaacaaaataaaagttcagttcctcatccatttcaagttctcattagttacatgtggccagtgtttgccatattagacaacacaaaactcagtatttccatcactgtagaaagatacagtgaacagaactgccccagatatctcttcagatttgctctaggtttttattctgagttttatcataaaataaaatcaaatattgttttaccttctagactgtgtattctagactgtgtttagagtatatctgattaatttatttcctcctgagtcttatatacaatacattgatcaaattcaactctggttctgagcagtgcccctactatataagacagaacaaaaaataagtctgagtaggtagaaaaagatacagcaagtattcccacaaaagagagaagaccagagaagtttcaggcatacgcctggtttgttgggcaatgcagggacccatgtactcctaactcaggcctcagacaaagtgtctttccctatgttcaataacattaataatgctttcatccctaggctctggaaataagagggtacatcagaccgttgaatggcccttttaggagagaaatggtactataaaaacccaggaattgattcatatttgcttcctctctctctctctctctctctcttcctctctcactctctcttccctgcactcttcagcttttccatctctttagacatccacctaaggtgcatcattaaaggaagtaccacagcagcacttggacagctccagtggctttaattgccccatttcttcattaaggggagttgcttacctacaccttgcacaggggcttgagatctggattattaacgttaaaatggactgagtcctgagaaaagccattcattgtacaaactttcagttatgtagggtaaataaattctgaagatgtactgtattatatactcaaaatttactaaaagagtggaccttaaatattctcacaacatttaaacaacaaataaaggtagctatgtgagttggtggacatattaattagcttgattatggcaatcattttacaatgtatacatacatcagaaactcacattgtataccataaatatatattaataatttattttgtcagttatacctccataaagttcgagaataaaaagccattacttggaatgcattctggtgacaagggaaatttaataaattcgtgcctctccttagggatcggcttatttttactgacttgccatttggattgtgtgaccctcacacttgccattgggttgcgtgtggcatgagtaagggcagtggtttcaaaacaattataagttgggttctgtggttcatgcctgtaatcccagcactttgggaggctgaggtgagaggactgcttgagaccaggagttcaagaccagcctggggcaacaaaaggagacccacatgtctataaaaataagttaattggctgggtgtggtggtgcacacctgtagtctcagctactcagggaggctgaggtaggaggattgcttgagcccaggagttggaggctgcagtgagccacgatcacaccattgcacactactcactctgaggtgacagacagagtgagacctcatctctaaaaccacacacacacacatacacacacacacacaaaatgatgataatgtacttcttataaccaccaaattataatggacttccagaaaggtgagggagctttgttcctgctacatgattggagttttcccttttggaaaacctgtcctatggagtatggtggtgcccaaagcctagagctcaaagccagacacctgggcagaggtccttgagctgcatgacattgtctccaaaactcagttatctgacctatgaaatgagaacaagaaaaactacttctctgtattattgagtggattaaatatggtaacataaatgaaacagtgaattctaacccccaaatacatacaagctcctattggattgttattgtgactcttcttgttattcagaaattccaaatattttcaaagggtcactttgaatttcatatttcgacccttcacagactctctatctgatttggccaaggagtttagattgcccctgtgattttcttgaatattaaatatgtaagctcctttcatgtctttaatagagtagtttttttttttcatttttgaccactccatagttcataaggcacattgcagcttttcaaattgtcaaatttgtttaattagcccagagaccctgcccggttggtttttgtcagctgtatagcagtctctgtgggtggcttgcaaatctctgaccagggttttttttttttttaaatcattttgcacatttctttccttctttaatacaaatcaaggagagactagatgagcaggaggcagtggtgggggtgggagtaggaaggcaacgtgctgtggcactggttgccaactggcttttggacaagagttacaaattgattacaagtaacagttggaatcccaggcctgagagatccaggtttgtgagtgtgttgcgggtggggtagagttctccttgagctatttatttacttcaagaccaatgtttcatttgcacactgaaaccttcctaggtaagggtttgacattgttccctttgaatcttctatttggtgctttgctaaatttatagccaggagtaaacgtattgatctggttacccaaaaagatgttttaggccaaaaaaaaggtagaggtttaaagaggatttagagacatccactggcagtggattctcagagggttattagggaagcttgcaaggggcggggggtgggggtaattggaatgcaccccttccttatggtgagtaaatgttttgaagtacaaatgtggatgccctaaaagatgtcaatgggaaactatcaataaaagaaacttttataatagtcttcttgtgtgattgttaccttttaattaaaaaaaaaaagacttggtagtgaaatccaataatcagattggattgatgtttaacaaatacttagtataaaatatcagatatgaatcaatagctacttgtagcttatgctggcaagtggctgtttatatcaaggcagagagggacctgctttcctgggtttaaaatagaattgaagctttatagcgtgcctgtggggccacatttttgtacataccactggcccccagtgttcatattgagtttagaaagttctccttcttcatcagtcaaatatccttttagaaaaagatatgcctctcacttgtgctgtgattttgccactgttaatatggaatacagatgctatttattttccgttatttggggaattgtagagaaaaacgaatctggggagaggagtccaggcattcagaaatactcaacctattaggggcttggaatacttggagggggctttctgaatcaatttcactgtgacttagtagtggttttgatgttgttaaattcagactactgcaaggaatttgatacctctgttggtttatttttatttttattgaggggtatctgtggatggggggcgggagagagggcctggtgttcagtagttagactgacatcttgtgatagatttgttagttaatttcatgtgaatgggacaaaccagttctctttcctgcccctggcactgtgattctaagattgaaatagctgtttcagaggaaagacaattccatgcaaatcatattggatggagtttcagctgtattagcggcctggtaccttatttttactgacctcaggaataatgagagaccaaagctatagccaagttcttaactggaggcttctttccacgaaaatagatattacttctttattccccagcaattgagcctttgtcccttctaaaagtagttgtcatgaactcctcattaccatttttcttaacgtgataagtgtaaactacaagaaagctatcatgtttgaaaagctacagcagcccttagaaatggaatactaacatgccttgtgtacttctttgaaaggacttagactgaggattgtgtgaaatgtatccttctgcccccctttgcctggagttgtcattctctagtacctttcacttatagcataagctggctttctaaaggactgctgtgttgttgcattgacaccgtatctctccaacaatgtgaaatcaacaaatccctttggcaatttctgaaacatataacaaattgtgcattattctctaaaaaaaatcaactttgatgggcttattttatttctacttcgaatggtaactggtaattgttattaccttactctcattccaattatcaatactctagctacagagagtaccaccagaccctgtaccgggacctagtctagcctcctggctgtcagataccttgcaaggagtagacactcaataaatgttttctgaatgaatgaaattaaatatagattattagaaatgctgctggaggagaagccaatgaaagtgtgtgagttttatcaagttggtttgcctgagctggtgctaaaggagcaaattggaaggtaaccattaagaaacatctcatgctgtgaggatatagcatgtcattccatcttttgaagtgactgtgaaaggaaaaaaaaaacatggctgtagtattatgaaagcctcgcgaattatctcaaatcagtatattttaagtgatggtcattggatgtagttgacggcaaaataatttgaaacagaagagctggaaattcaacattgcaattaaaaatcacttttgaaaagagttacaatgatctgatgtcaaaattagcttaagaatgtaagaaacaatttcaagggttagaaatgttaagaactggccctgaagaaaccccagaatcctcacatacctgaactggaccacttagaaaaagccctctaccttgattccctttttgatactgctctttgcagaacactttctcagtggccagttcttacatttctaagctttgatattgtgttaattttgcctgtaccaaacaaggcaaacaattcagtgttgttcaatctgataacatttcctagtggggtgttcagtcttctattctgactggttcaacctaatttagacaaagacaaaggtcttaataaagattaaaatttacaaggcaatcgtgtttagggaatcaaataccattagttggatgggccgtggcctgaggttgctgctgctgaaaccttttgctgaactaaaaaggtctggttgaattctgcccagtatatcactatagtgttctgttcccttgtatttacctttggagacctttctttgcagtgtttgaatgtagaatgcccgaggagtaactgggccaaaaaaagttgcatgaataggccctgcacatggtcatatatgttcctgttgtattcagtgggtgaaatggaattgattgcatctggcaatggcaagaagatggcttgattgattgcctgattgagtacacagtggagattcagaatactgatcactatacttcccaattgtacattataattagggctctttttcaatggaaccctggtttgggggctgccaggatgaaggcagccaatgtgagctgaactttttgcatgtacagattctcctcctggatccgaaggagaatatttccagattcccttaaacaactgccagcactaaagagtttgaatacagaattccattatttatttgaagaaacatcgccagggtttttataccatgccatttaaatcataagttagtgttagaaacttttaaaagaattgcattttgcattgacccattgttatgccatggccaagaagttatgtttaatgtaaccgttgattttacacttcctctctatgagcacttgcatggaaatcagaggagcaatctcaggagactgtcttaacagcattccaaatagaagaatattcattcaattgaatggaacagagttttgaccactagaaaagcttggcaggaatggctagtgatcaagcctaggaaagtctatggttccactgttgttagattttctaagagttcagcaaacaatcagacaaattgggctgttagctgtctcactgtgagacaataggctcccctcagcatgtttcccccaccccatccctgggagaatgacaaatttccttagtcaatttagtcagccgtgtttatatgtcatgcaaaacaactgctccagattcagttttgcatcttctcatatatatctttgactttacagaagtaaagtgtatgattatctgattaggtaaagcagtacagatgattcacaacacccactccgccaccttttaggaatcccttttcactgctctaggcagaggacatttcgccttcagagatgaactgctcactgccttctaagacagtaggctccatgattggaaacctcaaatgattggaaattctttagtagtttgagctaaaattggtcccctgataactttacccatacagccagtcctaaactcttggtccacaaagcaggtctcaaatctctttcatgtgaaagactttcatggatttaaagacactcctcactctcccttttctgtggactaaactttccctgtttctttaatgtctatgtatacatgagatgagctttccaagctcttaccattcagatagctgtcccttagaggtattgcagtattcccatgcccccactgagatgggacatccaggagagcactctgagagggccctgagaggaaaaagatcagtagttcttcccacatgccctacttccctctaagggaatttcgtttggaacagccaagctccctgaccctgagcaaagggcccctgtccttccgaagcctgcctgagggggcctagtaggagaaacaggtaagttcctgtgtctgtagaggctgcacagcagcctggctacattctggcacaccacactgggagcagcagcctgtgcagatcacatccagccccctgaatccttttacaaatggctgtgtggctccctccatgggcccatctattgggggaacctgcccccaataattcatcattatttcacataggttcttttctatttccgtaagtgtcggcctgtctgagaaataaagggaaagagtacaaagagagaagtttttaaagctgggtgtctggggcagacatcacatgtcggcaggttccgtgatgccccccaaactgcaaaaccagcaagtttttattagttattttcaaaagaggagggagtgtacaaatagggtgtgggtcacagagatcacatgcttcacaaggtaataaaatgtcacaaggcaaatggaggcagggcgagatcacaggaccagggtgaaattaaaattactatgaagtttcgggcatgcattgtcattgataacatcttatcaggtgacagggtttgagagcagacaactggtctgaccaaaatttattaagcgggaatttcctcatcctaataagcctgggagcgctatgggagacccgggcttatttcattccttatctacaactgtaaaaaaaaaagacagactttcccaaagaggccattttagaggcctccccttgggaatgcattctccttctcagggatgttccttgctgagaaaaagaattcagtgatattttcctatttgcttttgaaagaagagaaatatggctctgttgcacccggcccacaggtggccagactttaaggttatctcccttgttccttgaacatcgctgttatcctgttcttttttcaaggtgcccagatttcatattgttcaaacacacatgctctacaaacaatttgctcagttaacgcaatcatcacagggtcctgaggcgacattcatcctcagcttacgaagatgacaggattaagagattaaagtaaagacaggcataggaaatcacaagagtattgattggggaagtgataaatgtccattaaatcttcacaatttacgttcagagactgcagtaaagacaggcataagaaattataaaagtattaatttggggaactaataaatgtccatgaaatcttcacaatttatgttcttctgccatggcttcagctggtccctccatttggggtccctgacttcccacaacacccatcttaaccctactcctgctattgttgtccatttcctattaacacccccactgctgctgcagataagggtgctaatgccctgcctggctttgctctcctatcagggaggagcagagcatcctacaggctggttagcaattgatagcagattgaaggtcaaggaaggatttgtttgctgttctcctgaaccctagccccagggcagccctttctaggcatcctaagggcacttgcgccttattcccttgcatcctggtgcttagctgcttcattcccccttttctggctcctcacagaactgtcaggaaccatggatacaaagggtctaaatcattcattcaaacaaattaggtttttctggtaagtcattaacacctcctctatacacacacacatacacacacacacatatgtgtttttgtaaatgcataaggacctttagataaagaaacagattcagcagtctaataacaagacctcactcacataaatgttttcaggtttaatttagttttggtgacggaaagatgctgatgtttcttcatccttagtctgtggtgatttgtaaagctactcagtaggataccttttgggagtacactatctgtaaagcaaaactaaaaaataaaagaagaaaggaaaagaaaaactgaaggaaggaaggagggaggaaggaaggaagcaaggaagggagggcccctccaatggaagtcagacaccaaggttagttaccatgactcagttaccatgacttgtgagtcatttacttctgatttcctgtgaaaatattgataaacttgaacccgattttgcagatgtattcttctattcaaccatatttttatttgagccactcagctattcacgcttattcttaatcacaagaatttgtgaatacttccaaaattgcatttattacgttcttggtattttagtagagggaagggagaaaggtgtatgcaagctccatcttgagccttgggcagatcccaagctgcctggttgctaagccaaggcatgcaggctcatactgacaatgccatagccatacctgtggggctggtagcaatgagctttgaatgtgtacaacactatatggtttacaaagcccttacacaattattcatttgcttccccttatgccaagcctgtgaggtaggcagaacaggtagaatcagagatgaacggtattgctaactgggagaactagaagccatccaagtcaaagcccacatgttgtaagcaggaaagctgaggcccagaatggacaagcaacttgaccagggccacccacatagcttttggcagagctaggcttgagttaagttctccctatcttaatacttagtccatgttgcttttggggctctctctgactataacaacaacaatgaaatatgtgaactatcatcatcatttgcattcattaaggtggtcatttgaaaaatcgccctaatcatctcttcagtttgagctcttttacagtaagtaccttaatatttatgcttaacctaaacacactatttgagcagctactatgtgccaagtataatgatagcctgtaaaagggatacacacacacactcgcacacacataaacacacatgtgtgttcaaaaacactgctcctctcacttcaactattgaagccttttccaaatgcctagcacagtgactttccccaccaccttattctctgcacctttgctcattcccctctcaaggtgattcgcatgtcaggcagtgaacgcttcaaaaagaggtccttgactttatcatttccatgtcctagtgactggcttataatggctacacacgcctgtaatcccagcactttgggaggctgaggcagactgatcacaaggtcaggagtttgagactagcctggccaatatggtgaaaccctgtctctactaaaaaatacaaaaattagcctagcatggtggcacgcacctgtagtcccagctacttgggaggctgaggcaggagaatcgctggaacctgggaggcacaggttgcagtgagccaatatggcgccactgcactccagcctgggtgacagagtgagacgctgtctcaaaaaaaaaaaaaataaaaaataaaaaattagtagaacaaatgcaaagaatccaccaaacagatctgccatttgctgtgtgaccttggacaagtcactttacctctttgtgcttcaattccttgtctgtgaaaagggtgtgaggctaatccctgcctgtttagtttctggtacaaaaagaccaaccaattacttactacacactaggcaggagagatacaaaggtgaataaggtgaggcttgtgacaacatactagttacttgagataacagctattcaggtagctgtgtgttagatgagtacaggatccatttgagattagcaaagcctggaacacagactgtcttctgtccttcagcctgtggcatacccagctttcgtgtctaaattgggcaaagcaaggatacctgcaagtggttttggatttgttttgagtcctagccatgagctattgtttggataatatggtggaaaattgagccttttgtgattttgtggggtttgactttggagtcttcatatcacattaatataagtgtcttcctattattagaagttatgtagaatgctctatcacttatgaaatccattctttgccaaatactaaaagataaaacagtattccttagtcttttcttcattatccatgttagtcagtcttacagagggagacatatttgttatagtggaaagtgtgcactcttgtaccagtaatcaaacttcacttgctactaaatgtaaggctgtgtataagtgacctcacctcttggaacccccattacctcagttgcccgttgggaatatgaatccctgctttctgtctctctctgtctctctctcaaaggatcaaaggatcccaaacataaagcagtgcttccttgtggaagttcagaccagtctcagatgtgtgtgtgtgtgtgtgtgtgtgtgtgtgtgtgtgtgtgtgtatgtaacttatttttgttaaaagagaagtgattcttggtgttgtgtacaggtactcatcattggatcctgttataaagctgtggcaacattttgggagcaggggctcatccctacctgatgactgggtgaaggattagtaaagttgggtaagaatgcataggtgtcttatcttaggaatagcaagaacataaactagattaatatccttcaagtgttaatgaaaaggataacaatggaatatctgctgtgagtgtgccacactttacaagtctaattcattttgagaagtgaaagagcttgcttgctccaaagtcctttgaggaagatattctttcaggaaattatattcctttcaactacatcctgcctactgtaatcaaatgcatcagtggtaacatggactcagtgtgctgtttcatgaaatttcacattttcaaatacagtttgaaatcagttgtaattgaaaatgtagaagtttgtgcagttccatgtggattagctaacagggcagtgcactccactggtaattcaagataatcagattctgcctccgagtaaatacagaaaacctaggggaaaaggtacacttttgagaagtgactttattcttcccggtgtctgaaacaccttttaataaacccagaggcacacctctaaaatcagtggtgaaaggggataaaactaagcctctaatcaatttaggcatacccagtagttgctgaaaacagacaacactcctttttctggaagagacttacctgctgttttattgactctggctaaatatgaactatattttatttattttgagaaaaaaattattttaattgacaaaaattgtacatacttatggggtaaaacatgatgttttgatatgtatatacattgtggaatgattacatcaagttaatttacatatccatcacgtcacatactttttttttttttttttttgagatggagtctcgctctgtcaccaggatggagtgcagtggcacaatcttgacacactgcaacctccacctcccaggttcaagcgattctcctgcctcagcctcccgagtagctgggactataggcgcgcaccaccatgcccaactaatttttgtatttttagtagagacggggtttcactatgttggccaggatggtctcgatctcttgacctcgtgatccacccacctcgggctcccaaagtgttggaattacaggccaccatacccagtccacctcacatactttttttatggtgagaacattcaaactctgtcttagcaattttcaagtatacagtacattattactattaataactatagtcaccatgttatgcaaccgatcttcagaacttactccttcaaactgaaactttgtactcttataccaacagctcccccatcccaagctatatattttaaatgatctgactattttggagaccagtcttaatcaggaaaaaccatctaaattgtaaaagagatcactgagtatttttaaaactcagagtaattagaattactgttgtcacatatatttactttgcagccagttttgatgaatacatgagtaggatttgtcatgaatgttatcaactggatacaaatgcacaactcaaaaacacttggaagtagtctatctcttaagtaggttaagcatctcctctaaattgtgtatgcatttttaatgtagttacctcctcctttttaaatagtgctaggtaaaattcaatctttgtcagaataatacttacaaattctgcttcagcagtgccactgtgaatgaatctgtgaagtatctccttgcattacagctcttcatacatcaaagactctttttgaactgagtaattatagaaggaaaaaaaccttgttttagtgctacctgagagttcttattaatattacctttgaaatgactaattatgttacttataaagactggaaaaaaacaagtattatgtaacttactcattaaaaaagactttcataaattttgatcccctccatccttccccaaatccctactttatttctatcatgactttttttttaatgcttaatggttctatatgaaaatgatgactccaacacatgctgactccctcctgcttcacaaaacttatcatctttctgttgctgggattttgagcatgtgattcaattatccttgctcttagcgtaaagcatgttggccacatgccctaagactcaagtaagatttgaacagcacctctttcaaactgagtatttgaaagagctgagagggtgtccctgctgataacacagggtgggagcctaaggggcttttcctgttttgagacttgaactcacagatacactgtctatgtgtatggctgtgtggaaccgagctaccaatcacatagtaaccttctctatgaatgagaaagaattcccctcagcggcttcatctttgcatggaaaaacccacagtatgtgcatcatgggtcactaactgttgggctgtatcaagagaagatgagtatcagaaggcagcgacagtactgtcctcccttgagctgacagatcacacgtggaacaggataccatgagttacaagagccccaggcaatctggagttcctcctggaagcaccaacaatagtgacagtgtacagaaattgagcattagaagaaaagttgaaggttcccaataaatgaatgaacaagctgagaatgtctcagcctggagaagagacgatgccaggggataggattactatcttccaacaactgaaggcttgtcattcaaaagaaggagaagatgcattctgtgcagctccaaagtacagtctataagtagaagttcctgggggacaagtttttaactcacaaaaaaggaagaatagcctgatgatgctgtctcaacatggagcaggctacttcaagcagtagcaagctccctgtcactggcagtttgcaagcatctgctggatggtccaaatgactttaaattcaccttaagtattaggtcagttaagttaagttagtatttataaaggacctacactgtttagtgctaagaaagggcttgattttttaattgccctgaaataaagtttctttatttttcctcattaggagatgacccattcctggcctactcctctcacttccatgcatactgctggacactctgagcagagcaccttttccatcccaggacaggtcagttctcttccttcctgcatttttgtttgtcttattttaattataccaatcttccaactggattctcagtggcaaaaatggccttggtcttctagtgccataaaatctagactctcttgcccctcagaatagcaatataaaaataatttttattgaaagtgagtctttaaaacaaaatacacacagataccggcatgcgtgtcttactccatagggtgttgccactgtccaagtcgctgtgcctagaacagatgagacagagattgaataactcatcccttaagaaatatcaaatagatgatggaacagcaacgttcaagattttaaagttacaaaacctgtactctttaatgaactgattttcatttttatcaccttccagttcttgctcacaagcagacagatctttacaaaacaccacatcacactgacagagctttatcttctacagttctattgtcaaatgtttaatattatttttatttaccttctctcagcaagagttgctttattgccatcactttttaaaatgtctagacatggctattctaacatactttaaaaatatatataatgtcttcctttcttcctccattcctttcttccttccatccatttattcagaaatcatttactgagaagatacagtgggcttaaaggtaggggtgaagaaaaaccgtctacatgctatcacatagatcacaaaacaatgtagtaaatgtcttcatagagaagacaagactcagagtcgtatctaacactcccctggggagttgaggaagtgctcaccactgaggtggaaacatttaggggatgattaagactctgacaggtgaagaaggggccaagagaagaataccgcatgcataagactagtgtgagcaaggtcatgagagatgagggatcatgctgtagtgcatggtgatataaggtctcaagtggcaggattaaagtttgtgtgatggggagtggaaagagaggaaacctgggcaaataggtgcatatttggaaaacgccttggataccacctcaaggagtttggactttatttgtagaaggagaaacacccaaaggagaaacccttagattttagggtcatgattttgaaagtaacactgatctaaactttgcttaatgatcttccttcacctatgaaagaggtcagaactaaacgaacagctaatctcactgtcccagtatgggtgtgtgctattcctttttgcattcacacccaccctttttaggcttctgttctccttccccctggcatctccagcaaagggagttatccatccagttcaggtccaacacttgtacagcaattgcagtgttttcaggtgggttctccagttttgaagataatttgtgcaagttgcaattttgacatttgcaagtgtatacaatagaactgttgtttaaatgggcttttatagttaagtgcacactttgaaatcaggcacagtttgcattttctgccaattatctgtgctaccatcaaccccatgacaaaggtagaagcaagtggactaaaatggtgaaagcaagaagtctacacacccactcctgtctcatttgattcctgccaaaacgttggtttgaaagaaaagtacactttaaataacaaccaacacatacaatggcaccatgtgcctcacgtcattctaagcacttaatatatagtaaataatttaatccccactacaacccaaagagattggtaattttactaccccagtttacagaggaggaaacatggtagttaagtaatgtgctcaggattatccagttaataaataagggaaccagtacttagatccaggtgttcctggcaccagcggtcatactgtctctctgtatatcttttatcacacaggcccactgatgccccagttcaaattctatcttccaaaacatggccatccctatatgtaacaaaggtgatttccctttcctcagtgcttccaccagaattaggtgacagcatcctttcagaaagcatcagtttcttacatccatgacagagcttgcccagaggaaagagtgctgtcttaagagctgccttcccagctgcttttaatcctggcactgccatttgcttgctgtgtggtcctgttcaagttcctctaaacctctgtttccccatctgtgttggggcatggtgtgtgtgtgtgtgtgtgtgtgtgtgtgtgtgtgtgtgtgtatgtgtatacactatataatcccaatggattttctaggtaaaatagttgatgattctgtaagcttactaaaacaaatacagttgaaaattctcaacttacttaagcttacttatcagtttcaaattgaaaatgccatgttttctcatagacgatgaaaaacctcacaaggaagggagtaagtgcatgccaagtagaattgagagaataatcatatcctcaggagaagtttaataaagttttcctggaggtaaacatcctctagaacagaggttggcaaactatggcccataggtttttacatctttaaagggttaacattttcaaaagaaaaataacatgttattatgaataatattcacatgagtgtggaattcaaatgtcagtgtctataaatcaagctttcttggaacccagtcacacccacttatttacgcattgtccatgactgctttcacactacaatggcagagtccagttaattatgacaaagatggtatgtctcccaatgcctaaaacatctactgtctggccctttgcaggaaaagttagctgacccttgctctataatctagatcctttaggaacttctgattttaggattattgtcaaggctattgcttaaaagaacctcatataagtttgtgaaaagaacttggcatcattatattctactgcaaaaattacatatatgacatgtctatgaaagaaatgcataaagcaaagtcaggcatttaaaataaatttgtattatttgttgtgcattaacaattactgtgagaactgtgcagattatttctacaaccaagctatttccaactggggctggatatgtatgtaaagtaactttggtgatatacaaaggagtttcatttgttttgatttgatttgtagtttaagaaatgtgaaatccaatgcataatgatcaaaacatcatatgtacctcataaacatttacacctactatgtaccaaaaaattaaaaattaaaaaataaagtaaaaagaagtgtgaaattcagtttaacattaaaaattgtatcaagaataaatatcagttactccaattcagtgaataacacaatcttccagtttgctgtatgcattgttgcactgatggtctggaagaactgattgtttaggtgtaaagtccaaaacatttggaggaaggttaaaaattcaggcataagaccagtacaaagacggcctgcatgttttactctctgatcagatatttggcttaattgactttggaacttgtcatttaatttcctggaggtatacaagcccaaactcatcctgtacctttgtaatgaaatcccttaaatagtaacagataaaaatacttgtatatagttacagagatatacatggttaacaagtcatttatttgacactctggaaaatgagatgttctggataattaaaattattggataactgaaggttattattctataggaatcatgcagtataaattattttgaagtgtaattaatattttcctgacttcttttaaagattatatcaagcatgctttactctttcttgataacttatatattatgatgagtgtaagttattgtagtatgtgtaatattatactatgctgcaattatgttctcagggtctattaagacaggtgggaatgcttgcctctatattaaatgactgtagattcttgtgctttttaagttcagacttttctgtgtcatttttgtgggctcctttgctattggttttcacctgtcaattttctcagtgcctgtgcctctagaactatttccccttccttgccatctgtgatttgaaaatgagtgggaatcatttgagtcctttgtcaaaagacagttctctaccagggagagcacagaagcctctgagcagcaaactatatgggctttgtgacagacagttctttctctaagaggccttttctgcctcttgttgagtttgtggtaatcttctggagtggtgatcttgccagaagacaaatctcttgagcaacagaatcatactaaatagatgggaaatttcacttttgattaaagcaaagtgttatagttcttgcttactttttataaaagataatgctgtgagcctagttttcatctacagagggtcaatattaggcttaataaatagattacttggaacaatgattgatataactaattcttgtatttacttgaattcattgtctccagtttctggaatgcctgtattgcggtttgtaccatttctcttccatccacacagtgccatgtgtgccctgaacgttactgtaatgcttttgccttcaagttttgtcagtatccacacaggtgtgccacactccaagcaaggcagcatgtgcaaatctggatttctcaaaacagtgaatgaattgtgtatagtgtgactttcaaatcaaatttaaattcctttaaataacacagtccactaacatttcacattgctttctatacttcgacagacttgcaatgtagttttaagaacacttcttatatataaaatgaggtacatctgtgcacatgtgtcatagaaagttggatctgtttctataaaagggaaaaactgggcagatctattaattatcattttgtttacagttttacaaaaaacatgatcatctgtttgaaccaagtcctctttattcttttagaggcatcgttttccagctaagtgagaaattatacacttcaatttcacacatatgggtcatttgttcccatgttacacacatttccaaatagataccagtcttacttataattttgattaaatggcagttatgatcatgttgcataattttgattaaatggcagttatgatcatgttgcagcaggtttggctggcaaatgtttatccttcaaatagagctatagacaaaagcctaattaatggaattgttaacagcagcttcctatttgcaaacattagtcaactatatcttcagcaataattaatatacctcttactctccttgtgtcatttaactaatgtttgtgtcatatatattattccttataggaatcgcagcatctgaccccaggattcaccttacaaagtaagtggttttgaaaatccttcttagtccaaacatccatgtcctctgctccctcattttttcctttttcctacttaaaatcattaaaacatgaaagaacaacaataacaaaaagttattttaattgttaatttttagctctcagaaataagtgagaagatgtaaagtttgtctttctgtatctggcctttttcacttaacataatgacttccagtcccgtgatatatctaactggttcccccccttttttttttttaatctgttacttatctcaagaaggtaactcgggggactgcatgtttggagatcaatttaattcagaataatcatttgacagtaggaacatgaacagtaattgtttatatcttttcttttcagagtggaatgacccaaccaccagagcttctacaaagtcagtgtctttcaaatcgtgagtagttggatctccaaatcaggcctttttggggatatttggcaaggaaacagtgcctcaatgctgatctaatcttgttctctcctctgctccttgaaactatgaaccttgactcataataatatgtagtttggttggggtggggggagaatcaaatttcccattgtcttagtctacttggactgctataacaaatactataaacaacatggcttataaacaatagaaatttacttcccatagttttggagcctgagaagtttgagatcaatgcaccagcataaagggtatcttgtgagggaccatttcctcatagaaagctgttttcttactctaatcccacatggtagaaggggtgaggggtctctctcaggcctcctcttataagggcagtaatcccattcatgagggctcaactctcatgtcatgatcccctccccaaatacccatgtcctaatactatcaccttgggggtgaggattttagcatattaattttggagtaatacaaacagattataggacccataataaataaataacagtaaaagttaatgagatcaccattaagttctctaagtttgtaaatacagaccaggtcaatacctgggatacgaaaacaactgtgatttcagtgaaaaaataaatctctagatggcttgtttcccacattttaactagttcaaacactgtatagtatcagctaaagacattattttacacaatattcagtcaccactgactaggatggacgagggaatctaagcagccatgattggacatgaaatgttgagtggattgctatggccagtcagcccaagacctcactatttgcaggtcatcaggcacctgtatattaaagacaaacaagggcatccaggaagagccggaataagatattacatgatggtagtttgaagttcagaagccagggccctgcaattcattcagcactgtcttcattttttattaatgctaactgaaggaggggtttggagaaaccaatttcctcatattaactattgtagattttctaatatccatttgtccaagagagtatcaagggagtattatttctctcacaacttctttcatacctaataatagaaaatggaagtcgatttttttgtgtaataggcacatacttggaatttttcaaaatgaaataatttatgacattcaagtggcctaatggcacacttgaagtgaattgctcaccttttggaagatcatgaataattgcataaaaaaactgggaatgactcccaaatagactgaggatttgagaaagtaagtggcatttctacgttcttggtgcagtgcagtagcaaagccccaaagccctgaccccatcactggtccatttatttgcttttctagactgatctgtgccttctaattcaaagttcaatttcaacaaccaagaattctcaattttaagaagcaagaaaaaacaagagaaggggataataaaaccataatcccgatttaaggaccgaattatatgaaaacacaaaaatcaaaatcatctttgatgctgtatgttttagcttttccattaatcacattttgaattgccctcccccttgttattctaggaaacaatagatctaatcctccctgctttcactcctgcctcacttcatccccattaaaaagtcaataagattcacacacatacacatacacacacacacacacacacacacacacactcacatgcatttaggaaatcaacacaagtttccaaacttgaaaaaaatataaaaatagattttcctatgtaaaattatcttactcctaaagcaagagtattaggctcccactgtgaaatatgctgctttccatatataccatagaatgcaatgtttcagtagtttgtaactaacagaaataaactcgtcaattgtggtttatagttagaggctgcatttccagagaacagcacttcgtagcacagtaatatatagtgtagccaatacaactaaaatactctatatgaagcatcagtaaaactagaagacactgagtccattttatgaatgagctcctctctttttgtctgtttgatctaaagtccaagcaccatccatcagattttagctgcaataagttcccttcttactgtagggtatgggtttaacataggacagatcagaattgtaataaagttatttttatttttagcttccaacttatcggcttagccattactatcattctcccacatttaactacagtgtgctttttaaaccacctcctaggattttccatttggcagggtaatcctccaggtgattaagattattctgagtgcagacagactgctaatgcctgcgccttggtgagaagcagcccgtaagtcagccgtgatgcaggaaagacccaaggccagaaagtgtcccaagcacactcctgacacttagtgcagtaaagagagattagagtcttgtaaaacagaatcccttaattactgggacacttcattacttttcctcatcttggcctgttttccctagttgacaaaatgcagatcttccattggagtatgcattgtttataaggactatacacatgggcaccaggtctgaaaacattggccacagtgtgcctgagtataaacttgcaactagccagtctccctctttctttttgacaattactgctgtctctgagcctgaccccaacaatatgactggctttttggaaaactgggtattttccttctcagtatagtgcattggcatacagtgctttttatcagtgtccattcatgccatgacatcctacctgcttcagctggaactctgaatgcttatgaggcaagagtactgaattggggaagtttggagacctaggtttaatcccctcctttgtgtcagttgtgttattgtgggggaaagcactgacctagtatccagaagatatgaggttaaatcacaggagaatttatttttattttaaactatacagacagagtctgttaaagggaattaaacaaattaatgagtatatgtgtctacacatgcaggtacaccaacaaacacttgtcagtgttcaaatttaagcagttatactttttagtaattaaatctagcaacataaaaatacatttaactttaatcattaatactttctggaggagaaaagaccagaagttggtctcccacccctcagcctctatgattctgtgctatgttacagtcttggaacaggccccacctaggtcttcttaatcaaacggagtttctaatctcccccaaaaatgtctctgtcccaaaaaagagggtgaagcgtgggcataagaaggtgaaattgtagttctcagggctgtggagttgtatgtttacacagtaatatcatggctgtctattctgtctcaaagagatctttttatttcaatgacaggattcagactgtgaatggactcaccagacattgtgttgctttgtagtttctctttctttttctttgtttttccccaagatagagtctcgctctgtcccccaggctggagtgcagtggcaggatctcggctcactgcaagctccgcctcccgggttcacgccattctcctgcctcagcctcctgtgtagctgggactacaggtgcccgccacctgtagtttcttaatgaagttattaaagagcagtgagggagaaaacagaaaccaaggtgaagaacttggattttctttgttcagttggattgattcatctagtgtattataaatcttgccacttacctgtcagttcagtggccttcccaaatgcatgaccttgttggtcttttatgggacatcatacataggaatagataagatgttattaagttgccccgaaaaggactttcaggcaggttccatgaactcaagggtgtacatccagttagttcttaacttcagttttgtgaggactgttgaggagatggcagctccaaatatcaagctcctttgtaaaacttggttgttagcatttggactatgtccaggtggaaaccatccagacccccatttaactgagcagctcctgtgttttaaaccatgctgtcgagaatgcctggatagtttccataaaatcttaatatagccataatgttggttttttttaataaaaccagtttgccaacttatggtattaactatatgttttaaaacatccaaactctagatccagagagttgatggaaggtcttatggagacagattggttgaggccagcctgagtttacatgtgggtggttgttatgcatgtcacatgaagacatccttgattgtagcaatagttaggaagagagggcactatactatcacaggaatgacagacacaaataataattattgtgctgttgagaacaggtgccaggtgcttttatgtacattgccttattaaacttgccaggcatcgtggaggtgctccaaattattcccatcttacagatgagcaaagtaaagctagaataacagtccttcctcctgaagtgtacacagtccagtaggaagacagactggccatgcccacttattttgaatggatattttggctacaaacatacagaagagccctctgagtcataatgctcctcagtgagaaagtttgaatgcaggctaagggccctgtgagttcaaagctgtctctcatcctgctgagttgcctttcctcacgggatttgataagttcagggatttagtatgccaaagttttccttttgtacctggacacaacattcccacaacctggtgggatgtagtcccacaagaaattataccgctctgttttcgatgacacaaaactgggtcaaaattgttttatgtaatgaaaatgtcattatttctaaagttttctgtaagtgctatgaaaatttcattaccaaagagaatagaaagactgtgaggatgttttccagattgctataaccaatacaggaattacattatttttagatcaattttgaaaatatttttgctaaaaaacaattgatattcattacaaccctggccatccttttaccaaagccttcatcactggaaatgtttccttcgagattttgatttgaaatttaagaactgcaatgcattattgcagagcaataacccactttctagcaatttcatatattcttccccatgtagatgtttgatctgctacttggatgcaatttcggtagcaaattgactgtgtaatggggcaaggaagaaatgactgttattttcttaatcagattaattcttaatcagaatacatgatttggtacttggaatttaaaaatactgctaatcagtttgaggcttataaaagccaaactaactctcctgataaactggtaatcttggtaactttactagttgcagacattttggtttttaaatcaagaagtataccaactcttgcttttaacttgtcttgtatgccctgcatctctgagcttgccaaattttcctaaggacttaatatatttttggaagttctccactgcatcaggggcagccacctgggagcagagaaaacaaaatttggcagcctgttcaagctgtgaattaaaggtaattcacagtttgaaatgaatcagcgtgtggtccttgagaagagtaatcagacatcaagaggattttatgttgaggattgtatattggctaatgtgacaacaagcaatattggcatttggaatgtttgcatcaagaagcactgaagctgccggggcttgatgggtaccaagatctaaaatgggggctcccttcaaagagagctgtagatttacatttctatcacaaaagctgaaaacagagatgggttggctcagccatcatagttgaaagattagatctgatttttgtggtggtgttcatggacctaagtctatcataagatttgtgtatctcagatggcttttgagacacctctgtaatggaaagcaaatgtctctctctctcctcccccccccccccccccccccccccgctgaccacccctctctctccttctctcttttctgtctgggaaaaggcaaacatcgcttcctttctactagatttcattttttttttcaacaaatatgcattcagtatctactacatgtaaggttctgggctaaaacactggtaactcagggtgaaacactgcacatcattgtctcaaggaattcatggtctagtgaagataagactagcaccgacaatgccagcaacccaactaactcatacttattgagtgcctactatgtgccaggcacttcccatgcactttttctccttacaagcaatcccatgggtttcatcatcattatagtgtacagaagtagaaacccagctcagagacattgaatgagttgctcaaagtggcacagtaacaaagagggaggcagaacaggactgactccagaacatatgctcttaacttacactaaagccatcccatgagtcatttggaggtggctttactgatttgcagtcaggtgtgatcttgcccaggcattaggccaaaatggactaaccacaatgcaagccaaaatggcaatgccattttggtttaaatcaggggaagtattagatctaaatattataactgagttaggtcttgcatatactacacatgctgacatggacactgaagacagatctgtcctcaactcagggcctgcatccagattgtgtcaccaggactctagaatattcccttcagtgaggctgaaggatctattcctgcaagagacttagaccatcacaaaaataaaattcatataagattgattttggtggcatatcccttcagaaatgtccattgtgccacattaaagtgaagagaaaactaatatttgggtctatttttataagagactcatccattgcctttcatgcttaccaacttgtttgataattagaaagtggctttatatcctcatggtgaaataattttcaaaaatatccccatctgttatcaaccacagcggcatatttccaaattcttctcagcatttttaaacagtaactgggagtgaagcaaataatgctggtggaaggcactgaaattgataagcaagggaccaaagttaaaaaaaattcacttgtataattgaatgtaatgttgtgataacacacccccacacacacacacatgcatacatatgctctgtatcccagaacagtaggtcactctaatgtctgatctaatgagatgcacacatagacatatgcacactcttttttcagttattacattgtaaagtgctatgatcagagatacttttcatgtgcacagtgaatgataattttaacacactttcacacaatacattagcccatgtgagtggcacagcattcctgttagatagccaattgaaaagaaaccaggcgtagggaggggaagatattttcctaaagtcctccacctagggagtggcagggctgggactagaagccaggattctgcattctcagaatatgctgccttgtccccagattccccagatggctgcagggccagaactcatcagagtcctgacaagtcttccaggcccagatgaagaacatataacagcagtgtagacaagctccatggattatgcttagaatttataaagaaacaaacaaaatccaactgagactggagtagaagagaagaaatatctacttctgaactattcattttgtttttccctcctatcaagcatctcacaaacagccagatcctttaccacaattaggttactgggaatgttaggtttaaatagtctgctcttgacaccttctcagagttgcttaaagcccctccattttacactgacgagtagggagcagtgttggtagaatactgcagatgcacacaaaattacagctgtaaaatcagttgaagaatctgacaaatgcctttctttgtggttcatccacccactttaacaatgtggaccaaaaaaggaaaaggtctcaaagctatttgattgacatctacaaatatgctgccaagactggaacagagtaggtgggatggagtagatggggttggggtaggtcttctgaaaaccaaaagaataaaatttattttctttgctaccctgtggttttttgacactgaagatctacagtacaaccccatagtatactgccttgtccttgccaaaggttctagggtccctgagagagcaataagtgagagaaaagtatccagagaagagtagaagctaacgatttagcaacctataactctgacagctccattgcctaatttctggagttacttgttttggcataagaagcccactttataaaaattccagatggagatttcaattttgtaactacatagaatatttcttctttttttctttttttttaacttttattttaggtttgggggtgcatgtgacacgggggtttgttatacatattgtttcatcaacaagttataaagcccagtactcaatagttatcttttctgctcccctccctcctcacaccctctcctctcaagtagaccccagtatctgctgcttgattctgtgtgttcataagttgttaacatttagcttccacctgtaagtgagaacatgcagtatttggttttctgttcctgtgctagtttgctaaggataatagcctccagctccatccatgtttctgcagaagacatgatgtccttcttttatatggctgcatagcattccatgggatatatgtgccacattttctttatacaatctgtctttgatgggcatttaggttgattccatgactttggtattgtgaatagtgctgcaatgaacatacgtgtgcgtgtgtctttatggtacaatgatttatattcctctgggtatataaccagtaatgagattgctaggtcgaatggtagttctgcttttagttctttgaggaatcaccatactgctttccacaatggttgaactaatttacactcccaccagcagtgtgtaagtgttcccttttctccataacctcaccagcagctggttttttttttttttttttttacttttaaataatagccattctaactggtgtgagtacatagaatatttttctatttttcaaaagaaaaatcttttaaagtacctattcctcataatatatggaaattgtctaggccatctaaaaattgaaagggtcattctaggtttctccaaaataatttttgtatatcacatggtacagaaagaaacgaagaaaacaatctggatgtgagcagtattcttgggtaattgcaaccaccacttttggaacctactatatacctggcaccatgaaatattttataagcatcagctatttcatgctcacagcaacctcgtgagatagatttcgctatctccatcgccatcgtcaccactatcatcgctcccaggattgtactctcaagggctcagagagaatgccaaacacctgtggctgcacagccaatgctggtagtcatatttgaagtcaggcctgcttggtgctctttccactgtgcaatttcactggttcacttgtttaatcaccttctaggctcataatgtctctgagaggttgataagattaaactgattttatggagaaggaaatttcgtcccagaacagttaaatgacttgctcaagatcacacagctagttgttgagggagatgaaatttcactccaggattcttggattacaaaattcaaaccttttttaataccctgtttgcctcacccacataaagtttcaactgaaatcttattaattgttaaatacgaaggaaaaataacaaaataatcttaataatactactttctagttctttggcattatgtgttttctacacatattgttatataacacataatatatattgttatattgttaaatcttttagatttggtcttcactcaatttctggagcaaggagacaggggagggagccattattgtcctagagaggtcacagatgtggggcatccatttctgagtggcttaagttccagcgctctcactcccctgtcatgtgacttgatgaatttatttggtgcttttctgagcctttgtttcttcatataataaaacagagatgatatattactcagactctgtagcgaattgtgttgtcaacagatgagctcatgaatgagctttgcagtcacctgctctcattggttctctttccatgttagaagtgaggaaagtcatgcccaggtgacctaagtgaggcgtcccagctcacacaggtaatagtgttgccaaagctcagtcctgtttcttgactcctagttgagtgctatttttgctaatcttggccattatttttcaaaagtgttctgtcaatgcagtttaaatcaaaagatcaactgccaatgctgtcagagagcgatagacttaaaatcaataactatgtgtgccactcctctcctaattagatatccccagcatgtttctggatgtttcatgctgctgagaagagtgacggcatttttccactcaattatacccaaggaaacattgttcaatttagtaatagttttagcacttgtagaagaatttgaaaactttagaaaaatctcatacgttttacaatctcactgtcttagagaatgggatttgggactaggtctaccctttatcttcatgcttttatgcagcgctttaaaattttgatattgaagagggcctgaaactgggtgacctgtgttgccctttactactggattaaaatttcaggttgctactatggtaaccgtaccttgaaaattagatcctgacagagtcactaagaaatgtaaaagtgcactgctgccatgaactttgaagaaaggttgcatacaattgtcagcgacagcctcttaattgaaataatctgcctttcccatctgctagaaagagtttgtgtgtcttggggaggagggacaaaaagattatatcttgatggatttttaacacaaaaatggctgtagttcgaagcagagctgttttctgcatgagatttaaatcaacttcagctcaatttatgctattcagaaagaaatgtgatactcagtattcacggtggcaagaagccaagatacacagtaaagatgtaacgatactaagagaagatactgctggggatctatcccagaaaaaccccagtggccccagggtccaaatggcaacctttttcaaaccacagatttctgtgcccaggcttctgggaagttggggaatgcagagcagccgcatgacagactttcagatcaagagggccagcagtcactgatttgcttagtggcataaaagctgagatcatattgatgctcccagagccagggaaatgaaacaagcaacatagggtctcttggctttcaggaacatgagggtgagtggcacttgcaatttcaggaattcctttgtgcatgtctttcccaaggcaagcacatcacggtgtgtctggctttataattagttgtggctgtatctgtgtttccataacaggacttttgttgttgttgttattgggcctttttcttttctttatttttttcgacattcttataaaaggattttgatttgtgcttctaatgccacacatagaaaatgactctttaactctctgaaggtctcaaaaatttcagaccaaaagtgatgttctcactctgagaatgttggtatactattttgcacaaaacagatatcaaatattaaatctgttggacaatatcaagtagttgggactgagggatgtggagccataggaattctcaccacctagtggtgggacagtaccttgaggggtagttctatctaaagactttgggtagaatcgcctctcacctcatttgcgagtctcttcattttggtttggtcagcatgggtactaaggagactgtgatagtgacgactgaattgtgatatacttccaaacccaagcaatgcccatgaaagcccaacaaagacatatcaccagtcttctacctgtgaggactgtggaaccacaggtagcaggatgtttgactctcctgaacataatagtttcacaaatctatttacctgagtggaaggggtggtatccactcccctatttcttcagcagccggtacaggaagaacctactacacaacagataaccagaaaatattcttgagtgtaaagtgaaagaatgatccagaaggtgtcacttgctctgaagtaacttttttttaaatattgtattcttatatttgttaatccatattttaaaagtagtatcgtaagaagaaatataaatgcatgcatgtgtgcatatgtgtgctcatatgtatgtggctggaaagcaaatacaatgcagaacttgaagtggacaggctctgtgctggaatggctgggttcaaatcccagctccaccatcttttagccatgtgatcttggtcaagttacttaacctctctatcactcagtttcctcatctgtaaaatggtgagtagtaatagcacctacatgatacgattaaatgattgaagtgcttatcacagtgcctggtacgtaggaattttttgataaacacttttattaatcatgttcatgattattgcggtcatgatcactgagtcttttgagtgagtgctgtttgtactacattccaatcttcagtcacttgggaagcctttcactctcttccctgacttgtcccagaggtctccagttggagaaagacctctccagaaagagcaaacctggactacattgaacatttccttggctcacctgcctaccccagtcccagaggataaaaacaaagaatggctagaacgtcttaaatgtatagatatttggtactaggcacagtcttctcgttcttggagctcaacacagcatcttatcccagtcacaattgtactcttagtttgtagttatttctaaaaataaaagctaggacttattaagtgccaagcactatgctgagtgttttatatccactagctaattgactatttacaacccagtgagatgtaggcactaccgttacccacattttacaaatgaagaactgggtttcatgacttgaagctaaatttttatagccagtaatgatggattcattacttgaacttatgtctggttgactccagtaagagaccccttaaccctggccctcctgcctacccatggactctccaatctcagagtccacctggacttgattgtcttgggaaatggcaccacctcctcagaggtagtggagcaaatacaagaatacaagagggagaaaacaatggaggacaggaatttggccagagatattctctgctcctgagtcccaaaacatcctctcacattttgtaaaatcaccactggtataatttgctgagtcataatttttaattctgtggttcacatatatatgaaaaactgcttttgaaatatataacaagcatgttgtcaattttctaatcaggtggaacaaattcttttctttattcccagtttttgcatgcataaaggaagtcgtctgaataagaaaacatgtcaataaaatttcatggaatagcctctgccattctgtgaaataaacattccattcccttgcctgggcaaattgttcctgttgctgcatatctacttctgtttccttggtctaaaaagacacttcagactctgcctttaattacgataaggcttgactattaacccttgagaattaaccttatttttgctaggagggaaggtaaaataacatttaaattggttttaagagtaggaatggaatctcagaagacacactaatgtagaatacactgtatatcaaaatatataagtgcatagttgtaacagtggcttagtaaacatattgctgagtgaactatgaaaaataattcaccaaggtactgtttcccatactcgtaagcactaagttaagagagtaatgccataaagtacatatgcactgtttaaaaatatttgtgtgttttttaaagaatactttcttcaggcccaatagacgaatcattttttcttcccttgctaaaatgtacactgtaaggaatttaactaagtggtatattaagtgagggtctaaaatagttgtagaagataacaattctgagcaaagaaatgtctttagcaatttgattctgaatgcaacataaattaactttataaaatagaattaaaagaagttcagttatagctttccaatttttcatataatttagcatttcatactcattgtgtttgctactggcacttttattataaaagcctgaaactgcaggtcaaatgagtacttatgtggatataaatacactgatttttgtttttcagagagagatctttctctgaacaacatgatttatccaagttaagagactacctctgtggaagagcaactctcttgaaaaccattcttcacataaggttttatgcaaaactcctagaaacctgttcaaaaattatagaataataggaggtgttcctaagctttcaaccctccaatgctcttgcttaaattttagatctcaactaaagtaacttgacttttcaaattatgtttcaattcaggtttgttgtcttttaattccatattaaaaagtttgatgagattaggatgagaagagaggggagatgataaggcagttcattatgcacatcaaagcatttcaaaacatatctggtttaaagccattaaataatttcccaaatttgaacctgtggtataaaactctttttttagtctaattccaataacgtaaatgggatacatgaggaaagatttcaaagcaacgtttcttataaatagaatttcaatagcttctccttttaaaaggaaagcaaggggtaaagtggatgaatcatgtcagtctcccataatgagaaaacagagaaaatgcacattcacatgcccaccctattatggtgtagtttggctgcatgatggttattactgaatgattataatacacaattttacatgggagataaaaagaaaatcatatatagatgttttcccacttgaagcaaacctctcacagaaattctagcatatatttccatacagataaaaaggtagtttttcacccttaaaaagaatccttcactttgaaaatgattcaccatagtttccctctaaatagtaagctcatctcatgcatttacaatatggtttgattttcaaaacatcaatttacatgcactttccagtaacaaatctattgtgccatgtgatgcttacttgtataggataaaaaagcaaaagtattttttctaattaatacacaatattataatgtacaacatacaaatatcaattcgttttgttcaaactaataataagtacttggaaatggagatgcaagaaaaccccacttcattcacaacagttatatggatttacattaaaaaactataaaataacaccgaagtacataaacaaggtttgaaagaactagaaaggtatatatgttctcatagcagaagtgttatagtgttatttctcccaaaattaatttataatgcaattccaattagaattcctcaaaatgattctttttggcatgagacaaattattgtatagttcatatactaaaagggtaaatgctcaaccatagtaaatgaaaagaaagaacagtaggaaagattttcattactagatatatgaaaaaactacaatacgctttaacaaaatcaatacattattagcatgaaaatagatactagatcaacagaagagacaattcaatctctctccctatatatgtatgtaatatgtaacaacagcattacattgattcaaagagaaaaaaattgatatgtaatgatgatactggcactactagatctccatttagaagaaaacaaaggtagtttcctatcacatttaaatatattaaagtaggaagagaatgagaaaaaataactaatggttactgggcttaatatctggatgattaaataatctgtacaataaacccccatgacaggagtttacctacgtaacaaacctgcacttgtacccctgaaattaaaataaaagttaaaaaagatacaaatataaaatataaaacaacaacaatgaaaatacctttagtaaaaatgcttggaactctgtttctacaatctaggggagagggtccttcttaattaagtcagaaatccagaagttctaaaagatgaataactataaacaactgaaatataacatttgtattgaaaaagatgccatgtttctataaacaaatggaattttcctacatacaatgaaatgaaagtttgtatgaataaaaattaagtttttatgaagaataaaataaaaacagaaaaacaaatgtagacaaatatttgtttaaaaattattaaaatgtataattaaaaattaaaatatttaattaaaaattaaaaacactatatagcacatctgacatgccaagcagtattctaagctctttacctgttttatgtcgtttattcttttttaattaattgatttatttttttattatactctaagttctagggtacatgtgcacaatgtgcaggtttgatgcataggtatacatgtgccatgttggtttgctgcacccatcagctcatcatttacagtaggtatttctcctaatgctatcccatgcactttccagtaacaaatctatggtgccaagtgatgcttacttgtataggataaaaaaggagaagtatttttttaaaaaatttgagtcgatagtttatagtttgcttgtctttaatattaactatttatagtccagcagattttgctaacacaagttgagatggagatgccactggctgcctaaaagctaattctgtaaagctcattcttgattatcaaaatgccgtatttcagcagcagccgatcaaatacggccttgttcttgttctcatgggaatctaatccttgagtcccttctttccccttaaatttgtctggttcacagacacattccatgagctgaaaatctaacaataaattgagaaaattagatcagtttgcataacatttgaaaaggaatgtagcctttgtttgcacagccaaggtaaaatggacagatcagtaactggaagtgtggtgtagcacctcacagaacatgaattctctaaagaaccctggcaacccatgtgaaaatgttacgtggaatcatcattttgaatagagcaaaatgacgctggaaaagagctagggctgagctgtgcagcgtcatttgagatctgtgcatccagaaactataagcacatcttgaatacagaagacgcacctccctgctttcacggtaatattttaaatagtgtgctggctggctttgctttttaaaacaaatgtgtttaatctttgttagggtgagggtgaaaccacacaagaacatttacagcaatatgtaaattgacattatatggcttttctactctcctaagaaactttattaggggaagtcactttttttctgcatagaaatagcagcccctaaaatatatctaagcagttaaggcttcaccccaacagcttgagtaaacacatttttttaactttcccatggacttcaactttgaaggttttacataaggtaattctgaagtggttgtacagagttaatcctgggtcttttatttataaagcattaatttcagactttttaaaaaatgtaattttctcagataatgtctgagaacaaattgagcttctaagatttaaaaagaaaagatccaattgtgtttatttgtggccaccaagcaggtcagtgggagaatcatgtatgtgtcactaagtgattattttgagaaattgagtatactgactcatcttctaattgaaaattgcgttgctgctgtgcttttttaaaagttacttattaatatcagacaactttccttggaagcttaggctatatggtcttatttatgccatgcaaatgatgtgaatagttgaggcaaataaaatcagaggaaaagaaaataacctcatttttctatcaattatgtgtatgtgtgaggcaaaattattttaagtgtgaaatatttagattctctttttctaaatcctttatcatgaaatagttactatgaaatattaattggtattcagcaaaaaagggaattatatgatccaacatatttgggaaacagcgggttaaaaaaaactaacaagtcttttcattgtaggaattctttgagcctttaatatgcaaatgctcactgtgtttctacaagaggggtgtagaatatgaagtgtttttcaaactaacttggctatagaattttttttcccagaatctctaccaacatgatgtggaataatttgggcctctccaatctagataactacaccattatagagttctttgtgcataggtagactcagcttcaatatctacctggagtatggatgctcattatcttttatcttgccatcttcactccacctttactccagttgccccgccacatctgaaaatacattttaaatcaaatatcccttataggcagcttagtgaaattacagataatttgtatttcaaaattttgggggctttatttttgtattgataatatggagggtgttctgaaattccaccaactttcacccagatttcttttgtgaggagccttttgtctgtttttttttcccccctcagaccacctgcaactgtaagttgtctccggggtggctggctgggatcatcttccttcactgtgaagagaaaagctggctgaatagagacaaaaacactgcatactcactgaacattcttgggagataatttgctgccatgttttataaaaccagggactggatgtgcttaagagctttttattaaatattgccaagagagataatagtcctattatccaggtgacttttgagaccattctgaatgctagtattattgaaaatgcagtaatgaagtcaactctcaaatctaagcatgtggatcgtccacttcagactgtgtcttccctagctggcttgttgaggccactcagcccagctctgggctgccttcccctgccctctgtgggaatgtgttttgagaatgcaaacacgcataacattagactgagaaaaaatgcaattaagaagatattttttaaaaaatgatgggaggaggtgatgcgttatacacaatccagagtctaaaggaaaggacttcccattatgccctcattttctgtgcactgcttggctctattaacgccagtaatccagagctgatacagtccctctgaaacagccaaattatattttcaacaaggccaagaatgtgtcctttatttaagcactttcttgataactgatctattatgagaagcatttactacatagttaaactggcaagaactagaatttctggttttctgatctacacacttaaagcaaatacgtttctgtgtgcacagtacttcatttaattatcattttaattactttattgacttaaacattagtattgaacacattttacaacaacaatgaatacacaagcaatttataattttcattatttcttatctcattcacattatctgaagcttgatagcagataattatttgattgaatatgaaaacacccaaaatattgttgggtagcagatatgagctccaattagttgactctttcttccctcaccaattacatatttttttatatttatttctggtatatacttaatatttataatacgcatgtttggaatttgtacacagggagatggctcagtgattgtatttggactatattgtaacagctaccttatcatatctatgaagacaaatattgaaatttttatttctggaattaacattttactttagagtttctcattaatcattacttttgtttattttatgtatggtgttagagacatgatttgaaaatattttttctcagcaaactgggtagggttaaatttagaaacttgacaatagaagaactatctacagaaaataccaaagatgaaaatacaaaatgctgagaggctggtacaaaagtacagtttacaagactgtactctccttgaggttggaagttgctggagaaaagtggctgatggtctcacacctcatctagctaaactcactttccattatcttggttacctgcgctatgaagtggccattcaactttatttaatgtttgcaaaatctggctgattgattgcctattcactgaggtctggggaacctcagattgaaacattatccaggcagtagcaacatgtactttttcaagggcatttaaaggaatactagtaaacttctggtgggtattcctagtctagatttatggttattctttgaggaaataccaagagtaggtagagatacctggcttatcttgtaaaattgaggtaatcattttgcagggatgcttttcactgttagttgagccttctcttgctgttgcaattttatttgtccacagggagaaaatgggtagggtgggaacaatgctaggaatccgggtagcagtgtgtgaagaaatgtatattttcatctacaaagagaagataaattaaattcttagaagtcagaagattcttatgtttgctgtaagataaaattctgctgacaaatccacctcaggtggacctggctttggggaggaaggtccttaatttgcttttctccccaaattctgatgaaagccaagagaaaaatcaattaaccagtatcaaactagggctcaaagatgccctgatgtggcactgcgtgttcattggtaagcctcagtgtactgtgagcaagtcgtcatcatttggtgcgtggctgatgagagatatttaactcaaagagaagtggcataatcgttgaatttgactctgccagttgacttaccctgaaagcccagagtgtattggcttcaaatggttaactgacacaattttcaacagaatattctcctccaactggttggagatccaactcagtgacttgagattagctgaaaggtggaaaggcttctctgcctctgtaacttctgttttagcaatggataactaggagttttgttggtggtatggttaatatagataacaggcatttcttttgggcaggagagccttgctatttgaggtgaagaccaatggcttgactttcccccaaattccacaaacacaaccatataaacagatttttttcccatgaactccattctagtgtcctagaaacaggtagatttatgcagattaatttggcatagtacagcaaattgctgctgtgagatatatcatagaattacttcctagctcaggctagctaatggctagaatgaaataaaacataaaaatacatttacatagattgttttataagtctgataaagctttttgttacctaccactggaactggacgtgtttttgcaagcagcataagggttgttcatgtaatactttcattatttccagcaagtgtaaaacaaaataaaaacaagaacattgaatttagccgccattaactaccattaactgtaatttttcctgacaagctctctctcatctgatgatgagtgaaacgctgggaaaagtcgactgaaaaattgtataaacgttgatgaaatatgcccttgtattttaagcatgcccagttcagacatttaaaatcgagcaatttataatgtgttagcagtcagaactccatcatgttttaaataaatttatttttctacttcttgtgagactctaagtcactctaagaagactcatgacatttcactgtacaaggcaggtcacaaattgaataatgtgaaataactttattagagaactgaagaaaatgatatggcaataatgtgttttacagtaaaatttgatagccctctaaagatcaatgagtgtgtttgtttactttgaagtgaaaggacaaaggcttcataatggaattcagagaaatgcctgaattaaaggcatcattgccagataaaatggctttcctagtctgtggtgaattcagaaaacctaccacgtactttgcagtagaaagaatagcctaggtactgtctgtgataatatgtcattataaagctgccctagaatgaatgaaagtcctcttgtggccacacagaataaaacaagctgcaagtcacaaggttcttgtcctgtcccaaacattgattgaaagggcactttataaagggagaaagaaacagcgggggcaccctcatttgcatcaccaaaccctaatgatggaggcgcttttatggacacactgtgtacacagaataggttcaattaaaaagaagccattttacactggcctttaccccaccaggattttttcttaaagacaaaacaaagaccatttatctgggtaacaatacattactttaaaaaatgaggcagagtgtagaacatagggtaggcaagaggcgtgggtctcccatggttttatctttgccacttcttttcttagccagtgcactgtagatgtcatgaaagcatatctttgtcaaaataaggtaaatatgaatgacgattggagtaggcaggaatcttgtagctgaccctgactaggaagagcaagattcagaacttcacttgagtttaaaatgaagttccattagcagggaccaaaatgaattgctgtctgataattctggcctcgataaaacgagttgggcatttgagttcaatgcctatggacagatgttccacagacaaaaaacgaggctcttaattggcactaattagcacccttgttggcagggagagattgacaaggttatttctatggcacttcccctgctgactcccatagctgttctttccaggataaggggagagcaatgtaggtaaacttatgctcttagccttcaaggattatttgtgcccccaaacaaagacagtcttcgcatttctaagctgtcaacttagtaagattctttgcctaggatatacattggcttttatttttaattaaataaagtgtaattagtaggaaacaatcaatacggtagagtgacaagcacttttatgttggtttgtttgtccctgcttaaagaagcagaagcaaaaagaaaaaaagaaagaagctgtattaaggatgagaaaaacaatctaagcacattatagatgttaacactagtagcgaacaaagaaggtgttttatactggcacaaattcctgcaacctgctgtgcaatacatcttttcaatgctttgtttataatcaccttcatctgtaaaatggcaaaatgccaccagcctcctgagagggctaaagtctgtaaagaacctggatgtcctggggcataaaggtgtcttataattataagctatctctaaaatgagtagcatgctgaaggaactgtggctgcattctaatatacattaagcagagctatatggaagtatgctttaagtttctgcaaatgcttctctctctataattgcaaagttgagaattatgcaaaagtagttattttgcatttattcaatttagtgctaataaggaattcaaagaatggattaaagtcatttttagtaacttgacagatttttgtatactgtagcatgatggtgtacattgctgaagagctggagaggctcttaaatctagactaagcccatttatttttctaggaaaaccgagggattcgatatccagaactagattcaaagaatgctcatcaacaacgcacatgtggtagaaatcatgtgtgggaatggggcagctggatggcaggttcctgagaagcagagcctgacataggcattcctgtgaattaactctaaagaaaaagaaacctgtaaggaagtgaagagaacaagtgggatggtgggcttggctgcagcttgatcccatgaggagtcctagagcatgaaccaaatcacagagttgtcccacattgaggcaagatggggccagccgtttggctggatactggctgaacgcattcccgtcatttggataggggtttcccatccaagagcaaagtggctttccttctgccaagggcaagtatctggagaagggcccacctggaggtccctggagaaggacccacaatagctagagcatctgtgcaccagtctggtaaaagagatgagggaagggccatgctaccagccttcactacagggctaagtttggtagagccaggtagcttcctatctaagcaaggccttttgtttcctgagcaactttcagaagagcacagtgttgactgagcagaataaagcccatccttagatagtgaaatttttaaaaagtatcctttgataattagcaacagtatgcacatagatgagctaagcaatattttctttgatgcgaacagtccttcttgaagtacaagaaggcaacacagatgttcattcggcttcttatgtgttcagatactgtggaaacagaattcccagttcctcaaacaaaacatttcattcatacctgtccatacttgcatgtgcctcctgtgtcatgcctctctgcctgtggtactctggaatctttgtcttctattcacttctcaagattgcacaccagcataaattcctaggtgaagacttcctagaacacaggtccacacaatgaaaaagtcactacagaggctatgtaaatactccaagttccaaagacaaagggatttccagtacttcctcaaggccatctctcatagcttagatttcctgtccacaccctggaacctaaagcctaggctcctctcagtttactcacactctttgcccctgaaggcattttccttgtcaccaagcacctactacaattgaagagggtacagtcagtcccaagcagccctaccaggtttctcttacctcctcaccatggatgcctggtatcccttcctcatcagcattctctgatgctgacactggatcccatccaagagccatacactgtgctggtacatcacaatgccaaccaccctttttacatactcttaaaacaaccaccaccagattcccccagctcttcttcccccaaggccacaaaaatctgcagactccatgcatcccaatagtgattttcagagactgtgacttctgttgcccttgaagaatcctaattaggggaattgcctggccgaagttatgctttagaatgattactgaagccatagtgagagatcttgaaggcttgaaataggtagggatagagaagagaggacagactggagaaaggtatgatatctgtgttcccatcaatggatttgagtaactgacaagatgtgtgaagtgggaaagagaatagaagtgttaaaatgatcaagcttgcttgcttgataatttggataggtggtaatacaatagagatatcttagtcaatttgtactgctataacaaaatacctaagactgggtagtttataaagaagagaaattttatttcttcacagttctggaggctggaagtccaagaccaagacaccagcaggttcagttgtctggtgagcacgtgttatctgcttccaagataatgccttgttgctgcttccctaggagggatgaatgctgtgtccttacatgctagatagaacaaaatggcaaaaacggcttaacaagttccctccagccttttataaggcactaaccccatgtttaagggcagagccctcatggcctagtcacctcctaaagggtccaccttttaatactgttgcactggggattaggtttcaacatgaattttgaaggagacacaaacatgcaaaccatggcagatgcaaaagtaaagcagaggaattaacttctgacacattctacaacatggattacactcaaaaacattatgctaagtgaaatataatatgctaaaagccacatattatatgagtcccttcataagaaatatctagaataggcaaatcaatagagacagaaagcagattagaggttgcccagggatggagggtggaggggatagagggattgggagaatgatagctaaaagttacagggtttcattctggagtggtgaaaatgttcctgaactagatcatggtgatggctggacaacactgcaaagatactaaaaagcacagaatagtccattttaaaagataaatgttatatgtattttattacaaaataagtagatagattaaaaataaaacaaaataaatgaaggaatgcatacatacatacatacttaaaccagtaggagggacatgccagagatggtgagctcagttttagctttcttaggcttgaggcatttgtggaacattgtggtggaactggatttaggtgccaggagctcaaaagagcgttatagctgtcagggctgtaaatacattgcctcagcccacccattttggagagctgggaaggtaggaactggggcaaagccctgtattagtttcctggggctgctataacagagtaccacaagttggaaggcttaaagcaacaggaatgtcctgtcttcctaacttccagatgttagaagtccaataacaaggagttggttccttcttaggatgtaagagaaggatctgttccaggcctccctccttggcttgtagacatctgtcttctctctccctgagtctcttcacatactcatccttctatgggtgaccgtatgcaaattgcccctttttataaggacaccagtcatatcggattagggatcaccgtaaggacctcaagaccttatctccaaataagaccacattctgaaatactgggggttagggcttcaacgtatgagttttaggtaggaacgcaattcaccccctaacaagcccatttcctgaatttcccttttctgaatggcagcaattttaacgatcctccagttgcagtagtaatcagctgcacagttctgtcccatcctacgtagagggaatttaggggtacttacccccaaaaccactctggagcttccgtccattcttctgcaatctctcagaataacatggacttagggagctgactaagagtcatctgcctgcagtcattttcaaataacattgttattgcaattaccaagttgagaaaagcctgcccaaccactacttgggcaattgataaggtaatgaaaaaaacaaacagatttacttttttatgtgaagacaaaatgtttgtaggaagcagctctcacattctttgtaagcagctctgctctgtggattttctcagcatctttgaccaagcctggcttgtgaccatcttgttttcctatggtagttcattctctgtttctgtggtgggacactgtgccaagagaactcgctcaagaccaagagacagatcaggctgttgttccacattttctttccactaaatcacagttttctttcaagggaaggtggctgttgtgaagctgtcaaactagctgttaaatgggttgaagtgaaggctcctattaacaacagcagctatctctgtcacattcaagttctgcagacagttacaaggcaatttggtcctgataggtgggctattaaaaataacaaaaggcaagaagaatgagagaggaacaccctttttacttcctggtttcaaaactaagggggcaactgaatatttcacacatggacctagcctgcagttagtgtggccttcataatctcacagggacaaggcatcctccctccctgggtgttttcctttagccaggtctgggaatggaaggtggcagtgggggagacagcaacaaggtctctatcaagttcaaggtggccaaagagttctgaatgctgatcataattggaaacagtgtcactggtgagggcagtatgtgtgctgtgtgtgtgtggttgtggggagcgggtggggggcagtgatgatgccctctgcatgagaaaaagcagtgtggacagttttacagtgtcatatccaagactgtgaaggttagacgacagacaaccggaagagaattaaagggaaattatctctcagcttaagggagccccaacttaaattggatttgtgagttaacatttgccttactgtgggagttacatacccgtacagggccctgataggagcctggatacctaacccctcgtgtcatggtttggaaaatcaattagccagtgaaggacccggccttgcgtagactcagcagaggagaaactgctgcaacccaggcagtctgcacctctgaccagcaagaatggacacatttttcttctgttgaaatagattcagagtcccattttgcctgtgcttaatgaattcatatataacatgatccttaccccagcttcttctgtaatcactaaaatgtgagcctccttccatcagccctcacatcgtattagagcaactcatccaaattggcagcccacattaaccacatgcctgcctgtgggttttattgcgaatgggggcaggtgatttgtactgttgcgaggaacattgcacagacagattccttctttactaccctcaggtttggaaattccaaagtcagggaggaggagaagagtctttgcccacaggatcttggcttggtctccaccccatccagacagctgtctctttaatataatgctttgtctctcctggaaaagacaaagctcttttcccttggtgaggcttctgctggtcatatcaattgcagttttaatgtagggaaaaaatacagtgagaaagagattaggcaggaaaaaatagctctttttctctgtgtttttcttggcagatatgtctaggaatgcattggagaccttctgccgtacttcgttatgcaggacagtaagcagagtggttagggacatgggctttggaatcaggccactgtggattgccagaccagctctccgttcttctcttgtccagctgtgagacttttttttttaaaaaagacggctctatttagatgcatataacataaaacttaccattgtaaagtatacaattcagtgttttctagtatattcacagagttgtgaaaccatcaccactgtctaattctagaatatttttatcaccccgaaagaatcttcataacattagcagtcactccccttgccccatccccccaagccctggcaaccagtctctttcagtctctacagatttgcctgttttagacatttcatatgaaaggaatcatgtgatatgtggcctttggtgactggtttattgcacttggcataatattttcaaggcttattcatgttgtaccatgtgtcagtactttcttcctttttgtagctgaataatcattcatttcatggatctatcacatcatgtttatccattccatcagttcattgacatttgtgctgtttctactttatgtctattccgcgatggttaatgatgttgagcatcttttcatctgcttattggccatttgtctttctgtgtctgtcagtctgggctgctataacaagaatcccataggctgggtggcttaaacaacaaacacttgtttctcacgtaagtggtggttgggaagtccatgatcaggatgccagtatggttgggttctcgtaaaaaccctcatcctgatatcctcacatggtagaaagagaatgaaaggaagcaaggtctcttgggtctcttcttagaaggtctctaatcccatcatgagtattcaaccgttatgacccagtcacctcccaaagactccacctcctaatatcatcacattgtggattagagtttcaactctatatgactttgagggagggggacacacaaacattcagtccacagtggtatcttctgtggaaaaatgtctattcagatccttcagccctcacatcgtattagagcaactcatctaaattggcagcccacgttaaccacatgcctgccttcgggttttattgggaatggggacaggtgatttatactgttgagagggacattgcacagagagattccttctttactaccctcaggtttggaaattccaaagtcagggaggaggagaagagtctttgcccacaggatcttgccttactgcaggagttacacaccagtacagggccctgataggagcccggctatctaacctctcgtgtcatggtttggaaaatcaattagccagtgaaggactgggccttgcatagactcagcagaggagaaactgctgcaacccaggcagtctgcaatccaggcagtgtgcacctctgatcagcaagaatggacacctttttcttctgttgaaatagactcagactctttaattgggttacttatcattttattgctgagtttccagggttccttataaattctggatactagatccttatcagatatatgacccacagatattttctcccattctgtgtgttttcttcttaacttttttaaacctgaatttcctcacttgaacagagaaaataccagtataacctcccaaatttcatggagagagtcaatgaagtgatccattagcgcacttagagaaatgaatgtctggcacacattaagcttacctcaataagtcttagttattattagctagtattggctgacttggatttattgtgagacagagacaaggtgtaagccctcaagtcataattgtacatctgacaggtgtgatgtgaaaggttcaaagtgctttgattgaactaacatgttattcctaggatgattggagcaattttatttgagggactacatttttattctgaatagatttcctagttctagatattaaatactaagtcttggccagtattggggtctgctattctccacgtatctatatttacagttctttctgattctatctagacagctagttacctatctatcaagaaggtgagtctatgaataataggatagaaatagccaagttctggggcaagtactcagaattggcaccctcttacctgaagccaaatcaggaaagagtagagctccaatttcacaagatgttcatccactatatgtaaaacctactctcatgtctctctgttgttgcttaaactgctttcttcaaccagagacctggtgatttcctctacagtgattcttttaaggctgcttctaaatacattgatataagaaccaggctccagtttgccttaatatcagtaatagtggaagcagtggcatttatcaagtgctcacgacgaactcttttcacatattatttcagctaatctttgcaacaaccgtccaaagttgttataactagccttgttttagagacgaaaaaaaaaaatggcgactcagagaggtcaattagtttgcccagatttgtacacttggtaaatgcaagagcacaggctggacctgtagtctattcagctcccaaccctttgctatttcctttacacattgttacccctaaggaaattgaattacagagcccttgattgttagacaactgagttatctccgtgtttcagaattagaaagccaatcctgtctaattcattagtatatggtaatacagaacagtttagataagtgtgtcatttgttgacagtggccctcccttttcttgagaatcctcctctccggttcagtttttctttatgagtcagtggcagtgctaagatgatggccttacatgtgttcagcagggtcacaggaataagaaagactcatggtatattggtgagctacagagaattcatttgccgcaagttgaaatttggagagagatggccaaaatgactcaacatggttggctttccacatcaatgtaattgtgccatgtgctataatttatagtgtaaacaagtttcctgcaaaagctaaatatatcatgcaactcatttaacatgcacagaaggagccattaaattatttcagtcccgttactcaaaatgttcagaaaattcctctgtattagagccagtgcaggattggctctgcagccaagtgcatcaacataaatgttgaattctcagaaggaaatgcatgcctcatactgttacttagggaaaatatatgcccagacattgtggagccccttctaaaacaatcctcattttgttaaaacaatactatcaaattttcaatcaggttataaagcatctctgcatttataaagcttgcagacaattgtgaatatcaataaaaaggtgatgtgtttttaaaagattaataatttatgaaccatggaaatggaaactgaggctttttatgtcattttctaattttgtctacctacgtggagagaatgccttgtggaagccatatgtgatgccttaaaactgtttaaattggagtaattatcagaacaaatggtgtcattggatgatattagtctgtttgtgttccttctgtctacccaatgaatcaacattaatacatatttttaaaaacatttgaaacatggtcatctgtggtttcttttttgttttaaagtatatgtttaaaaattgatctaaccttccatacatactaaaatataccttagattgagagtttgcagttacatattccttatgcaaaaagggagtatccttctctacttagctgttaaagagtttgggtgagggatggatataaaattttgtcaagtatatttttggcctctattgaggtgatcatctggttttcatcattttatttgttgatgatgtgctttgttctacaaatagacatttcattatcaaaatgtttcagcactcctggaatgatactagattaatatttgatgatatatagttcagttgcattttaggtagatttgaattttcaagatttgaaaaagttgatatagtaatattaaaaaggttctcattattaaaaacatgatctacttctgtttctggcatgcaaaagctatttgtggcaaatatacagttattttccttctttcgatttttactttaacatgagaacacatttctctagtttgccttgtttccaaataaaatgacatctgatgtgtcaggataattcaagctcaactatcttgagccaataatcacagatgataaagattgggtgattcctacgtgctaggggtttgaagtgagatattgcatttaatagttatagcaattctataagacactcagaagttcaagggatttgatctgaggtgacacagatagtcagagtttgaacttgggtctatctgactgcagtgcaagctctattgctacactgagcttttcagtgcactcagtagccacacacaagtcaattagctttgcaaagtggaaagttactggtctctgaggactctgaatattggctagttcttatggatgtgtgtgcccttggacccaacatgttacatgatgagctctggctagcttagcatgcatgcatcaccccagcagagaaacaagtccattcgctattgttctgtttatggtaatgatactaccagcctttgttagaatttaaatgtggacagcacattcacaatgagaccttagtaaatgagagttatgttcagcaggtcaccaggatatgaaactcaggtcttgtaaggagtagttatcaacttacagggatgtctggtggtgtaggggagcacttttaccatggcaccctggagaacctgcaggtatccaaataggccacataagcagaggcttgaaccacagctaatctgagccttggtggaacatccattgatcctcccagaacaagagaggacaagaagattgtgagatgtactttaaggccatctcccactcacttccctatctcctttggaatgctatcatgagacagtttcccatcacctcccaggttctgttgaggagttttctgtcctgccctccactgaatagaactctagcctatacaactgctaagccaaagtctaaaattgactcctcagctacagtgtgtcctataacttggtcttcagtcatctggcctcttttggttggtatcctcctttttggtgtgtgggacaagagtcgggggtcagctggcacctttggcaattcttcttttattttatttcaagcctagtttagtaagtactaaactatctgtatctaaaagtggacctgcatctttattggttgaattagccaggccttggccttgaccttgccctgtcttctatgtgtgtgttaacaggaggtactcatactcatctgctggaatgctcacaggggtcctgggctacatgtgcccaagaaggtctatccagctctacagagttaaaatactgtcaatatgggttagaaagcaatctacctcttcccctaaaccagagtgtggagagtgattttgatgcagccaaaagagctgagcatacaaatcaggtgggatttttataaataactgagcaacaatgctgtcaacattttagttgggcctacattgtcagtcctgaatgttttgctaaaataatctgaaataaaatgtgaattctttatgcatcagcataagggaaatcctatttcctgtgtcaattcaggtagacaggccttcttgacaacctttctctggaaatgggtttgagaaatggtttaaagcactccaagctaaagtgttctgttatcagcagctgaaaatttgccatgcatcacataggactaagaattggtccttgcccccattgagtttaatgtaagacacaatggctgtcagcaggtatgagttgtagtgcacttaacagcgacttagtatttcagttgttttggacagcttccttagatagatattaatggaccaactccataaaggagttatttccttaatcatttgacaattaggagctgacgtgaagagatgagtaatgaagtaccctctgtgattgtactttggaggtagccacaggggttttttatatctaatctgctgtagttgctctaagaagctgaagggagactgagaggggcaattccaaaaggaattctgcctttcctcatcacttgagaatggaagctaaccagtgactgggtttgtctccaaagagaatgctgagtactagagacactcttctgcctgatagagaaagtcctcacttggcatctgagccttatcaaaatgaagagacatttgatagacaggcagcctagtgtgagggaaggctttgatgtctggtggaattcctgatttaaattcagtgttcttagacaaccttgaatgttaggatcatcagtgtccaaattcagttgactccaattctgaaatgtctctagaatctggtctccactatttttactgtctgtgccctgacccaggccaccaacctgtgttacctggagtactacgatggcagtctaactggtttccttgctgcctccttctttcagtcaatctatattctttacttcctgaaatctcaccggcaaataccaagcctcgtatatggtcttgaatgaattcctattcctccacttgaatgactttccatatcacccagtatgactcaaaggaaattctttcaagatgacttgtaccgccctaccaaagagcagaacatcagctatcagggtccatacttgaaattttttttaaagataaaagattctgtgttctcctttggaattatccccgcatttgttttcaggcccaggttgatctactgagttatggtcttctctggggaaattcactcttagatgttttaacacacacacttctaaaaaatgatacaagactgtttcgttgtgagtaacattttcttgaaagccatctgaattctattaggcactttgtcatttgcatgataacttgagttcccacattgggaggacattgtataacccagagaaatatactaagaaaatgaaaatcaaatccaaaatagtgacagtagagcagaaaattggtattgtgatgaatgtatgtgaccaattctaaggaattccaaggttgaagaggtgacagttgattgattcaagtcatatacgtcagggttcatactattagatttggcttgtgtatacaatatagacatagattcatatgtatcacatatgcacccagacaaaaggatagttactctactattctcctactgttgtttgagaactcagcactgtaggctgtcaggctatgtggcactttctgaatctctgagatacatattatttttattcccattgcatagaagagaaaactgaggttcagagagggtaggtaaattaagctcaagttctcttattaaatcctatgcaatatccatggagccacaaccatctccataaaatgaggaatcttaactagatgagttgtttttaagctttgttcctgcaaatccctgggagttaacaaaacaaactactttaatcttatttgaggtttcctgtaaggtttcatttggctacacaagaaaagattttttgagtttaagagtttgaaaatcattggcttaaagcaagggtcagcaaactctattttgataaagacctagatgataaatgttttaagccttcgtttggtagcaactactcaacctggccattgtagctcaaaagcagccgtggatgatatataatgaatgggagtggctgtagtccaataacactttatttatggataatgaaatctaagttccatataaatttttatgtgtcgtgaaatattattcttcttttgatttttttacacatttaaaaatgaaaaaaaaaaaactgttctaaaatcataagcagtacagagacagacggaaggctgctttgggctgaggccttcagttggccaatccctagactagatggcccctaagggaactcctagttctcacactaagaagcccaattaatcttatgaaatacctattttctgaaccccttggaaggccatcagctacagaagacaatctttatcaggcccacgtgcccatggcaggatgcatgtttagaccttgcctgtgggcacagtggttggcactgggctaggggtccacccctgatagatcttggagatttgttcctatagagtataatacagattttcaaactggttgtcactgccacagccctcagacagggattctgtaggattcccagtgaggtggtggccactgaatcaaagttttaagttaaaaccttaggaaaattaaatgtagctcctcctaaggggaaaaaacagcctgagcacctttactgcagggaagaagaatgaattccctgaaaaatatcacctcctcttccttatcacctgccttcctaccaacaaatgattcaatgctgtggagactacaaagcactagataggaaaatatataactctctgagtaattctaaaccagtcatgttttatttcttttaggttactttatgaagaggaagtgccctttaaggagtcaagagggctaagttactatcctagaagagggaccagagtaagactctgcctaatgagaacatgcaagccctctctaggctgtgttattatcctcaaagtcaattgtgtcattcatttgggccatcagaaacttactctgattgccatgaactctggggtatttagaaagacaatgataatttaaaccagtaaccggaagaccccaaactcactgggccagaagttatagctctatgttttagttaagagcttaaaacctgagtgtaataacctcctccctctcctatatgacagaggtagcaacactggttctgtctccaacatcattacaagtctagtctctgagtgtggactatagagagcaagactccagctgcaaggtagaaggtacaggaaagcacgtggcaactcctaactggcagatcattctcacaattaaaggtattgaacaatagaaaggtattgttagctacctatcagaaaaaaacatgtatgaccatatgttaggaatgttgcagttctctccactaggtgacacagtgacatggtgaaagagatagcactctcaagtacttccaactggaagagtacatctgagaatcagtcaccagcattgcagctagcaccatagataccttgaagctggaatctagccagtatcaagtgctgctgtctgccaagaggaacaccattttgtagttcacaaaaaggcactgtgtaggcttgcaagtcctgagaacaactcagtgtcccaacggttgtttctgagcaaggattctggatcaactaggagcctattatgcccagtcttacacgcaaacttcagagacagatgtgtgttggaacagcttcctgagagtgacaggcctaaagacacggtgctcaaggtgagcacaacttcaactggggggtcgcccttggttcatttctctggatcagcaggtagcttcccaggtataaaggtcagaacatcgggaccactcatttttttctgaactctcacttggtacggtctggatgtttcctcttgcaactgtctttcaaatttctgggataacttaagcactccaagaggatctaagaaaacccaagacagatctgatggatttaggccatttctagaagagtaaaccaaagctccgaaactttccaaactcctttatagtctttgaacctctccttatttggtcatggtttccaatgatgtgtggggcctgattcctctgccagcctctaggttaacacatcagcttttaaaaattattattcccacctctacaacaaaattcctttgacaataataataacaatatcaatagtaaccaagatgaaagtgatagctggtagctgtattggctcctaggcaatttgtataaactttattttctaattctaaaaattgtccagagtaggtattattattgcccattttaacatatagaaaattgagattcaaaaggtcttatttactgtattaaaaaaaaatccgttaggaattcctgtatttgaactcaggtctgtttggctctcgagaccttgctcttaagtccatgctgactcaaccaagggcttcttcctgccagccttctataataatgtttcaagccctctatttttccctcttcaaaatcatctaagcattccactatgtaaattggcaaggttttgggagagtgatcttatgattttctggttatcattcacatgggacctgtcatgtcatagtgcactagaatgtttcagtgcaaagagcccttggaggccactaggttcagcttgaagctcagaaaatcaaggacaaagatcttcttttggtccattccatctcatccaaatttcactatctgagcttttataggatcatctcctcagggcaagaacttggttttttgttcacagttttatagattattctatgtctcaatactacaaattataggtcacagtaaaactaaaaacagcatttttacaccaagatgaacattgtggatgactagaccctgaacagacaacagacttcactaaggaggtctaattggttctgttttcacctaattgaaaagttgaagaacaatgtctgttttttttaagatcacacacacaggcatacatttatatgagcaatttttttcacattatgtgtcatgaatttgtctatggaattataacctcatgaaaagagattaccatttttctgctgagacgaccttaactgcattgggtgtgaatggtgctgctataataattaaatctaatatctttcataatcctacgctttccctagagtaatgttcagcattagccaaggatgaaaatgcaaacaagtacatgtatattcaataataaagcttaataggtcagggaagaagtggaatgaaatgaatgcctagttcctccagagataactaatagtaatttgcttcctagttacttctttgacttgtgtttactgggacttaaatgtatgcatcagattttcctttattaacagccaaatccataccaagcttgttgcatggtggggatgtggggaggttgtttaatgtggatcgctgtgtagattggctgcctatttccagaactgtacattggagtgcatttcatctccatgttaaaaatcatataatgttgattggagagtaaaataactgctgagttcagacctctgtgctctgactctggatgtgctacttctacctgaaggagagaaaccggaagaccacaagcacatttctacatctggccttgagatgcccttagacatttcccaagtcatcatggattaccttcagattgttcagaaaattaaaaggagaggagcaaaggcacacagaaacttctgcttctgattactttttaatagtattaatgaagtccgttatttccaactgagatagctttccaaattaatggtgccccgcattattagttttgtgctttcataatgcactttcacatgcattagctcctgttatgctcaccaccaccctcctgtgatggaaccaaagtgttatcccattgaacagatgagggacacagatgaacctcagagctggtaagttaccccagatatcggggtttatgattagccagcaattgagtcccagtatcttgactccatgctaatgttttctgaggtttttgttattgctgtcaattttattgaatataccatcttttataagttgtacactctaggaaaaccttgtatactcccaattctagctggagatgatctaggttccatgtttgtctccgtgatttctagctgtgtgttcacaagcaagctccttaacctgtctaaacctcagagtctccatctgaaaaatgcagctgtaacatcatctccttcatagaagtattgtgaggaccaaattccgtgctgctggtcaaatacttaggactttctctgtctctgaaaattgaccctctaaatgcaggaattatttaccatttcttttgctgaatacttgaatataaattaacacatagacattccctagatgtattgagatacacacacacacacacacacacacacggaaagtaaagccatttataataacaagcataggtagtttgtaaatatttgagttctatagcttatgagaatgatacagtcttcatttcccacaatgtgttgtaaagaattatttgttcagagtcagaagtctgcaactgcaaaagaaataccaagatacattttttctccttctctaagatcttcaaaacatccattagtctcttgaaggacagtcataaatcctgcaaatttagtttatccgaaagccactctaacagttgtccttcccagcaatcatcctttatatcagtctttggtttgccgacctcagtgtacacattctagtgttatgtgactgagcatgaaagtgggggagctgtgctttttttggagagttattggatatccgctctgccctgactctcctttcaatatttgaacataacctctgaagtaactttccccctatttatcaaattagaagcttccttttcccttctggcttctcttctggaaaaacacccaagtgggattacagagatggaaattttaggagtggctccagcactaactattaatagctgggtgagcttcagcaaagcaattcacctctctgaatctttccttccttgtctgcaaaatgaggccagtagactctatcatttgtgggaagatgctgtgaagcacagtgaggtgaaaatgctgcaccctctgccctcatgggaattacggactagtggggagagattcagtggaaagctgtgctgtgatccagctggagctgagggttgggtagaggaaaaaaatattcttcctgagatgagagttctttctagaaagcttttgtacagaaagtgggatcactgggctacaaaggataaataggatttccagagttaagaaagagatttctagccctggagctgagcctgatgcagagcctagatgcaagaaagagcaatatatgcataggaaatggtcattggtccagagaggctgagactgtcccttcttgaagcctaaggatgaggtataaagttatatataataaataaaaatatgaacaccaataggtctttaaagacagtgtagctggaattttaagataataagctattcgtcctgctgtagctcacacttggagaggatgccactggaattaatatccctatagaaacaaaaggctttgtggctccataaacaatcttgaaagtgctagttcatcaccaaaatccagaccactcatttttcaggtgccttgccttaggagagaaagatttcttatccacatcatgggcttacatctctcagatcaaattttacaggaagagatcggtcatatatcagaaggttaatgactagccatttctctcccagctcttttgcggccacccagctacccagcagcagagggcactgaaaggcagtgcaggttcactgtgccttttacctccgtcatccagagagacccagcaggctttgacaacagcctccagagctagggatggttatcatgcccctcttctttcatgggaaactctgagcaccttgtcctgtagagatccagtgccacatcccacatacacagtgattgatcagtacatttattgcacttttagtagtaaaaatgtatagaatccagtcatctctggagatgctgaaatagtattttccccttgatttaggggaaggtagagagggaagatatgtgcaaatatgatataaatataagagctcaaatatctaattagctgaaacaatcttggttccctctacacctttgaaggatttgcagctgtcagattgtagctccaatactttattctcattgcaagatgtatccgaggatgatttagaaaatatgccttctaactcaaacaccactctgatctctttgtaggatgcttgaggatgacctgaagctgagcagtgatgaagatgaccttgagcctgtgaagaccttgaccactcagtgcactgccactgagctctaccaggttagaagagcttagggctttgttttgggatgaaggggggagcaggaggaactggaatggctttgacatgctttgacatgcgcaaacttccccatgctttatctctgggctttggagagagggaaagaagcaaagatgagcatagtgttctggaacaggtcaaatcagttcaaactttcattaaagctatagtaaggagatgcagagctctttaaaactgctttcaaccccctcccatctctctctctgttccatacacaaatgctggtcagtggtaagcaatagagattgtcttgccctctcttggactacttattgtcttgggtgaggtataattttcatttggtgactctggtgtgaggcttggaacccatactcattaatttagatataaatgtgatgcttcattcacctttcccagatgcaccatttcagaatgcagctgagaatcaatacgcaacatcttgccattaaatgaacctttaggcagaagacatttggcaaaaacttgtggctgcccttgtatccttctatcccacattttaagcatttacagtattttaccaccaaatgagatggcaggaatgtgtgttttcagcatttcaatgagactggactttatgatttgaaaaggccaagtatcatgtatgactcatgagaacggcaacctagtgtgtggtgtcaatgatgcttgcacattttctccttgagagagaactgtctcgaatgtggggtccttctgggtgtgcttatcacctcaagtgaggaatgcagaaggattgcctttctttaaatccagtacctgaccaagatcttcctacagtgaagtctgctacattataaaacagactgtttaaaggaatgctcatgcactcgtatttcaagagagttaacaaatatggaattccatgttcattgaacatttcatgaggaagagcctacaaagaaaagcttaggaaaaattatcaaggctcagctactctattctcatctacagctgtttaccacactagaactcctaccattctggtatactttaaaaataaaatccatcttcaacgttatgtggccaaaacttttgtctactttactttctccactttcttgtgcttgaattttaataatatgtaaaaaataattgcatctttgcaagtttagtgctttatcaagaacaaccacagggtaagtgcagactacatagtgctggcctaagccaatttcacaactgttccccaagggcttgctgtacatttactggatgcaagctgtctccctcctgcttgagttgggcttcatagcaaatgtaaaatgtacacttcatttccaaaaattgtcatttctccttcacacatttaatacgccaatagcaggagcatcatatttgtaagtaaaacaaaagcaaaaatgaaaacattctagatcattgattttgacagataaaaagttgccttttaatggaaatgtttaaagtagaattcaataataattgaaagtagattttgcacattgacttcctctttatgtaattatatgaatgtaatctactttttaacttataaagttattttctgtatttatctcaaaattggcaaagggtctgttagcctgaatcatctgagttttagggtatattcactgactttttgtaagtgctgagactctcagatgatcaggattggtgggttggaacctttttatgacatgttgccgctagtcatgatgtcttcctcaaaaaggcttaggttctcagtgaaaatttgatggggagattgaactaggggctctaaggtgaggcaaaatgacaacttattccctctagctgagtcctaggagcaagatgtaggcacaaggttataaacatttgcaaatgaaccctccttgtagagtttgaagatgagttacaaggcctggaaggctatagaccaaaagagaatgcttgtgcagtagtggcagcagtaatactagcaatgtttgcagagctctgcttttaggatgcataatgtctttttgtaaaagtaaatgggttgaaataattttctttttttattgcggcaaaattcgcataacataaaattaaccattttaaagtgttcaattctgtgacacttaatacaatcacaagactgtgcatccatcccagttccagaatttttcatcactccaagtggaaactccatacccattaaacagttcctccccatttccccctccccctaaccccgacaactgctaatctactttttgtctgtatggatttgtctgtttcatgtaactggaatcctataatatgtgaccttttttgtctggcttctttcacttaccataatattttcttggttgttcgatgtcatgtatcagtacttcattttgttttatggctaagtagcattccattgtatgaataaaccacattttctttatctactcatcatttgatggacattttggttgtttccaacttttggctactgtgaatagtgctacggtgaagatttgtatataagtttcacatggacatgttttctttctggtgtgtacctagaagtggaattgatgagtcacatggtaattctacagttaacttatagaggaatcaccaaaatcattttgttttagataatatagtgccatgcatataacatagtactgttcactcatctttgaattgggacagtcatacctccagcaccatcataaggaggagtactgagactaccatttttggaaccactcttgctctatgccaggcacaagctaggtgtggtgtctcatttgaaccttacagcaaaccttagcagtaggtttgggcctcctggctgagcaaaagaattgcggagtcattccatttgtggcagaatgattggggagaaagcatacagacaaatgaattggtccataaaactgtgctcaagagcccagacaacactgctggtttcagctgacataatagttagaaatggctcagaacccagtggctgcattcgtgcagacatagtccaataaaaaagccatttactttctggagacgtccccaaatcatctcatccataatcatcacaccttgactcatttgaagaaactcaaattatccaggtgtagtgagtacacagcaatctttttcaaacagtatctaagagcttataatgtgggcttagagcataagcatccccaagagaatacatttcaaatacatgtatgaaaatgaaacacaggatcaagttgtgtcagcctctaaactggcatttgggtaccgagtatcttacaatcagaacagcctcccctttttctgctacttctaccttccacagcagtgttagccatgctgagccaggtgacaggtcatgtgcacaaacacaagcagagcaagtagggtatgtttaaatgctaaatattattccctcaaatgggaaaatggaacatgagtccagaatgggggaattataatatataaattaaagatgccaaatggtcagccatagagactcatgatcataagaaaacatttttaacagaagattttaccttcaaatgactctttaaagtcagagatatgtaatcacacatgtacatggcttcaatgaagacacgatagtgattgcagcctgaaaatacctgttaaaactttgtgttttctctccagtcctctactgcatttgactttcttggttgggactatttgggcagcagacatatgcatgctgttttctaaggtggtgggacaatgctgggacagtgtaggagagcgtgtgagagtatagctgtatagttacacggacatggctttgaattctagctctgccactctgaaactggttgaccttgggcaaagacctaagtacctataaaatagaggtaaaaatagcaccttcttcattgggtcatactggggattcaatgattaggtcaatcaatacaggcaaaagcacctgatgctatgcttagcacatagtaagtactcaccactttacgtgataataatcatcattgttatgggtgctactaatgatctaaaaagcttcacattctttgagatgctacatatatttactttcccttttcttgtaaggaatgggatgttaaagacagctgctgggttttctatcctgtatatggcaaacttgaatgaaaatgtctgtcatcctaaagtttattagctgtgtgcctggccatgagtaattttaaatgtagatattaagaacatagtttttggaataaagaagcctggggtttaatcccaggcctcaaatactagctgtatactagctgtatggcattgggaaagttgtttaacatctctaagtctcagatctcttaccagtagactggaataaaccagccttgtctaactcatggagtactgtaaggatcaagtgaagacagtgtataagaaaatgccttgaactacaaaataggtggttactcttccttgtggtccttttaaacattaactggcagccctctctttaggatccatagggaaatagacatagcccttcattttggcctaggtatccatagggatctgttaggaactgcattgcatgtcttaactggcccccaaaggcagccatcagatatgaatgaccttaactttcctttaagccctgacaacttttaaactagagatcccagaaagaaaggctaggttgccaatgatctgcaccaagtcctccaggaaattatgtgtctccaaaagagtttttcttccaaggattggcgtgggtggagagttgattcatacccttctattgcagttcttaccttctctttctgagctcatgctgtcccctagagaaaggcttgaaggctcttctaggatgctatactcaccttggctgtctctcaggagctgtccctgaatgggagataaataactatttgaagttgacattagacattgcaaacatccagaacagtgttggaattagacatagtgctatgtacttagtgtctgaataaacatatgtgctgcaatgtattttttaagtttgatatcaatggcatggttgagatttgggggccacatgatgtctattacctggctgactgcattttttgcttctcagctgccactgttggcatcatagatataaaatccagccctggccttccccatgaaacacttattgaatttccattttcaagccagtcctccagggtaggcagagatggccactggggtttggctagggagtggcctgacccaggaggacagacgttttgggagtgggaatatgttatgttctctgtatgccctgcctcataccactaaacctctggtttttctttttgtcagtttttcttttcatttttctcggggttaaaggaacccctgaaaatcaggagttaaacctggaatcaattttcatttacagctgagaagcagttattgatgctatgcttgcagttcaataaaagatctaaagatatagaccttgtgcttctctttcaatataagcagcctaatcagtctcaaaggtttttttaacaaagaaattgtatggacaggtttattaaaattgctgtctttaaagttttaaactatccgcaatttgacttattccaaaggcttctagaatgtgtggcgggcaaactccaaagctccctccagcacatgttcttagagccaggtaaacatctgcttaatgtctaattgagtgatattatgatgtctgatttccacagccctaaacatgtagtctggtgtccacaggtagcgggatggcttgtgatgcctgggttctgaagcctagttagatctggccatggctgtctcatgccccagttagctcacattggcattagaagcagcagactttagaaatctaaaagccataaaagagatgggtcttgttagaaacttcctttagggcattataacattagtaacatcttattaatatgaattagattgaaatattagatgacttcatttagcacagttagaagttcagaaaacatttgatatgactgaaaatgttcaattagtgaccaggttcactaaaagaccctacttaaagcttggagtagtatgctagtgctttaaaaacagaactgaaccattaaaattttctttgaacacaaaacattctaatgtgttgtgtctgggcatgtgattgtgagtagctccagtgtacccaattttatttaaccccatcttatttctttttctgccaaagaagtatgctggtattctgtgaaatgttcacttaattgaaagcatattaattactggagatgtatggactttccaactagacactagtagcagagtcgcaccttaagcatatgagcatttacagaaaacaataatcttcttagatcttcccctccacttcatagttttgttttttctttttttaaatcttcagattactaattaccgaacacaaaaaagttgcttttaatccagtttctttaatccaggtcttatatttgatccattttgatttgtttgttgtttggtggtggtcatggtcatggttgttgttcttgttgagcgagcttactggcctggttgctatttgagaatttcaaatgaaataattacatagccaccgaagacccaaacattctgtcagctttgggatgtgttcctgatacctgtgatgcacactgaactttcagaacctagtagccacattaaattgaaagcccgcatttatattttaagtttgctaatgaaaaagatgcaatgaattttactcctgctatcagctggctcttttgaagttggtgtgctgtatagaatacattagttgtgacaacagatactcttccctgctgtaatcggtcctattttgtagccacagttctccctcgtcatactgaacaagttgttacctccccaaggtttctctgcatttctatttactttgttatcagcagaaaggctggggaaagcctcttcagtaatgacatcgatacgacacacacagcaagagaggtcagcctgtcagagctctagaaacagcagatggattaggatgaaactgggtgcaaaataactttgatagagtcttttaatgtaaacagtttatctgtcattgcctttcattgaaatccctcacagaatgatagcatttgggccgttaaggttacagaatgtagctgaataaaacccatacattgtcatgctcaaactctccaccaattagagaatgagaggacattttaatttattcattaaagacaggagagtaaataggataacatataaggttaatagaataacattggccttcatattcccaagattgtatttcccatttggctatattagcacagagactagattaataagaaactgcttagggcttgtatgatgtggtttttaatatgcttgagacaagtctgtgactgtttagaaacctgtgtgctgaatttttttattacaattaggtcttctccttcagtaccaatttttttgacttgtaatctatatacaatagaatgctttgagcatacagagatgcatagaagtgtaatgtttttatgtattgtgcttatctcatggtcagtaatgaccaaatactggctagtgtttaataaactttatgaattatccaactatgagcatttcagttgcaaagccaatagctcttttgcttagcttagcacttttccacaatgaccttaagtcagacactggtgagggtatgttgtttgccccaagatccaaacagaaacaaaaatggatatgatctgtcatttcaaaatagataatgctcatatgtgacagggatgaccacagccttttcacccacaaagagcacacagcacatatatggttctgtaaagagtgtggcagtgagagagcagccacctctggaaagctggggaccactaagtacagacttcagttgaagtgcctggagaaaagagtcctcatcatgttgccctttctgggctggaggaagtgactggacatcactggtcctttcttcactcaaaccccaccctctgtttggtccaagcacattcttttccttaagtctcttcatcatcccaattagggtcctaatccattcttgcagcctggaagtttcactctggagtcatccataagtaagtcccaggaaatgcaccatgtgtgcctaacttcattggtagtttccaagccttgagtttaatcagggttctagaatatacctagaacagtatgcacatctcaagcaaaagttatataatgaaacactttgccactttgaaaaagtaagattttgaaatttatattctgtcttgaacaatttactggggctttggtttagggctcaagaatgcttaactctaccccctcccccccagatatctgccatctgctaaaaaagtcaccaggcaggctgaaaacaccaaggaccttgttctgcctggaaaactgaattgatattttcttaagcagctatatttacttttatctttatttatcaagagcaaagagcataagcattgtaagtgcacagaagagtttccaaatttgagattaaccaatccaacattaaccattcaaaatacaggtggatgggcggaaaaaagaaacaaaactttccaaaatgtatggggccacataactcgtatttcacacagcaaaaatttcataggagtctttggaacattttactaaaaatgtataaacttgctaaagctagtttattgttaatggaggtcgactaaagcttcatatttaaccctgaatcatatatatgtgtgtgtttctcaaaaaactaaaaatagaactactatatgacccaacaatctcactactgggtagttttccaaagtaaagaaaatcagtatattaaaggaatacttgcaccaccatgtttattgctgcacaagtcacaatagctaagatatggaatcaatctaaatgttcatcaacagacaaatggttaaaatgtgagatagatagatatatatatatatacacaaaattgattactatttagccataaaagagtataaaatcctgtcatttctggcaacattgctgcaaaagcaagtagggctttagttcttccccctcctgtggagtctgcagtccggattcatgcccttccccaagttctggccaggagatttctcaatgggttcaaattgttacaaagttcagctggaggtttccttctccctgtagccttttccgagtgcctctagcagccctcctaaaggacctctgtgaggcaaagctgaaattgcttactgggggggccagcaagcccacagggcttttcccactgcttcctctacccctgtattttgctagcaggggtattgtgcttacaataaaaatggctacatttttattgtagggatacagggaaccaagttacaattggcaacattaaattcacacagacaatgagggaaagagagtaaaagtgtacagtccaagtgtgttaatacccatgtaattttatttgaatattgacataagtgacacccacccaccaccttaaacacacacatataaatgaagtctgcaataacatccttttgtcttattgacaacaagtatggccatgctactatatgactgtatttgtgatgttctggctgtgaacagtgtactctgtgagtgagtgagtgtgtgtgtgtgtgtgtgtgtgtgtgtaagagagggagggggaggggagagagagagagagatacagagataccgaaacaaatagaaattctgtgcattactgattggcacaccactgccctcacctatggatgtgtctgttccaatcccatatgctctgttgtgttcctctgtgaagagtagtgcagtggtacttgtgataattcctcagaaaagtggaagaacctggcctcttatatcctcattttccctcttcttctcccctctgtatcttctcacctctcctgcccaaccattcttacctctctaatatttcttctcccagccctcacttggagcagaatcacagcatgagctcaggttcttaaagacagcgattaggttcaccttcaagcctctgagccacgagcctgcctggtaaagtggagaaaactttatagtgagtgagagcatccctatgaccaggcatgtcccagaatccccaagcctagccttcagaatcctctgggcataaacatggactcgagggtcattaagtcttagtaagtctttattcctctttactgcatctgcagagaaacaacgtgctagatacaactccttagctcaggggagcaggtgtgttatgaaatgaggggaagggcactatcctgaagagggaggaatctgtttgggggatgatattaattcagcttccctcgggagccatgaaaacattgattttgtaccattaagtcttcacagtgtgaccatgaaactgttctcagcaacttttctgttttaatatatttgtgtaaatcctgacgtagtttcacaactgttacaattgaggcttcaaaagatgaaggagaagacatctaaaatagacacattagactctgtggcacaactctgtttattggcagtgtgcatgcctgcagataatggcagcaactatcttccaacccagcaagattctccttctcagtctataactaatggtgaacagatacagtatttggagagaggtttgcatgtgtttcagctcttttggcagaaagtgaagaaaattccacattttttttctgataaaacatattatattgtcccttccagccagagcagaagtagtgtttcctgagaggctcccttcctgaatgatgatagggtggacctgatagtactaccaggacatgctacagagcctggttttcctgactagagttaaaaatagactgagggaaaatttagtacattagacaattagatggtattttttgcctcctagttcagactattttgagttgttagcacagaaatagtaatgctgtctgtggtccaagagacattctgctttgatctgccatgttctcgtgttcattacttctcttttgattaatgagaaagtaactccctagcttcctgtttctccctcattgtgtccatcttccttattgtatccacatttatcttcccacatcaagtctgactctatccagtttctgcttaaaattccttcccttgaaccctacattctccattgcatactacagactttatgtaataaagggcaaacaccattgttgccaaggacattgttgccaagtccttcactcaatattcaatcacacatatatatgattcagggctaaatatgaagccttagtccactatatatatatatatatatatatatatatatatatatatatatatatatatgtatatgaaaaatatatatatccatatgtgtgtatatatataaatacatatatatatccatatgtatataatccttttagatatatgtgaaatactcctgtgtgtgtattaaaatatagaataccagaccttaaaatgaccatagagagtttttactctagctttctaattttctcaataaggaaactgagatacaaagcagtcagttagtatttagtatataaataaaaatgtagtctcattacccacagtataatgtgttccaaagggataggaagccttatcacactagcaggttaatgataaagatattttatcagtatttcctgccaattaggtttttgaatatgtaactgagtacctactatgtactaataatacacttcccatttcttctggttatgaatggtagggagaaaacctctattaggcattgattgtctctcactaaaagatacatgtcattttatgaggtgtgcccccttagcatcaggggcaagagggctcagattggttagggggaagaaaattgaattttcaaacccacaaaccccaggggaacagagtgaccaagtgccacttacattgggcctcctgactgggaaaaaataaacacctcaatgcaatactgaagtgcttggctggcatctgcatatttactccacttagagaatgattagtgtcaacagatgactttgtgggtgaaacatgcttcttcaccaaagacagtacatttttcattaagttacaataaaccaaaccttagttataaaggaaatttccaattgacaaatggatcttgccaaaggattttctatccagcaacatagccagagtgaagggagcaagtctttatggagtgcaggcacttctgaatgctgttatcacgtcatctttgggctggatgctcacaaaactctggcttccatggtagtgaaatgcacatgcaggtacaagtagtacctgctattcagtggctgttcaactggctgtggcagggtctagaatggcagtgtgagtgaaattgatatttactcaatgagcaatgggaagccatgaaggattatgacaatgagagcaatgtgatcaaagtggagccttaggaggattcatcttgaagtagaacataaaatagatttagaatagggagaccagtagagaagtgaggtggcagtggccatagtcctggtgagaggcaatagaaatcaagttagcagtagttgcaggaagagtgaggaaggcacaggtagctacaagccttcttccagaaagtgggatgggaaattcaccctgtgaatgctgctccagactccctcctcttcggagtgtaaacaagagccttacattcagttgcaggatgaattgagatgcacatcagcctggagctcagctcttcctccagaggcttattttttccctccatacagagcttactgtcctctggcacattttcatgcccagagcataatgtccaggcctatgagtttgcctagtcattcttgattcatttatctcatcaatgtttaagtgactattaagtgcaagacatagttctatccactgagaacaaattttccccaacctctgcctgtcaaaagtatgttcctgcccctgttacgtatagcaaagacctatttcattgattattagaaaagaatgaataaagttaaaatgtggaaagcccagtgatctaaagataggtaacatgtttttgcttcctagaggttcaaggttcaaatacagaatgtttccatgcacgttttcaggcatccataataatggttagtgttttcctgaagattataatccccgtatgacaagtcagaaattcaggcatccaggtgttgcaaaatcttgagtgacattttgtcctcttaatctgccacccttggctgtgtgtgcttaatgccagctggggtttagcctacaggatacattgtcttttgccattttactcattccagtgaaatctatttaaatgctgtaattaagcgattcatttttatatttaagcaagtgctgtcagtatatgtctcttcaattgttttagccaattctgttggtattgattttaggccatctgaataccctaatgatgagttcatttgttaatggaagagtttctcttctgaacttaagcaatcgatgcaatttaccaatacatgctgctaggttagggtatagctgtgccccacagaacaatcatgtgaaaaaaaattaaatccaaaacaaaacaaagaaacacaaaaccaatgcaattaattgtttttctgtctttttccatgttgttgaatacccagttatttgaaattatctgaatgattggattttcccttttgattaagaaatgtaaaaacccagtttggatgtatctgctagtagaatgaaaggaaaatgcatatgaaatggaaatgtaaaaggcatatagagcaatactaataaaatcacattttatgcttgactgacagtattattattgattatggaagaaatgaatacctgagtccactgccacaatatctctaggccatccaaatgttcactttgacagtctcaacatacaggaaacatattgcattagatttgttttctgtaaaaggagggggataatgtcataagtctgactgttcagagcatgcttcttataacccccaaaagattctcacattttctataaatatatatatatataacccccaaaagattctctacattttctataaatatgtatttttagtccaatagacatgtctatttatacatgtctattggactagaatagcaattaattgagtataatctctgagacagaattaccttgctaaagaattttgaagaagtgttatcattataaagaaaatggctggcaagttttctaagcaccttttatgtcatattttatccttaaggaaatgtgataccatgtatgccacgtggatgggactcaagagacagcaactgtctttccttccttccttctttctttctacctatttttttgtaatagtgctatatgatatggtttttgtaattcaacatggttcctgggttacttgagctttagtgcagcacaaggattctctatataaaagaaagacaagcttcttattttcaggaacataggtttagcgagtgagcaaatctgagcctgtctgtagccacatcatccctccaaaggaaataaatgtgctgataatgagagaggagtcacctcagaaatgctccttggaatcagagaagttccttcttccttgcatttaatttctcaagataccccatgacagaggtggcccatgtagaataggagcttcagggcttccccatcctcagggtccaatgttaataaaaaagtaaagagcccatctgatggagtgaagtgtggaaggaggggctactaaaggagagatcaactggaaaatatggaatcatcctaggcttccttggaaacacagagaaagagagagaaaagagagaaagaaaagtagagagaaagagaggtctgtagaatctaaacatatcaaagtcttctgtgaatagcactttccagacagaagcattctattcactccagaaccactactgatatggagagtagaagatagtggttcctataatcctcattggaataactacgtaggtttcataccacaatgtggcctctactcagtaagcccatagactatctggctgtaaaaatctatgcatgaacaactgtgtagaaagcagtcacaatcaaggtgcactgcatttgcatatcatgttgcagcttccagagcactgttgtcaatgttggctactcacaaccaccgttgctgtagaaaaggcaggaattattatcttcatttttaaaatgaagaaactgatgctcaaaggtgtttagtacttgccaatagggtaagtggcaaatctgggactagaacccaggtttttaacatttctggcacagcactctctccactctagcctattacctctcatcacaccatactggagtacattctctaacattttaatttcttttattgtttttttcttatactagagcttcctcaattgtgagataaatatcatgatagggaaccatggcacaaaataaggagaatataggtttttaaaagcatatagacgttataaattaaagcagcataactgttaactctccagcctccattttccaatcagtttaaattactttaatgtatgtttttaaatttaaaattagctgcaatcccaatatgtaactgtcttgatgtttggtgaattgtgctatgtcacttccttttaattttcctccttttgcagtgtgtctcacattctggcaagtgtatctggaacttgggatggtcttcttatgtcccatcatttcaaaagagaaattctctctttgtgtatcttgtagaataattcacatatcatttgcacataaataattcacttaaaattttttcctcaaagtctcttaatgtaataattcctcatagcatacctaaaacaacatcaaattacagtgaaagcatagtaacacattgcgagctttttctcatatggcaaggttctctgccatcatttactctaccatcatttacttgccatcatttacttgagagattcaaggtgatgagcacacaagaggatgacatgaggacatctgactagagctgttgggacatcagaatgatcacaagttaatttccaaagaaaagagaacctctcagcatagacattttcaatcaatagccaggcaacccagaaaaaataatttgaaggaagttattttcctatgttggctctataaaaagatgtatgtttcaaagaaactggcctcaaacatgatcacgttcctcctgatcagagaaaaataactgggtctaattgacagttccaaagcatagagcagagagggtattttcaaaaaacatgcctccgaatcaaagggaggataagcaatgtcactttgatttttccctcttcctgtctcctgccagtggcaagctcatcctatcacatccagcatgctttaaaaggaaaccacttgaacacagcacccattactttgtgataacctaagtcttctagaacagacttatctggattctaagggattgaaaaaagtggattcacatgatttccacagtgacatgtcttcagcctactagtatatcttattgcaaaccagccaggcttgggagagaaaagggttttttaaaaaaaaggcagatgtgagtgtgcatgtatgtacagactgggtcctgctgctgtaggaaagctgcatggcagtccccacttcttgccagcaccacttctccctttgttcttctgacatgggagaatctgcaggatgagtgaggttcacatcctctgtacatggactgcaaatggacagcaaatggacaagttttcatgtccaagatacatgtgacagatgagttgggccagccagacacatatttcttgttttctcattttcacctcttacctcattccttagcttttttcctattctagcacttgccaaaattcaacctcaggcacagatggtgagaaaatgatttttgcctaccaagccaaagaaagtgcccaaatattaatggttatttatctagaaacagaacctgagacttagtaaatggaagcatggatttccagcactaacatctaaaatttggaagtgttttattcagttgttatgcatagaggtcttcagtatgttgaatatcacttgtcaccgagaatgtcaagtccagagttagattatatgttgtctctgctaaaagtggttgcctctgtattctaatttacagcagtattctcttctctgtagcccttacccacctccaagattcacaaagatccccaaacagatacttttttaaaggatctgaacaaccctgaggttgtcaaatagctgcttcaatgctctttttatcaaacataacgtctatagcctgaaaaagtctatgggagtacaagtttggttctgattacataattatgctacagaaatatgaaaaaaaaatcatcactaaaaccctccaggtgcttaaacagtttgatagactgtagccattctgccatcagcacccccagctgtgttgcttagcaacattttaattccagaagaatcgaaggagatgaaatccctgtggagaaggaaacagaaataagagggctgttgacagatgatctgagttgtttcttctaatatactgtgaagatcactagctcttttcatgaatgataaatggactgtacacagatcaatgggttcagcactaaactggaaccgggctccatgtctaaggcaatgcaggccgagaggcccagagatttcctcatttctatgatttggtgtatattttcttaaaggttccacaggaggaaattgatctgagtattcagtcattccttgcccttctgtggtgtcggctaataaaaatgattttagaaagggacactcgactttctatcatggtggaagtatggccagatgtcagtagtagtgctagggtgagcagttccctaccacaaatctaaaaatccaggatatgcccatgaccattccgtctgcatctgtttccctaacctgtcgttacaacccaagcaggtccaaacacggtaagattagagtgaaaggtgggaagagagggaccctagttatgcacccagaagtccacttttatggtccctgatgaactttctaggcagccctcacaatatccacctcacaatttccacctgtattggaaagctgcacttggacaggtaaccatgtttcccaggagaagaaaattgctttctgagtctccagtctgcttatctacagcaccctgtttcggttagctccttatgtttctgaagagcattttatattgcttattgttttggtagctagttgcaatgattatgcctgctaatattgtctaattgcattttttcttctgtttacaggctgttgaaaaggcaaaacctaggaataatcctgtgaagtaagttattatttttattagttgcaaatgttaattttaacggactcgatgcatgtgaaaaaataaggtcataaaagagaccttggattttgagttaatctctattcatgacaatttaaagacaaaaacaaaacaagccaaaaaaatcctccaatgagcagggaccagcttatatttttccctgtgctcctgatgaagaaatgccccaagttgtacccagtttacataaattaatatgtgcaatccatgaatagctgccaaatacgattataatcatattcaatacatagtacttcaagcctttgggttttgcacatgctaaaaagattacatttttaattgcaaaccttggacctatgacagagacataaatgactgaaagtgtgccaagtgatttccagccacgtggggaggtttggcaccttggcatcaaggcctcaatactctgttaatgaaaagctcataaaatatacttaactaaaggcttttcttttttgttttagctaacagaaagcaattcccaaggcattttatgagatactcttaaatcataaacaagctacacagacctcctttaaatatagtacatcttagacatcctgtctcttccagaagggagactttcaaattaagaaggatggctgtcttgtcatttggtttgtaacatctgattgcagtgttacaatgcatgctagtcctgccagctctgtggctgagggaggactttctctatttgctgggctattataggtctggtaatatcacatctcgaggaactatgtgttaatttattttggctgacttcctttatagttggtaccaaatacagaaatggagagtacatagatttttaagtttctgggagaatggatcagctaatgccaacaagaaatgtttttgttttgtataataaaataactaaatttccagagcaccagggtagcatttagcataccattaaatccaagccctagtacgtttttccaaaaggtgttgtgtactttgcttttaagtttcatttttcttaggccaaagaatattccctatcaggctctgtaacatctagaggggcatccgtagtctggagatatattatgttgtagtcttatggaagtatttgtagtagctgaggttttgtcaggtcgtgcagctgggggttgaaatcttctctgcagcctgatttcttttccgtctgaatgccctaaaggctcctccactgtgagcctgtggctggcaagctcggagaattagaggatggtgctaatgaggccagggtcagggcttttgtccctgggtgggcgattagtgatcttctttcctgcagttcaactgcactcctcccttcagtccgcctgcatgcagatgtgtgccccaggtcataaggagtggggctagggctggaggaatgtaaatcaaggccctcaatggcaaatgtctccaagctccagccctcccaataggaagtgattcccaagttgcatttttgcatgcatggaatagcccattggcagtgtttggggttgcatttaattctattctaatggcctagaagcaggacctgttttctctttgctccttgtgagaatttgaccctacagtaattgtatttttatgagttcttattaattcacagtgcacactctatctaatgtctagcgttttgaggaatgttataaaaagaaggaacagaaactagaagagtcaaaggattattgagctttgtgctttaaatatatttgaaaatctgcttagtaataaacctaagtcataaccaactggtaggtgtttagaattgtcttctaattaagtaagatactgttctcagaatgagtttgggttcatgataccaaactcagcacttgaagaaggagacttcctcaagacctcagctcagaaacaaaaactccacagcagggttcagttgctctgcctgacaggagaacagagtcaaagtttttaaaaagttttatacatagtggtccttttgccatttctgatgacatcaaaggcatccctcttgaggaaatctcgactgcacaaccctactatgcccccagttcagcaggaagcagttagagcagttgttggccaacctccccaacagcacttgggttttcccattgagagggggactgagagacaggactagctggatttcccaggccgactaagaattcctaagcctagctggggaaggtgaccacaccctcctttaaacacagagcttgtaactcagctcacacccgaccaatcaggtagtaaagagagctcactaaaataccaattaggctaaaaacaggaggtaaagaaataatcaaatcatctatcgcctgagagcacagggggagggacaatgatcgggatataaacccaggcatttgagccagatcaggtaaccctctttgggtcccctcacactgtatgggagctctgttttcactctattaaatcttgcaactgcacactcttctggtccatgtttgttccggctcaagctgagcttttgctcgccgtccaccactgctgaatgccgccattgcagacctgcccttgacttccacccctccggatccggcagagtgtccgctgcactcctgatccagcgaggcacccattgccactcccgatcaggctaaaggcttgccattgttcctgcacagctaagtgcctgggttcatcctaatcaggctgaacactgttcgctgggttccacggttctcttccatgactcacagcttctaatagagctataacactcaccacatggcccaaggttccattcgttggaatccatgaggccaagaaccccaggtcagagaataaaaggcccgccccatcttgggagtggccaccaccatcttgggagcttgaagaacaaagatccccccggtaacactagagaatttcagttacacacaatgcactggaactccaaatagagtaaaggttcaatacaagtttacggaatgaataagtaaacaaattggacatatcccagaaaacagggattcttccaggaaaataggtttcttccaggaacctagcctgcaggcttgataaggctggtggctctcttctagtagagtgtcaccatcatgttaaaagaacatgtgtattgtaactaaccaagtggtccagtcctgtcgggcgaaattcacccctgatatttcacgtaggttcttttctgttttccctaagtgtcagctggtctgagacataaagggaaagagtacaaaagagagaagttttaaagctgggtgtccgggggggacatcacatgtcaacaggttctgtgatgccccccaagccgcaaaaccagcaagtttctattagtgattttcaaaaggggagggagtgtacgaatagagtgtgggtgacagagatcacatgcttcacaaggtaatagaatatcacaaggcaaatggaggcagggcgagatcacaggaccacaggaccggggcaaaattaaaattgctaatgaagtttcgggcacgcattgtcattgataacatcttatcaggagacagggtttgagagcagacaaccagtctgaccaaaatttattaggcgggaatttcctcgtcctaataagcctgggagcgctatgggagactgggccttatttcatcccacagctgcaaccgtaaaagatagccacccccaaagcgaccatttcagaggcctcccctcaaggacgcattctctttctcggggatgtcccttgctgagaaaaagaattcagcaatatttctcccatttgcttttgaaagaagagaaatatggctctgttccgcccggctcaccagcggtcagagtttaaggttatctctcttgttccctgaacattgctattatcctgttcttttttcaaggtgcccagatttcatattgttcaaacacacatgctctacaagcaatttgtgcagttaaggcaatcattacagggtcctgaggcgacatacatcctcctcagctttcgaagatgatgggattaagagattaaagtaaagacaggcataggaaatcataagggtattgattggggaagtgataagtgtccatgaagtcttcacaatttatattcagagattgcagtaaagacaggcgtaagaaattataaaagtattaatttggggaacaaataaatgtccatgaaatcttcacaatttatgttcttctaccatggcttcggccggtccctccattcggggtccctgacttcccgcaacacagtccctgttattcttgactcatgccacatgtaaaaatgttcctccattgctctggttctttctagctgttctttttctgaccagttccttgtttgatctcatatcaagaaataacatttgattgtctttttgagcatacaatgaaaattgtgtacagttttactggaaaacagaggcccagcggcatcatttacaactcaagtatgaacacaaattggtaaatatgaacatgtgtgtggtttcatatagccctttggtgtagaatttggcaaatggttgaaaaaaataaaaagaagaacatttcttgacatgtgaaaattatatgaaattcaaatttcagtaagcataaataaagttttattggaacacagccacactcattcatttccatattgtctgtggctgcttttgtgctacaatggcagagttgagtagttgtgacataaaatgtatgtagcctacaaagctgtacatttttaccatctggccccttatagaaagtttgtggactcctgctctagttggtgaggcagaaaaaagcattaagcttttttgtgatgctgaaggttaaactatcaatcctttctcctttggcctttaaaacagtgagttttaatgagcccttattgtgtgtttaggactttctagggttgatgtgccacttaattctcattcagagcaaacagattcgctcttcactcactacctttgaaaatcatatggatatgagatccattgacagggcattgatgcctcagaaacaaatgaacacatagaacacatatctagggcatactgctagccttccaaattgtgtgtagatggatttattgcaaagggcatattaattttctaaaattctgtcacttccacatctaactaaggctaaattagctttcagttatggtgctggtaaataaacttattagtgtatggctaataagtttctaaaagttttgcctccctcccctatttcttaaccactctttcaatttatttttaatactttcatggttgtaagctgcttctttcattgccatagggagactgtgatatacagtaattatgctccatataaaaaagaaattaagtatatgcctagtgaatgtaagcacataatgtacctggatacactaatgccatttccttgaaacattaaatattacctctgagggtaagactcaaacatgagtgttcttaagatcactgatcaggacaagggaaacctggtctatttctcactatactggaaccatactgttatcagagcttgattagtatgttcaaattatggctctttaatgtgtcagaaagactttcacttgtattttaatgctctgcagcagtcatctccaagatttcattgtgacagcaaggcctgagagatgtacagatttctttcaccatatgtgacttatcacatacatttttttcaaaaacacatttctgttattaagacatatgtgatagtacatttctgaaaatgtgaattgcttttggctaaaagccatgcactaataagttgagttgaatctaaccaaggttgacatctgttaccaaaagagagagagaaagaaacagagagagagagagagcatgcacacactgttgtcaagcataaaattcttccctgcttttacactttaacaacattaaacaatgtgatgattgtctttcacaattcaggatcagaatccactctgcgtaggaaattacgtttttttaggacctgattcatcatagatatggtgctttcattagtgaaaatgacaaatagccacaaaaattttcctgactatgatatttgcacattattcatttattcatctgatgaatatttatttaggttctacaacattctgggaactgtgataggtgctgaggaaattaaaagtaaatctgacacaggtcctacccttgaggagtttagagtctagcagaaaagataaaatcggtttgtaaaaaattaaatacaagatatatggggagagaaatgtttgttaagtggggaacagataaagtacagggaggctctaagaacaaaaaatgcttctagttaacactgtcaaagatggaagggacaatgggggaggagaaaacatttgcaccaggattttaaggactgctggtttgcgacactggtgctgaggtatggcaagggaaagcaaggagcccaggatgcctgatggggtgcaggcagtgaaataccaggttggaaaccaaggctgagtagaaatggtagcttagggccctcagagctcacccagatgaaagagattcacatggtagagtcaaatggcattaaagagctcttcacttggtactgaatgtgaattatccatcagtcccctaattattaaacacaaagggttgatagacctgggttctagtcttgaatctgatattagtttgtagtatgaaattgcatgcgtcaactccttgttataggcctcagctagattatttacatggacattccacttctttaaaaaagtcaaagcctggaaatctgttttatgattatactcattttagaacaatattaaccctgttagttcgatgtagattcatgcatgcacataaattatatatatatatatatatgtgtatgtgtgtgtgtgtgtgtttatgtgtgtataatgcatctgtatttaactccacacacacacgtgcacacacataatgcctttccccaccatttttaccttttacatttgtggaataaaggacaagaagacacatcattagagtttaaaaaagatatcttaggtggaaaataagtgtggctccaaagacacttggtaaagcctttgaaatggcccccgaggaccaaaggtaattttgcatttggagtccatatctcttgtgatgttcttgtatacatgcacatcacagacatgcagaatgtcagtcagttaagtcaccattctgaataaggcagtggaatctgatttgtgttctgccagacaagttttgtgggattttctccttgagaataaaaggctccagcaccaagaagttttggcatcttctatcatatcccttccctggagcatcactgtgcacattcacataatgtaggctcaaagaaggagttctgtttagctttgtcttacctaaggattcccaaatgtgtttgaccagaggatatctttgtctggcagggcaaatgtttcatgaaacacaaaatcgagtgttgttgctaacaataaagtggcttcattccatttaaaaatctttaattccacatttgttggcaaggtcacagagaaaagggacacttgtacaccgctggtgggagtgtaaattagttcagccgttgtggatagtaatgtggcaaatcctcaaagaacttaaaacagaattactattcggcccaacaatcccatttttggatatgtacccaaaggaatataaatcattctaccgtagagatatatgcacgtgtatgttcattgcagcactattgacaatagcaaatacatggaatcaacctaaatccccatccatggaagactgggtaaagaaaatatggtgtatatacaccgtggaatactatgcagccataaaaatgaatgaaattatgtagtttgcaacaacatggacagagctggaggccattatcctaagcaaagtaatgcaggaacagaaaaccaaatactgcattattttttaaaattttactttaagttctggtatacatgtgcagaacatgcaggtttgttacataggtatacgtgtgccgtggtcatttgctgcgcatattgacccatcctctaggttccctcccctagccctccacccccccatcaggccctggtgtgtgtgttcccctccctgtgtccacgtgttctcattgttcaactcccacttatgagtgagaacataaatactgcatatttttagtgggagctaaacaatgagaacaatggacactatgaaaggaacaacagacaactgggcctatctcagggtggagggtgggaagagggagaggattagaaataaatacctaccagatactatgcttattacctgagtgatgaaataatctataaatccaacccccattacatgcagtttacctatataacaaacctacacatgtacccctgaacctaaaataaaagttttctaaaaaaagaaaatgaattgactgtaaatgcttagatttatttctggattctctattctgtgccattcttctgtgtggctcctatgtctcttttacagtgtgacactgtaagttgtttttatggattgtaaatgccctgagacacagtcctcaatgaaggtataggaaattttggggtgggtcccaccgagtgagatacatgaagctaagtagtccccagtgagcttcatcagatcagtgggcaaaatgcccagtccactcatttcaagataatgaggcaccctcaacaatgtgcttcctacatcctccccaaacctctagtcaatctctaactggctctcgccaatttaaggacaattaatggagagataccaataacatctctctctaaatagctgcataaaataaattgggctcttaatgttgttcagatagacacagttggatgcaacaggttccagcaatcatcctcacagctaatgaaatttgcacaaatgtctgaacaccttccttttcattggtatttggatttgtaccatctaggcaatctcagatgagaaaactgagacccaaagagcaaactgcccagaaccccaagtttccaggaactctacagtttttaccaactccctctcaggacacacatgtccactttccatgcctagaaatgtgttattggttttttcagttgtattatgtaactttatttaacaatttattttcttagaacatgacaccaaatgtgtcaaaaattaatgaatcatcagatttgcaggttctttaacaattatgccaacttcaattatattaaatttatatctgtaaggataagtttcttcaaaacttcaaacacgttagttgccaaattaccatcactcatctttccaaaagttttatgagaaccttttctctttaggtgttaaattaataccctaataaccatagggataaaatagaaacaaaaagcacccatttattggtgaatctgatggacctcaactaagccagcaaatgtggaattaaaccattttaaagggaactaaaccatgttatttttagtatcaacattcataaaatactgcctggtccacgtgttagtttctaactctgtccttcttagtgtttgctgtttagacaagaatggacaacgctgtttaatctgcccacataagtcagctcagttttgggtacataagagttacacctagaattttatttcaatattgccgtgtagtgatctttcagtaaactgtcaaaaatgtagagtcacatagctaacctgctagaattcaagcaagccacacatttgctcttttaacaaacaataatgatgtccctactatgtgccagacacagttaatagagagattagttaaataagatctctactgtgagagtccccacacactggtagggaaagacaaagccattacactacagaataggtcgtttgtatgattgaagcatgtgtagcattctatgggacagagatgaaggagggagtgactgctgagagtgagctctccctatctcagcaggagtcccccagtgaacagtggggagaggcctttcaagagagcagaacaacattttcaaaaggcactaagagaagaaagcagatgctgtgttgtgagcaatgtctggtacttagaggcagctggggcggggggtggcatttttcacagtagcggaaaataccaagtgtgtgagttgtagaatagaaaagaaaggaaagagttgttgcatgtgccagtatacctaaagcatcacactgccaaatattaatacttgggccctacttttggtattaggaggagagcagtgtagtgtgggtgaaactaacaaaatgctggaaaggattcttttattctagaaagttaaaggttagagttagggagagattataaggtgctctttttaaactgtttgcaaataaatagacacatcaaatcctttctgattatatctagctaatccttctctgtggacttttatgtaaacctcagctcatatagagttcctgtaagcattcagctgttcccttgtggcttcatgaacccttgattatttcttgcatttttcaaaatgtttctttcatacagttcctttcacattacacaaatgtctaggctacactaagatatagtattttaggcatgacacaaaacactattattttagcttcagtttctgaattcacttcacagacataaaatttctttctgaatgtatttttgtcagcccaaaacataagcacagtagggctatttagggctatttttatttctagggaaatgatgcatgcccccatggtgactatagacaggggtccaaacagtaaatcagtcctctgtcgaccgcagaatgcgttcagagtcaagagcctgaggtagtaagttattattcagttgactactagtttggggggactgagaactacagaaatgactcattttggccagggcctcaaataggaaacaaatagtatctgctttcttaaagcttttgcctaaatcaacaggagttaactagagagccaccattgaaaaagaaaaaaaaagtaaatcattcttccacaagaaaatgtttttatttgtagaatttacagcataggggtatattacatgtcattataatccagtttttatatgcacatgtgtttatatactctatatcagcataccctcatgcaccatggtaatttaaatccaagacagaattgttccccttgttggggcaggcagaggcagccataactaaaagaaggtctcaaatctttttctcaattctcattccttttccaatttgtttactgtcttctgcacctctcagcaccatactgtcacaacaagtgggtcccacgtacttggggaaagcatttcagaaaactgttgtggcttatattcctccatggaagcctggcaaagggagctcagggcagccaaagagctccttcgtactcattcatgtttgcattatcaaacgctgcagtgtggttgctggggatctgctaataatagcatctacatctaaaatcacaacttattcatctctctcacgagctggagatgtgtgtaacttccaacactggctaggtgaaagtttaacttgactcataccatgttgcgcaggtttaatagcaaattagacatgttagaaaacttgctttaaatatatatgtggatgtgtatatacactctctacatacacattgtacactcacatataatttaagcttcacctatttccaaacagggatgtaacataattgaaacaagattgtacaggagaatgtttaaagaaaacagaagaacctatttccaaacactacagaaacatctgtttacatatgtgatggaactagaaaaagctatgtgtttttaaaatcaacacccaaataagggccacccttacaatgacacagcagagcacagctgtgcccttcctgcaaggatgctgttgtggtgcacagcccgttgggagatccccttggagagtgtggtcaaaccatgtatgaggttcttctcctggtcttagtgatgggtaatagacttttgaatgtggttttaactttttttttttttttttttttttttttttttgagacggagtcttgctttgtcgcccaggttggagtgcagtggcgcgatctcggctcactgcaagctccgcctcccgggttcatgccattctcctgcctcagcctcccgaggagctgggactacaggcgcccgccaccacgcccggctaatttttttgtgtttttggtagagacggggtttcaccagattagccaggatggtctcgatctcctgacctcgtgatcttcccgcctcggcctcccaaagtgctgggattacaggcttgagccaccgtgcccggccggttttaacttttaaaaactaatctaagatggtgattcggagccatggatgttgaaaaccagttgtaaataaaagcagttaatgtggttcaaaataagaatgatttcttcttgcacatagtgaatgccttgaagaggaattttacaaggctttgagcaggaataacaatattggaccaccgctgtatacaaaatagcatacaacctatacacgctcactctctttaccctactttattttttctcttaagtactcatcattctctctctctcactctgtccctttctctctctccatgttttgaagtgtcacctcccacaagaatgtaaggtccatacaagtgagaatgttgttttagtcactgctgtaaccccagcatctcaaatagtagctatcatataacaacagctcagtatcttgaatgagtaagtgcaaacatctaaggatatcactttaaagttcaaccgtcctagtttagtttgagtatgcgtttagtcttagaataagtatgattttgtgctgccctttggaaatcatactgaactaattattaaccattgggtaaattatttgcttttgttggaaaggaatagagttttattttataataatctatgttccatattagctttattctgagccatcataaagctagttttactgttattaatagagctagaatttgaccctccaagtgattcttctggtgtatatccaccttcatacttttgattcattccctctacaaattgaaaagaggaggcacaggagtgaagatgtcggcctccctatgaatgggggttagtgcatgggtagttatatttgatgtatgtcattaggcattttcaagaatgatagaagtcaaattttcataacatgggacaaggaaacaaaaacatcatgaagttaacagttgaaaacacatgcaattttctattttggaaaggcatcttgatcctcagaaatctgcaggattggacacacagcagccagtttcagaaccctcacacttgtcctcttctttggagttatgaagtctgagatgcatctgatacttcccttttgtccttcctgcgatactccactgtcacaggactaaaaagcattcagcagcttttcccattggccagtagttggagaagttggatggctccaaagctctaagggagcggcccttaagcaaggcttgactcactgtcacggacgtttctagccacaaggtctaggcaatatctctgcaaagtggttaaactaaacaagctttctttaattttatatgcttctcatgaatatgtaagtcattaaatcccttggtcacatctcagtgatggggtaaaaatatccctctcttaatattgaagtgtacaaaacaaacaaacaaacaaacaaacaaaacccaagaccgtgttaaaggaaataacattgctacaaggttaattttgcctcatacagcatttcctagaactgaattgcctgatctcctccctcgggggttgcgccaatgcttgcaataaccaaggctgattttattggaaaatcaccactagatgaagaacatactccagaggagattttgtatgggacaaactggtttctggtgccagtgtcatgttatccaggttagcactctttgagctcccaatctttctgttcattcaggcagcacattcattagcaacccttaaaacagggtagaataactagacatatcagggaatttactttaaattgttttcaagacttattggctagcaggccagtattcaaattgtagctcttaacatgcacattgaatgttttactagtagtggtgagactcgcggtagtttttatttcaaatgcttaacagataactctttaacataatataggacactcaaagatcctgcctaattgggaagaattatggagggtagattgataggagagagtatgatggtactgagtagtgaagatctcatgttacctttgtaggcacagcttatcgaacaggcatttcctgttagttggcttttttaattataaaaagaatccatagttatcttgacagcacagcgtagcacaactcacccagagacacaaattcggaaatataccccagcttccaaacttcaccaagtggaaatggagaatattataaatggaatacattgagcctccaggaggaaggaaagggaggaggaaattgatagagaagccacacatctgcgaactctggtgaccttgggatgacattaattctagaggctagaggacagatactcaaaagctgatttgattcaagatgggatacttggagaaaaatccagaaaggatagttttatgaacaagagagggaaacagcatatatctcatcaaagtacagactgcatctgatcttccagcttcttaggcaaaacctacaataagaaggagagaaacgaaccccctgttgtcttccttttgaaagtctctctgcctgggccactcaccaaagcacaagaaaacttgttcagagacagtgtacctaatgcctacttctagatttgtaataattcagacattaatgtagaaagccaaaatatctgtctatgctgactcattggtaccttccttttatgaattttgtgtccagattactattatttactctaactgagagagggaaagtaaaacaattcccaagattcggcactgacacaaagctttttaactactgatataggtggcatatggcttaatacttgggttttcagcaatcaaaaagcaaccctgtgcaatatcaccgtagctcagttcccagtgggcataagagatgattagatatattgagttctttgtgtcattcaaagaataaagaatctcatacacattggtgttagcttcctctcacttcatttcaattttcaataaccagtgtcatcacttgtaacagtttcttcataatgaaacctcatgtcgaattggatttgtctttcaagtgaaagcatattgggaagccttctgaaacctcatccttgaaataattgttactgctataaaatttttacatatatatataaatatataatttatttatttcaaattccccaaagaagaataatatagaaaatgaataataaaaacaaaattatgacatttgaaaaaagttataggttcacttttcatatttgacaagtctgggggaagaagtgctctggttaatccaaataatttggttaatagagctaccacatatagagagaatgattttcaaggaattagaaggctatatacccttaataaaaaaaagaaacaatgtgatccataatataatcttttctaattcagaaagaccatataagactctcactgtgaatagttctcattgtgccatttgcacagaaattctgattactcaaaagttctaggtgcttggacacaatcatgctcagtctcattttccagaatatcaaattatgttcttggatttggtagtttggtgttaaatcacacctttgctctatgtggcttcctaccacctcaacaaaactatagtcaatcacactgtgatgtaaaaaaaacatacggtagtgtctgcacaaattctacagtgtccaggttaagtcaagcattgcctagacattttgtctcctactttcccaacaagaagatagttgtattggggtagtttttctatagattatagattattgagagtagaactcccccaggctttttagtggtatagatgactgaaatccagacatattgatccttgtaacatttggagtgacaaggggtaggagccctgaacctcttgactgcaaaccatcatgttagtttatcctgacatactattccaattctttcctttgtgggccaagatttgtaaaaggttaggaattactatcctagggatttaggtgttgcatatccatgttcatttttttgaaattaaaattctataaagcaaggtaaagtactcagatggtaaaagctttaaagtcatggttctctcttccttcagccaatttgatgagctaaataagcatttcttaaagtattgtccatgaatggtgttttgagggatgtcaataggtattgtgaaggacaaaaatgtgtatgtctttggggtgtgtgtgtgagtgtgcgtgtgtgtgcgcgtgtgtgtgtgtgtgtatttggtggagggtggttaaataagtatgggaaattctgagttttaaaatttttcttctaagttgaattttgagcccttaatattacattgtgcacctctaagatgggggacatagtttattgttgtgtttccatagcttatttgaccctagaagctttttgcctatggaatatcagaatcaactttgagacatgctggaatgagtaaagttgagttgtgttggtgatttcgacgcatcagtgggttaaggaaagtcattgctgtgtaaggctacccctaactgagccagaagcaaaaatgtctttaggcaacatgtttctggcatatggagccgctgcagcaaaccctggaaggttcaccagcctatcaatggggccactaagctggacagtggtcctaagcagggagtctttaagccacagcctcattgcaagcaggtaaattgagctaaaaagttggagatttatggttcaactaattaggtgattatgaatactcatattggctaggtcagcatcgttagtaatgtctattcctctcttaaactttccccatggtagacatataaagtggggattttgagatcattacacaattttaacagctttattgagatataattcacatatcatacagttcactgatttatacaattcattggcttatatattcacagatttttgtaacaatcaccgcaatcaattttagaacatttctctcaccccccaagggagccctgtacccgttaagcagtcactcctcatttctccctccagtaagccttgaccagtaaactactttctgtctctatggattcacttattctggatatttcataaaaatggaatcatacagtatgtaaccttttgtgtctgtttctttcacttagtatgttctcaaagttcatccatgttttagcatgggttagaaccactagctgattctaactagggaatgttactaggaaaaaaagaatggtcttcccttttctacattctaaatgtatagggagaaggaatttgatggcattttaagaacattgagagatattgaaacaaaagtaaatgataacttgatacattctgatgcttaagataaaatgactctattatgtggatccttctcaaaagcattgaacatcttgtggattagtttttagtaagctggtgttaagtatgaatggtgttcttcaattctgtaaactattcgtcctacttgcaaaacaaggaggtggtgtggctattgtatcacatatctatggcttcccaattcatattcttacatctggcaatttcctattttatgaaatattttaatatggcaaactcattccaattacacagtcattataagttttgccaaggttgagtatggatcgttttgtgttcattagagcacaaaattagaattttcattgctgcaaccataaacaccattggcacaaaggatttgagcattttctcataaaatcttggacaactgataattgttgttttccctgtttttcagcatattttaattttttgaaactattttctgtatttcctcccctggtatatttcttttggcctagaagtgattctcttccaaacggatgatgtcgcacacgatgcatgaactagtgaacacagagagcaccatccctagagtcaggggaaggagcataaattatttctttaattttctcagctttagttggtccaaagtctggcagttagacctgagtaagtctggaaaaaccgtctggcacacctacatctgttctcacatttgccaatcaggatttatcaaaaatcaatggctcaaaaacatgaagctcttgagaggtgctaatttgtggctaaagaataattcaaatgcagcaccatttggtcttcatggaatatggtttcgattttgggaaattcaatgactgtttcatcttgctctcttatattctctgttaaaagaaggaaaactggaaagtagttctaatctaaggactttatttcccctacatttgtccctttggaaatttggaataactttgccaaggggatttagatacatcagtgctatttatttattaatggtcactcatacatccctgatctcttcctacttatcaggatgttctcagcaaaacaccaacacttgattctgtttttcacttaccatcccttttctccaaccctctgcctgatattcgaagtcaatcacctatgaagaaggtgactcccattcctctccctccgaggcagcaaagaggagataacattcattattcattgcaatgtttccactttgccaagatgtattctcttacttcaaattcagaacagtttattggcttctgggagttcaacagccatgggtggaggaacatgttcattagaggaagcacatgactctgccagatttaactgacagattttgaagctggagcaagcaattggctggcactcttcaggcatgaatgtcctttggcttgtgctgtgctcattgttacacaggtgctccttataaagtacgtgcacatttctaacataaaaccaataatgtcattcacataccaaaaactatagagagcttatgcccccgtgacaaatttgagatgggagcaatctacactatgatgtatatgtatagtatgatgcatatgtaactgactagattatactttgatacagttaggttgcgtttatcagactttgtagatttggagattaaaatgatttgcttttgaacctcatatgcttgggacaagaggttttgtctctgaaagccaaaagcgtcttgtcaaaaggccgcttccttaatattgcttctaaggtcagctttatgatgtcaggtctagagtataaacattaaactctactactgtttgcaaaaattttgaaacggaaagataccaaaccatatttagctcactagtaagtaaaacccaaagtgtgtgtgatagataaaatatgggcatgtgttaaaaaaaaaaacatgatgtatattagcagagttgaactgggtcccacagatacagcacagagaatagaaaaatacttcgacttctaagaaaacactcaattgtttgctttgtaggatgtatatagtctttgcctagaagagttttattctctgtgagggaatccacagtgtaccaaatattccctcttgcaggatcacaaatcactttctgaatccaaccaaaagcttctctgattgcatgtgtttatgaggctggtgagtgtccaggcctttgaagaaggaagactgtttgggtatatttgttacagaaaaaggaagttatggaggtttctctggagctgtttatcttttgtgaaaaagtagaatatgtcaaaatagagccacagcttaaactctggcagttcccagcaaataaacgaggcctaattatatgtaggacttcagctctatttaaatcaataataacaatggaaatgatcaccagatttttaatttttctataaaaagtgaattgaatgtcagcttcatatactttggatgaacctcaactcttcctagagtggaatagcaactataggaaatcaaaatgtaaaacctttttactatatggactttgattttcttcagggacagaattaaccaccaaagataatgattaaacctaccagctaatgaaaagacaatagtgagatagtgagatttgtagaaaactcatcatgtatatgcatgggtgtgcatgtgtgtgggggtgtttgtatacacttttagcaaacatcggttttctttcactggaggcaaatctgcctaaattcagggttcttacctgaagcctatgccttccatgcagatgaacaatgctagatgttatgagattatgaaaaatggagataacttggacaattagtatctcttccaaggaaaacattctccttaatttgatgcatgtgaatggaaatgtgttgagcctctactctgctagacacagtagggaatttcaaaatgaggaagccaacacctgcctataggggcattagaggttaggtggggtgggatcagggaaaggaggaattcagacacacagcttcttctacttccagatagatgccaacccaagtatgacacagaaaaactcttacaatgttagaattaggccaaaattccccacaaatccttctagtttcaacaacctttgggtaatataggcttacactgcttctgttgagttctaatgtctacacactttatctacctcacattttgccagaaggttctttgtaggctgaatatcagcagacagcccagccagatctactcaataagtgaatgcatataacaagacacttgcacagacttctaaatctaaccattccatcaaacagtaataaaaagtaaatctgcatgatattagatcagattattttaatgatttccttttaagagcagctgtccagtttgcatacgtcccttcctgaatcaaaagaaggggggaaatgcatgagcactgtggctccacacagttctaatcctgtctaatctgtaaatccctatctgctaatgtgtagcttcctgtcagtagatagccatagggataaacttaagaatattcagcggtgttatcccaaatcttaaagaaaccattataccgatgagatgttatcatctttatttttagagaaaattttaaagaccagaaaataatttgaactttttaaccagcttatagagttagtggctagaacacagtaggtatttaatatttgtttaaatgattgaatgcaagaaatattaaagaaaacctcagcctataggacaacatttccacagtgtgtgttacaggtacacttgtcccaagggatgctaagaagtcagcagtttggtgttccaaacagttacttccataacagaatgctggccgatggctctggccttgggagttcaagcctcctgtaaggctttcaaagaacctaggttacaagaggcatagcctggagtagtgaggggcacagtgtttgggttcaaatcccagctctgtcacttcctcactgggtagttttgggcaagttgctttagctctctttgtttcccttccctcatctgtgtaatggggataatgatagaatgtgccttatagtgttgtgatggagattaaatgaggtgatatgtgtaaggcagctggaatagtgtagctatgcaagccttcggtatggtgttcattcccatattggatagcctaccagctgggttcaatggcaagagttccatacctggtgtaagaagacctggatttgaaatctggttagctttgtggccttgggcaatttctttaacttttcttagccttagtttccttgtttctaaaatgaaataatgcttcctataactgctgtgaggattaaaaaagagaattaaatgagattctatgtgtacaaaaatccctggcatatggtaagtgctggataagtatcttctgagtctgctggatgagggtccttagagcaatggcccccacacccagccacgcttaagctgatctgacattcctggtatttttcttgccttatcttgcagctctactgcttcccatgtactgtgcattacgtagagagtaagtccagaggtggggaagcatcaaggctgtactggaagttccattttaggccgaggcttgctatgtcataaaagaaaataacaaagtatgtgttggtatcttttgccaagagcgacctaaacacatcaaagcctgacagttctatttatttggtctcttctgagatgaaaaggggtgaatggaaattctcgcactccacctcacactggttgcatgagctccctctccaccaatgacagtggccgactgatggtatagtttaggagggagagtctccctccactctagtcattactcttgttggggatctgtgtgaaatcaatttcattgcagagcagcaatggaagtagccgtgaattccatagtttctaaatgaagacacagcatatggagaatacagagtggaatttatagctcataattacacaggatatgttgtcggtcaagtccatcttgctggtgttcacagcaatccactcctgcccacattaaagcattgccaaattgcaataacctcctggccattttcccagtgattgaaccttgcacaccacttcaatccatattcgttgattttcgtcaataaaatgaaagcttattggtggatctatttgggtgacctcttagaataaaagcctcagtgtcacatggaaaaaacagcttatgaattctgctctgatgctctaatagaaagaaatacaaagcatttaacaggtgcccacctcacagttctacttttccccagatattttcagattttccaaccctgagacctaaggcgtcactttctctagtgattgtgtttgaggttttttatgaattctcattattggtttaccttttggtgccactctgagtaatgttaggattttttcttatggtatgcctgagacttaaactttacaatttatccagaaagctaatacattttggaaaaaagagaaattgggaccttgagcatggacatttatcagtaactactaatgctatgactagtgaattatttagagagaggcagggagtatggctgaggcagggttcaaggcagagaatatgtgttggcagaaaccttatagcagtcagactaaataagcttaataattttcttttcttatttaaacaaataacacttttactgtaaatcattcctccctgttttcttctttccctttctctcttttatcttgtttttcttttttgctgcatgtctgcctcgccttctctttcctgtttcctcacagtcctctctttcttttcctttccttttttttctgtcgtacattctcacactctacccaccagggctcaaactccactatagtctcattagactgtagtttatagaaggaaagtaaagatacctggaggctaggttaaagggaagggtcctccagctattctcttgtgctcgattattattttgaacactaaacagcaattcgctcacaggcaagagggatgtggcgttctgcattctactgagatgttgacttctttcatggagtgtcatgaacactgtttattaccaaagcactgtcaaactccctatttttggagatggaatacatgatgttacaatgtttttacacattcactattgaattgtactttatttaaataaaacaacattggggaaggaatcattaagtatatcaaactggcatctttcaggtggtatttccatgtgctgagttactgaaatgaatgcaaagatgatcagggattttcactgtattcctgaagatacagatggtatccaacatctcctcaatgaagcctttggctctgtttttcgtaaggttcccactctgttcatatgaagtagtgtatcttaaatataaacctatcatcaggtttagcaaatcaataccataagagtgtgaaatgttccccagaactctctacaagggcatttcacagtaaaagcaattgaaaaagaagctgcaatggaatatcttatgagatagccatttagatcacaaaagggccataaaagtcacaagcagtttgtgtgaagcaaggttcataatataaccatacaggactggaaagaaagaggaaaattgcaaaccaatttgtggttatagctttttctgtcaattctactgggatttaaaacttgtaaaaggtagaaacttctgccagcttacattatgtagagagactgtgataaccataatcacagtagccaaacaaacaccaattatttgaagccaataaagtctttattaacttcaaagcaattagtgcttcttggatttattaagccacagaatgagaagatgccacccaagaccatttgtcagcaacaaatttgggagtcatcccgggatgcttcatttacacatttcaaaatggttttgcaattgaaggatgaatactttgaagttgagtagaagaaagagcggccctgctttggggagcccatagaggctccaagatggcactcagaagcaggccctgtttggtatttaatgctgtcagacaacctaccatgtccatcatttcaggctctgcagacccagctagctttctcaaagcaattgcagtaataattgctgtctatactgagggcctgctgggcacaacaatttctatatgcatcatctctaatcagttcatcagctctgcaaggccttattctcttcttatagatgaggaaactgaggctgagaaaagttaattactagtagttgagaatggaacccaaggttgcttggttacctcacttgtgatcttgccaggttcctccttcatttgatgagtcagttgatggccagagccacaccacacacatttttctacttgagtcacgttgacattaccaaattgagactaatcttcatgtcctcttagactggaggcaggagctgacagatctcctggctatatgtaattctgtatttcttgctctagctttaaattaatctctcccaaacagtaagaaaactaattagattacaattgcaagtcttttagcatgtatctttatgattcactgttgattataagctgatgcacagccagtctatccagatctttatttccatctgagcaataaaagtagtttctggtttcccttcagttaacatttctctttaaagagcagcattccattaatgaagacatatgaaatgaaattttgttgctgctgtactcaatctgatttctgcaaacaaatgaaaagtattactgcctcatttaatatcattaggaaacctgacatctcataattatctttaggttgtagtatagctgaggcaagagtcctagtatttttgtgccacttgtgcatcactgaagttctttcctcaagtggcaaaacagattagaccggtgttcttgtcatcggtctatgtagtctttctgagaccagacgaaaatgtctatttctgtgttttgcaaaatcttcactcaccccaagaattcatgcctgtagagcactctcagcagatcactcactagtcgtagcttagctaagagtctggaacccagtaggtattatcccctttcttggcttataaaaaccaaagatgggaggaaacccagattcaagttgtccagaggagttctggaagtccccagggctcaaagccagctctgaaagatcctacaaaatgagtcacactctagtacatggaagtcggtgggcatccactacttgctaaatttatgggcagaaagcacactttgcctgagtgtatgctgcagcatcatagccttaggcagaactgtgacacaagaagctggagatgagacagacctgagccattctgacactgctgtgtttctaactctgtggcctcaaactagtctagtttccttcaagagcatcatgatttttaccggcaaatgggaataagtaaatggaagttacagtctctgcactggctccctcacaaggtcacttcaaggaacaaagagaggatgttctttgtccaaattatgtataagtgataagaggctataaattaacatgagattattctcatcatacagtatccaaagaggcaggtaaaacatcaggtctcaacatgccctggcctacagtaaacattagaaaatatcctatgaatctggaaaatctttcacactgaactataccagcttccttcattaaaggggaagcaaaggccaaaggggaagccctggtgggggctgaagttgtgcaggacacttgccatttctacactggaatggaattactcaggggatagcagaagccctctgtgtttctgagccagcctaggccattgtgaaatgtccactgtcccagcattacctccctggcatagaaactagtgatcacctcaaatagccagggccaattagcaacagaaccttgcctgcaagtcactacatgtccaaatgctctgttctccatccccattcactactggcattctaaatgtcaaatttcaattgcgttggtcccaaaccacgtatgtgtatcacaaataaagcaaggactctttgaggcctctggctactcaacctggaaagatgtctatcaccttgctaatcactgacctgaagctgatgagggtttaaataacacagtgctcctggtcccatggccactaaggcagtgctatttctgcagcttctgctggctgacttcagatagagtcttgggatgagtgatatttttgcaaactgcaaatgcctctgagtaatgggtttcattcatttcatcaaataccacattttacaactggttgtgctaagtggacatttaagaattcatatgcagccgggcacggtggctcacgcctgtaatcccaacagtttgggaggccgaggtgggtggatcacgtgaggtcaggagatcgagaccatcctgggtaacatggtgaaaccccgtctctattaaaaatacaaaaaattatctgggtgtggtggcacacgcctgtggtcccagctactcaggaggctgaggcaggagaaccgcttgaacctgggaggcagaggttgcagtgagccgagatcacgccactgcactccagcctgggtgacagagcgagactctgtctcaaaaaaaaaaaaaaaaaaaaaaaaaattcatatacaagccatgtttgtgatttgcattctcaacactgagttatttcatagtatctgcccattgcagtgcactgatattttaagtaatatctctgcttcttagagtaaaaattttaaaatgtgatggttattatagtcactataacccatttatcagagtggtacagttataaattgtactgctccaattaatttgtaactttagtcactatataaacacaaatcacaccaactagcatcatcttatttgcatgttttacacaatttttatcatctataatgacttacattgttgaaatagatttgttaatgttagaaagacaaaagcaaattaccttgttttctcttgtaactgttaataaggtgaaggctgaaatgcatgtttttattctgctgtaggtattatgtcatatttgggaaggagtggggttctctttctgaaaatgcattgggaaattctgattttgactgggtgagtgctggagaactagttcagaacaccattatgggaagaatccactccagaaagaaaagagtgatgatcacagtctgttcggtcttaaatccaacaatttggactgttcatttgctacttacatgtaattggggctttatattttctttgttgctgttgctgctactgctgatatcaggaaacacgtcttaggctaacgtcatcctcagtatggcagatatgtagtagactccactgggagccaaaagactagcactctcccaccaaatctgcctccaactcaggatttcactgttgtcaattccctttcctctctgggcatcaatttatgctcctgctgagtggaggaatagatgagacattctccaagttcagctctaaaaagtttgatgggaaattttataaatttggatctgcttgtgaggatgaatcatggaactgaaggtaccgcttaggttgagatcaggtatagcctgtgcaacttaatcttctgagaatttctcagattggaaacaagctagaattattctggatttcctggggattcacaagaaactataggcctgctgagaggctactgctcctttgtgggtttgaaaagaatgattttcttgggcatctaccactctatttgttgttcccttttgcataataggaagagctttggagtgaggtagacctagatatgactgctagctcttccaattataacttgtgatcactggcaaacttacttaagctacctgagcctcagtgtctgggaaccagctacacattaagaagcctttcttgcccaccttccagcatcaaactcataaacacagtctctctccggttgggttaactgggttccagcattattcctatctcttcaaagaatgactgtgaagattgagaacacttgtgtgaagtactcaacccccctaccactgagtagttgctcaataaataggttcttttgttcctgttttctgttattagggttcactttgtcagtcgttgaaaccatcaagcttaccataattttgaaaacacacacttttacatctattcgcattcattcatttgtgtattaaatattcattaaatgcctactagttctcagggactgttctaggaactagagatacagcaaaaaacaaaacagtccaaagctctgcgctagtggagtttatattctcttgggtggagacagacaataaacaatatgaaagtttaatgataaaatatattggaaggtgataaatattctagacagaaataaatcaggggattgtgctagagatggatgagttagagctgtagttttaaatggggttatcagggaaggcttttctgagagctgcatcgagcaaagaccaaaaggaagtaagggagtgagccctgcagaaattgcagggaagaacatttcaggaaaaggaatagcacgtgcaaaggccttgaggcaagagtatacctggtgtgccttagaaacagtgaagaagatagttcagctgaagcagagtaagcaagggtaagaatgttggggaaggagatcagaacttgcagtgggaattagactgtacaagagctggtaggccattaaaaagacttggcctagattgagtgaattgggagctgcgagagaatttcgagcagaagagagatatgatctgaattatgtcataatgggatcacactatacctattgtcaaaggactatgggaagggagcaggggtagaaacagagagaacagtaaggaagctattaccataagccaaatgagaaggatggtggcttgtatcagggtagtggtgatgagcggtgaagagtggatggattagtgatgtattttgaaaggagaacagataagatttgctaatggagtaattgaatagggatacagacaaaaaagaaaagtcagaaacaattccatgagtttcagcctgagcacttggaaaggtggtatttgctattagctgagtcatttactataattattatttacaggtagcatgataacaataagaccatatggaaatatttaaataattttttttcaataaacagagtgggagaatgttagctgcttgttatctattaccaatattgagggggaatgtccaaaatatgtgagatcatttctccttacactgaccagtgcttcctcctttccttcccacctggtcattcctttgattgactttcataagtccaggctagaattacatgcctcaactcagtggttctcaaacttggaaatcaactatggcgcttgttaagaaatccaggtatgagatcaccctctcatatccgtgaaatctgactgctgacgcataaacacacagcattcacacacatcaagttgtcacatatttttacatgactgaatcagtcaaatacctggtttgtggttgatcaccagtcagctttcaaaataaaatagctgggtgttttaaagaaaacattttttctgtccaggttatctgtactcatcagcttctgtccaccatcaaagtaaaatggccataaccgatcttatccagatgggggtttaggcagttgatggactcactcatgtgacctttacttccgtgaatgcagttttgtttggcctccattccgcttttgacagtttcaagagctggattagtaaatcttcaaggtcttctacacccatatgattctatgatactgcgattctgccacgttgctatgaaattgttattagaaggccatttaccccttaaacctgggtattcaaagaactagaaacctaaatgatgatgacagatatcttacttaaatttcatataagaattaattccaagtcaattcaacgtagcatagtagtaaaagatcatacagcctttgtgattggaaagagtctcattcgaaccttgatgcaagttgcttaacgcctctacacctcagttgctcacctgtaaagtgaaggtaataacagcatgtgcaccatacttgtattataaggatgaagtgaggtttcatgaaaagtagttagcatattacctgacacacagtatgtctcataaaagtagctatcaccatcaccatcaccatcatcatcatcatcattgttattaactgaagaatcatagataaacatgcattttcaattgtcattgaaaggcggagagaaggctgcaaataattttatgaaagcatatgtttaaagattttaggactagctcttcaatgggtttgtctgaatatacatatatggatgggtgattggttgaaatagagcataatttttcaaagtgtgtttaggcaaaacaaaaacaaccgaaaagcctaattttttttttctagccatttactggctgtgataccttggacaaagtcatggcacacattaagaactcaacaaacaaagttttattggtattatcattattttacatatatatatatacacacacacacacataatggtgacaaaagaaccatgttggacaaaaaatatttatatgcatgatgtcctaataactttgttaggtcttacactcaagcgttagactcagaagagagaggaacataacatattttgaaattaggtttatataagactttctctttataagctacagattgttgataggctaacaataagcttaaacttgtgtcatttgaaactacacacacacacacacacacacatatatatgaatctgtgcattcttatacaattctatgcccaaatttcatattcctatcatccttttctatatcagtagctcattttcagaggtaatgttattagtgctcttcactctcatggacaaattaagtccaaatcaacacataccagaccttcctgaagctctcagcggacacccaacttcgtgatccttggtttcgtgtgaaattgcctcctcctaaaggccagacgggaaatcaggacttggaataagcacagctctccagctctgctcctgccttggcaattttgatatttcacaagaattgctgtgttttttataagaatgataaaaaggcagatataaaggcaaatatcaagaagacttctggctgacaaaagcagaatttggagagaaatgtgaaaatagtgacttacttcagcaacagagggagtattttttatactttaggtttttttttttttgtaaaatcatgactttctagtaaatgacatcctagaagatatttatcaaagcaggaaagccgtggaaaagagcacctcgcattcactttaatattttgccttttcttttgacattttcttgcctagagatctaattccattaaatatgtactttttttgactggaagtcttcttcgtggatctttcagataaatcttaaaagtacataaggtctgtagggcagcttttttttaagtgcaaatgagacacacaatagaatattgtctatgagggtttccaaattatttatactcctgcagaaatttaccttgcgttttctgtgataatgataagggaaaaggtaagattccaatatgccttctgtggagcactgtcaaaccatattagtcctatttaatatctgacatgcaggaatttactttggctgatacccactttgattggctttattaggcattgtcaaggctgtaactttgtctgatggacaaggtaaatagaagtgtaatcaagtgtcaagttagcagcgcactcggtaatattccatcatgcctttgcaaagggacatggcttcactactctgcttcaccatgacacttctctaggactttggagtgaacatgtttgctaaattggaagattacattcccactgtggtgaattggaatgtctcctagtagacttccaagcatatactgttgcatccgtaatttcttctgttgcttttatttatcattccctatgcctccaactatttttctgcattcatatgaaatcaaactcccaccacaggattcacaaatgtaggtttttagaatgtcacattttatggttagtcactgtgggaaacgggctacagttgaggggacccaaagttggagttgagggtaggagtaatccagatttgggttatgctctgcagcagaactactacttcattactacatatcttctaggtgtgatcttttcagtacgtaagagcttcagtatatcaagggaaaatgcaaagtcattgaataaagtgagtaggagcactgagaagctacggcagggctgaaatactcaggttaatatgtgacattactcagaggctcagtaatgcagtgcaggctccagccttctcctgcaaaccagctcaactgatggctgccggctaggctggtagtcctatgggtcctatgggataggagaggagaccacagttaagaatagtttttcctttgcattataaaggcaggaaaaaagtctgtgattataaggttctctgcttccaaatgatccatctaaaaactatgagactagacattagaaagacaaatatgaggacccagaagaaagaagaaaagaaagggaaataaagaaaatcttctagccctaaacacaactaaatcatatctccagtccaccttagacctctggtttgttaaaaacaactttgcatgagaagagttgattcatttttcccccatatatatcttacagctttgggtcatctctggtcattagataattgtagtagctttacacaactaatttttctattgccaaagacaaagatgtgttggaatttttgcatggtggaggagatagtgggaatgaaggaagagtgcaaaatatgttgcctttgcaaaattgtcatcgaaaggatagccagaacataaatgatactgttttggcttcaaaagggtaagcaggtgtcttcaaagtcccaaatgagctgtgtacaagcttgtacaaacaagcgcagaatcaggcctgtttgttattcacacaaacagagtgtaaaccatgtgaattccacagttcccaggattcagatggtgcacaatggtccataatgagcagcacctgtgcttacctcaattaccagacagttctcaacagcagcagaaagggctcactagaattgtttttcaataatagatttagttatgtctttcataattggattcaaaagctcaaaatttcattttgcaacttgttcataaaatttgtatgaaaaagtctggcatttattcaaaagaaatagtctatgaagaaaaaattgcaaaacagccaaccgctggtaactaagcagccaaattatagtccaagcacttggcaaatacaccgtctttttattatttcagtaattgaatttctgttaaagcatggagcataatttaacatgaggaatttatttatagtacaatagtgtttcagtaataaatgcattatgattgtcacttttaatggagtcttatgtattccctctgagactgtgtggcagactttgagacagccactgcaccagtgttgtttgtagacaattgaattaattggagacatggtcattaactcgacctgaatacctctgattgcttctgtaaataaggttagagagcaaatggctaatcttcgttgtcattatagattcctcttacattttcacactgccttgtatattaagatcattttgctaagcagcttttgagactctccttatatttacagtattgtcttgcgtggcacataaccataattgtatcagacttatattacattctccatatctttataaagcacgatactaaaaaagaacctatgttgaatcacaactcataaaaaccatcagaccaataaatgaataaaccacagtgtataaaccatcgtattaaaggaaagtaaaaccacaccgcaaaagttgctttggtctcctcttacagatcctcttaacacaggatggcctcccaaagatgcaatcactaaagaaagagcacaacaaggaaagcattgattaaaatatctttatgtttcagttgatgtcatgccctttcttgcccttctgtaacaacattagtaacatgcaaatcacaggaggttaggttctttctccttgttcattctagaatggagttacataagaactatttcaaatacagatattaaaaacttttgaatatttgacttaccatgttatttttgtagcttcatcctgttataggtatgcaagatatttagaggggatttggagaaaaaaaatcttctccctttatgactcaaataattcaaaaagtgcatatactggaaacatctctaaaaatggactttccagtcattttataattcagacatattataaaggaccattaaaactgtacagcattatgttgaataatgagacatttacaagtaggataccacaaagagatgaaaaagaaggaagaggaggagcaggaggaggaggaagacaagaaagaggaaggaggaaagaaaaataattctgtgcttttatttttcccttggcaagactgaaatatactgaatatataaaaacgatcatttatactagctctgtataaattatctatactactagaagagtagatcacttcctcattgttgtaccaagccactggaagcctatcagttttcatgagttccatgcctaactgaaagtgttgacattttctttggatattaaatgggtcatgcccaaaagagaaaaataacgaccatttcaattatttcagactttttgcctttatatattcttattttaacactaatctttgtgtatatgatggaaatgttacatttgactctcatacatatgaatgtgcatatgtgtatgctagtaatcatggctagaacccaaatgtgggttgttgtatatacattggctggcagcaatatcatttttaataaatgactaatggccaacatgtgctgcagaagtcaacatttctgtccttagccagctaatagtaacattatttttaaattaatgttatgcacaccatttgaaggatgacacttctcccaatgttttcacttcttagccagccatctcaattagtgctgaaatgattctactttcttggtattagccatcttggattttaaccaacaggtgtacacactctcacatatacactcactcaaatgcagactggcacacgtgcattcatacatacatacatacacacacattcatccattcatgaggcgcaggtatatatacacatgcacacacatattatctcttgtttaaacaccttgaatttaggcacagttacctgaaatgagtattgaaatataattatagtgaaagggaacattttggcatataacctttctggaaaatatctctctgccagtgttttgcccaagtttctaactggcacagtaacatacccaggttttgtcattaagaagctgtagtagtatgggactcacagaaactgcactggattttgagatgttgataccatcagactagaaattactctcatctcactaaaagtacatgtctcccatgctttgcaagtgagaatattttgtttatttgtttgttttggacatttaaaccccaccccccaagttgtcaaagccttgtctacactataatccctaagatgtgcatttgtttgaatttagtaggtagggaccctgtagcattgtgatttgctgttgacatactaaaaggggatatgatgtaaccttcagaaaatgcagatttctagatttttctgatgaagtggttgaccacaaatgtaatctgcttaaccccagaaggtattttaattcctgttttaaatccattttattctaaattcttccttctttgaaattgctaaatttcctaaatccctcttaataacaaaaccaaacatcctgaccttattaccacctgcctgtttgtcatcatcacaggtcctgccagttcttggtgaaatgcctaagtttgtttccatttctttctatgtcagcatttaatagactctgtgttcatttgtaactcaggattgtcattcctcttgctattgatctagttgtaagccctgccattccacatacaggagtcagtgttgagtaaggctgcctgtcctcagctatcttatcactagtggccatgtacagacttcctcttgacgtcaaaggcaagttgggtacaatatcaaatgagttcccctaacatgaggaaattgtgttcctcttttcttctcccatttgcacttggcctccttcaatttaacattgatgagaagggagactattagctagaaggtaagattttcaggcagactaaagatctagtatttcctatgctgtcattcaaaataacaggcataagaacttctgtttaaaatagctgggctttttgactagagggcttttgtgtagaagatttaagatgtcagctttaaatatgacattgatagtctttggcaaagaatgggagtgaatttttgtagaaactgcctttttttctgattgtttattaatggtctttgtgatttatagtaaatgctggggaggatttccaggcccatttatcatgagaagggaacaccttcttgttcttaatgtgagtgtgtcataattagcaatgcatgtgggccaggagatttaactctgccttttctgaaagtccttcaacctcatatttaatcccaaactgactgaatattttttcttctttaaggaaattaattatgccactggaaaaatcatcaactagagagggagttgataacaggcacaatgtaggctgggttggctaatgtatcaaaatgacatgattagagtaactcacatcttagacaaattggaataatggagtcatcattctaattaaaaacaggaaggtctgtttgtatgtagcattcattttcagtaagaaccacaccatttgtttttcatgttcatgcatgtttgtacactctgcgacccatcaatggttgttgctctaaataccaattacattaaaaatatccatccagatactttgcattttgtcaatgaaactgaagctgaagaaggagttgggcactgtgtcatatggccagcatccatagaggcagttgaagggttacaacaaatccatcatcatgcaacctatttgcctgattattttcatcaaattaacttatgcttcatgatgtttttgtgttccataggctggcctaagtactggcttctgttgatacacatttcacagttaagtattgttctttaccaggtgactctgtttgtgcttcatttctatatattataaagccatctgaagtattttcttataacaagaaaattatatacaatttatcatgccggtcaccctgggatatgcaaaatgactttacattctggtccctgccatcaaggaatgtacaatttagtggtgcaggttagcacaacgaaataaaatcatctgagattaatgaagtgataaactgtgatgcaaaacagggagatatctgtaagaattaaaaagtcattagcgatgacttcatattatttgaatttgagcttgaaagataaagatttaaccaagcagaagagaggggaaacgtgccactgtagatagagcaaacaggataagcaaaggcatggaggcaatgtgggagcagagaggagacaaaagtcgcatttctgttgggaataacaatcagaaataaaactgacactaaggtagggtgttgatagagatctaactctgaaaaccttatagcaaagagtgtatatatctgccagaaagtcattgtgaattctgaaatagagagatctcatgatacaacatattgtcacagagggtgagtataaaagagcaaagcttttagttcaccagggaatgaggtcaaggcaagtaagaaaagaacattggatttgcggccaggcacggtagctcacgcctgtagttccagtactttgggaggccaaggtgggtgaatcacgaggtcaggagttcgagaccagccttgccaacatggtgaaaccccatctctactaaaaatacaaaaaattagccgggcatggtggcacacacttgtggtcccagctactcaggaggctgaggcaggagaattgcttgaacccaggaggcggacgttgcagtgagtcgtgatcgcgccactgcactccagcccaggcgatagtgtgagactccatctcagaaaaaaaaaaaaaaaatagaaaagaaaagaacattggattggcaatgatgagtcaggaagagaagggttgttgcgggcagttaagaagcagttttagtagccaaaagagtttcaaagcctaattactaggcctgaagaagtttccagtggtgaggaagtggaaccaataagtgttgactttgaccacatctttaagacattttcatggtggaagacagtcagtgactttttcctgattaggaatgtatgggctagtctgggtgaccacccagcagggctgtctgtacatcatccacttctcttggcaatatgttgtgttgctgccttgtgagggttagatacagcaattttgcaagttacagtttttgccattcacttagatttctgatgatcgtgtttacaatacaattatgaagtaagattcattcagtaaggaaactatatgacttttatttcagaaattgcgtatgtgactttgaataggctgactgcaacaaggttttcctagcacacagcgttggtgtccttcagtgttttcagcaccaaattcttacaaccagattcattaggtcagctgaagaaaactttttggattaattttgagtcttattgctttctgagatgattagaaagatgagttttgtagtgggttttgattgttctcattgcctctagcttgacagtgtttagtcgatggtcacagtagcctagtgaataggtatccttcgataactgttccttctaccttctagtgttcttgtggcaatcaaatcatgggagttaacttgcttgaaaactatcaagtgctctgcacttaaaagtattctgatcttattgatccaatgatgatgatatcctcttggaaccatagagtcacagagcaatagggatgttaagtgcctacccaaaggcagaggatatgtctgtggacagtcctccctgagatttatagagaagacttctttgtggctttactctagggtgtattaagcacactaagcattttacagaatatgtggttgataaagcctctggtcttagaagcttaccttctaaatcaagtgtctgtgatacatcaggtaacagatcagacatgaagggaagcagacaatactgataaggagaatggcattgaccaacatcacaaaagagatgtagtctaaggagagattggaagagcaatgcccacttcccaaattgagcagcaggtctaagtacattgagtaataggaaagaagacataaagcacggaaaaaggcggaggcttatgctaagccactgtgagactatcttcaggaagacctgtgcctgtctaagcatgctttgtactttcctagggaattcagcccgccatctgcctgggttctcctgacaagcagttgggccccatctccgggccagcttttggaacacagtggaggagattcctccatggaagcagtttctgggtttaagacacccagtggaagtacacagcctgctccacctacgatttgtaactgatatgattccttgtgggaaggtcttgaccttgttgtagactcctggaggctggccctttctgggtttcttgtgaatgcaagctgccactcaatcattcattctcagctttgcagaggccagagctcacgggagtcagtgttcacatccacttgcccgcctttcttctctcctttgctcccatttttaaaaatgggctttaaaggcaaaaggtacaaaaatacttggctttatatgattttttttcccacctgtttggctgtttgattgaaacagctctgtctcatgccagaaaagtcagtgtgattttttaaattatttccatagaaaccgaaatatcagcttattcttccatatgcaaattgcaatgctttgaagacataatggtccattagccaacgttggccagtcttactgggaacatgctgacatcctccatagtgtcacctcaccatgtaccatggtgaggttgaatccaggtgcctttttttcattcaggttgaatccaggtgcctttttttcattcctttgaaattgcaatattgaagttaatctcatagtatccttaaaactatttttcaacttgatatggtttggtgctacatctccgtattctcagctgtaaactggaagtagtaagagtatctaatttatcgtgttgtggtgcaaattaagggagaaactgcagggaaggtgctcagtagcccagttcctggcatataatgaacactagcactaccaggatgaattatgccctggatccccactacggccatggatatagcctgctatgaccctgacccttggcttgggcagtggcaagccacctttgaacgtcattagtgatccataggacgtgctcacaggaaagaaacatacattaagtgaactgctggtgtgggcaagtaggttcaggaaagtggtaaactgatatcccagcttatcagaaggaatctgatagaaattgttcaggaacaattgcctaaagaaagcttaaatttcaccaagtcagattaaaaatgatacaaggtagtcaactttctctgttgctaaaggaggacagaataattatgaaaaagtgaaattcacagttcaccttaaaattgggttttagcctttagtttcaaattcgtaactcaccaacttctttttctcccagtggctcccatctgaatagccccatgtagatattagccttgccatgctcaatgtggtccactgggagttatctgcatcacctgtgattatattggaactgcagaactcagaccttgccctaggcctacctaattagaatctgcaggttaataagatctccaggtgattcctatgcacattaaatttggagaagcatgggtttgtgagtttcctcacctaaattacctcatccagccctcttaaaaacctatgtgatatattatccccattttacaggtaaggaaactgagacccttatgttaagtgcctagcctaaggtcatacactgatgaagtatccaaggtgacactcaaaagcagatcatctgacttccaaccctatgctcttcccattgtactaaaactgactctttaaaaccagtaaggaaaatgcagctgtctagatatgtggcagtggattgaaaatgggagacggggcacaggtaggaaaagaagaggccaagtgcctgagtctggtcaatctacagaaaggacaaccaagccctgattagttgtgagtcaaacatggtgctgaaaagccattgccaaaatcactcataattatcatctcagaaaggaagtaggggttgagtaagttagaagaaataggaaccaacagctggtgatcgaaaaatgtaaaaagccggtcatttacagttatcataaaagttccaaacggtctgtttgcagcctctctggaagatgtaacctctcattgcaccattgatgtggcattaatctactagcgtctttttactcagagatctgcttcccagcacgtcatttagccatcaaggttcccttcccagggtgggcttatatgtttggacttctctgaagggaaactaaattttacaaacaaaagaaaatctgttcaggtgtaagagggtgcactcagaattttaattatttggatcttgtattaccttcctattgctgccgtgacaaattacctcaaacttagtgctttaaaacaacacacatttgttatcctagagttctggaggtcaaaagtcagatgtgggtctcacatggttaaaatcaaggtggcagcatggctgcattcctttctgaaggttctaaggaacaaactgtttcctactcaagtaagttattagcagaattcaattccttgtggttataggacagaactctccattgtcttgctggctgttaactgagggccagttccagcttctagaggctgccacattccttgacttttggcctccttcgtccatcttcaaacaccagcatagcaggtcaagtctttctcacatggcatcactctggcctcctcttctgcctccctcttttacttgtaaggatccccgtgattacactgggcccacttggataatccaggataatctccccatctcaagatccttaatatttacatatgtgaaatctccttggctatataaagtaacatattcagaagttctatggatcaggttatggacatctttgggtcagtcattactccatcaaccacagatcacttcagtcattcagggctttaagcaatgtcatgtatagtaacttgtctgagaaaatgaataggaatgaataggtgtggacctccttattactctttgcaagtaaattgaggcggctctatttcaaacatcaggatgagataacaggacaaacatcctagtgtatacatgttaggcaaagacaatctttttatgaagttatatcagggtgtggcccagatcacaactggaccataatcgactgtctgctcatcaatagcatcagagaattagcagaaaatatatttgattgtgacttgcttgtgatgatattgggatatgaattattttattttcaaattgtgctcagggggcatcccaaggaggtagggaagctgctggggacataggctccctcccctctccacatcccttgtttcttttttccaccacagcaattctgtttttatcggttttatatattattcttctgtgtacactttctattgctttctatttctgcatacactatttgttgcagaaatgggctaagtggattttcaggggacaggggagatgggggaagatttcaaaactgctgacacagacaaaatggaatcttcccagtctctagctagaataagttcagggttcagagtgtctgcctctggtggcctaatgtgatgaggcaggcataatgctccagttctggaacccagagttcagagacaaaaacgaaggaggaaggaagataagatcagctgcggatgttgattcctttgcctgaagttcatctgattacagcttaatgatgaaatcaaatatgaaaccattctaaattacctaatagacattttatcccagtaaaactggaacacagtcaagctgatgaaattcatgcaagtcttaactgaagaggagagtttcatgtaggactctcccattaaacatgtcttgctccatgtctttggcaagttctgggccttgtgaaatgtgttgccaagatcaatatgtggacttgcttatagaatcctcccatgtacatttcctatacatagtctggatgcccacacagcttgttggagcagaatggccaattcatcatctctgtttatctccagagaaagggatttacagttaaattagaattagaatcaaacagcactggtgcaggtgtttggctttctggaggctgttaatctgaattagtaaaaagtctgacttataaaatagcctacagaagtgcagttttaatcctgtgaggtttatacaataaccctgtgactgatagagtactgtagagacaggacattcctagacttgccttaaggagcagattggattgcacaaatgcctcctcacatgtttctcataaagtccataaacagcctcacttaaaatccccaatacactttaggttcataaggattataatctttgaattggaagacaccttaaattttgtgggtagtggggccagtggtgcaagtggtaaaggaatttaccaatacagttgtaggtaaagaaaggaagatttattaaagtatgaaaatatgttgcaagtttgcaacagcagagaaggggctgtctgcaaagaggcaggggctggagggaaattttacagggtcatgctggagggggctatgtgcagaatgaggtcattttgcccatgaaacaggatcattgtgcctgtggaatgaggtcactgtttgggattagccatctctcagaacaattgttcattgttcttccccacctgggccctcctacacctggggccccttcctcatttttgcttacttatcaggactccatactaaagatcatccaaccccacttcagacccacaataaggattcttctcccacattctttatagccactggctatctgctcacctaaagtgcagggttcactggcatgcaaggtagtgcattctttctgtggtcagctgtaagtttttaaaagtatttcctgatgttgaggtaaaatcttcctgactagatctccaactcattggttttgtatttaccgtggaagttcagaacaagcccactctttccctgctgccagggcagacctgcacattgtttgaaaattttcagtatatgtgcctctccccccatccccaacccagagtcttcttcaagcagaatagtcggtttcttcaatgtggcctttggcctctccatcttatctgcatctattcattaattatggtgctacacattaatccctttattgcagaagagtctgggtggtgtaagcatagaaagactatcacatatagagtctagggtgcccagactatctcttaaagcccatttttttcccctgtcactctcaagctttccaccagggtcaaccgtgtctggagaaggcaccttaaacgcctccccagcttctctcccactggcctactctctgatcgccttccccagctttggattcccccactagggtcactgacttgctaagccatcttctctgcccccagtctggcctatgaccatgaagacctaatgaatgggtttgggattaaaataaagcttagttctacttggtaaagatgaatgatgaatacgatagcaaattctgatgaatatgatagcaaaatctgatctttgagaaggttgagcagttgactttgaagtcattacaaatgtgggtcctttgagaagttttgttacattgtagtgaagttactgagtacacttttaatatttacagactatagagtggatggcttaatatagcaaatgttaattatttttagtatcagacattatgtttgttgtaatcactagcattctttttaaaagcagtttattgaaatatgaaagtaaatgatgtgtgaaaaataacattaatacagtcttagtgaatgaagaatatataaactgtgcattagtttttcatctcctaggcagaatcaagtattacatgggctagctttactcataaccactttcatgtacatctggaaaataaattagtaacgtatgaaaataaatgtagcagaagtggaaatttaactagctgaacagctaacagatttcagtgaagaactgaaagtgacatattatgatgctttgccaacttgaaagttccatggtatattccagacaagaatgtggccttaagccaactattcagacattgatgtttgtcctgcttttaaagacaatgtttcagttttgtactcactttttgtccctgggagcagtcccaaccgggcgcaaggtaggcccagaggaaatgaggcccagactcagatgtaaagcttacattccttagcagactggctgcatctacagtctccagcaagcccatgagcagaagatggagagtagaggcacaggaaaggtgctggtgagagcaattttgcctccatttaagcaaccattattcccttccacaaacgctggctctccatttccaactgtgcaacttcccggagaaagcaattccttttcattaacacactgaagtccttcacccctagtttgagttctcatggtgtcctccctgaattaaagtccaccctccttcttatccccatatctgtatgtgtaagtataaaaagctgatgtacttcttcttgttcttcctatactaatttcctctaagtgttcattgtcaaaattgactgtgttggagtcccacctgagaacacagaaacagatttagctataaaaattcttaggatacataatttcaggtctcatttcattgggtctcagtcaaggttgcccttatgtttaaaacagttttaatttcatgtctttctttatatctacttataagtattgtcaaattttcatatatgatttctatttacatccataatttcttacacttctgaaattcaaaaagttctgagaaccaatattttttctaaccttgagacaaactcatttgatgataaaacctgacctaaactgttgtaaagatatttatttaaaacatttatgtattcctcttactgtgaatgttactgcaacaatagtaacaagttttattaaggggtgcttatccagatcccactgagaatattatatatggtatattcagcatagtactttttaaaattaaaaacatccgaatactaaaatacatctgttctcagaagggctttagataggaaagatatatacaaaacacatacacgcacacacacacacacgcacacacacacacacaccccaatttttctactaaatccatggaactttgatttagctgaggaataagttgattttggtaaataaatcatccctgcttcatgtgtatcaccttaatgtatttggttttgaaggagtaatcccagggatttttttgtttcttacagaagttgctaaaaaattatctagtaagtggaactctatccagaaatattccaaagtcaacctagagtctattttagcttagtaatagcaggatgaccagcttcgtattaaaagaaatgagtgcataaatgtgaaatgatactaggaaacagccttttctcttgagaatcataaatgtggatacaaattagattttatccctcaatccaccacccagtattctcagtgttgcagatgctctgtgttatatttaaaacttcacttgggaggaattgaggccaagttagcctaatctctggattagtctcacttagatttctgttctctcaatctttatttagtaaccgaagacaaaaacaattgattagatttaaagagaactttgcataaatagggtatcattactgacactaaagagagatctacaaaggaatgcagggaaataggagccctgttataggtctcctccctttcccccccactgctggagaaagacacacagttcccaggagatacagtagtctccttatttcttgtactttccctaatctcttgatgtacttgacagagaaatgtacttgtagttcgcatttactaagcagatagcagtttaaaatgagctttcactatgttaaagaaaatgtctacctgggagattaaagggccagtctttaaggacacacggcacaggaagtggataggccctctgcactgagtagtgactgatgaggagcctgtgctggctttgaagggatcctattccttcccaagcagcagctcagtatggctccagctcagtgagtgagagttgtaatgttggagaagaggctctagtgagggcatagggtggggtcatgaactcgtttgggttcaggcaatgaataaaggtctgtgctccttgagctgggggctggggaattcttgcggatcctctttctcacatttgaacatggggccacaggaccaggtgacctccaggaccatactgggctctcttgactgagctgctgcttcagatttgtggaatgcgagggagagagcaagtcaggttgctgctgcatgcaagaggctgcgaaggcccagtagatggcaaacagacaaacaggccccgagcactcccctccccatgagctaaactgatctccaaagaggggttaggctgaagacacagagggagattagaaccttcccccaaatttagagacccatttctgagagaaagcaaaattcagtccaaagcaacaatgagaaaaagaaaggtgatggcataccccagtgtaccaagttgcagctgaggctgacttgttataggacgcagagagcaaacgatcggtatggaggagtattatttatcaataaaggcagagtagcaaatggtgtcactttccaaatgctttgcttggtcagctttacaaatttaaaatcaatcattacagctggttgctctcttatgatcataactccttgtaagagttacaaagaggttataaaaagtatggtggaggaggcctagaagtgtgttgtctcattcccttattcatgcacccaacagacagaaattgaggaccaactctagtcactttggggctgagcgccaggccctcagcaatgaatatgctcagcacagctagtgccctttgaaggagctggggggccagggtcctaggtgctagtcttggctctccaactagctgtgaggcagagaccagctccaccccctttctgaacctcagtttcctctaattaaaatgataattgaactcactccttcttggtaatagaactatataccatatgtttagctaagatcagagccccttgacgaacctgtggggtattgaacaagggggcaacaaaaaatgaaaaactaccttaactgaaaaaaatgggacagttcaacatctaaggcactacatctatatctgcatccagaaggcatgcaaacttggcttaaggtttttatgttgaatgagggtggcaaggcttttctggaagacaaggcagtgtgatggaaagccaaggaacttgcatacacataggcctggttctcttcaaagctttcaacttgggccagtcactgggcctcctaagcctcacgtttcctatctataaaatgggaacggtaaaccccactctacctgcatttcacagaccacaggcccttcacctgaactgggctgttttccatcttatttgagagtaaatgaggcaatgaattatgttgtttttctttcagcccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagaggtgagtgaaggtgccagggccctaaccatgatctgcctgtcccacaggcagcaccctcaacacacacacacacagacacacacacacacacacacactttcagcacaataattaataattaatttagcatgataaccacttcagaaaagtacccagatttttaacagcacttttaaaaagcatatattcacatactcctaacatgcatacattttttgctgtgtgactgatttgctgtgtgactcacttagcttctcttagcatagtaaaactagcatagtaatgaatagactagcagcttgtcttctgagagaatcaatgaagccagtcaagatccaattctggccttggggacactaacccttactctagattaaagtgattaaagtgtgaattgccacttggcaagtaagacccaagaagtatggctttccttaacggtaaaatgattatttaaatgttatatgttctttattttaatatgcatccttcaagtgtgtttgataataattcaccaaaacatttaacacagctccatgaaatactaaaataataattttgaaataaaagaatttgcttcacatcctctctgagtccaggatagccgctcaatttccctgagcctgcatttggtatagcaagtaaattccaccctcaacccccggctcttcatacacttgtttttcaataatcagaaaagaaaaataggagacaataataatattactgctattaataatagaaatacctgttgaacatggaccatgcatgtgccaggcactgtgctgagctcttgacttgcattttctcatattatcctcatgacaaccttacagagtacttattattatttttgttttacaaatgagagaataaggttctaggaggttaaaaagaactttcccaagacctcacagatagacagtagtagagccaggactgaaaaccctggtccatgtgtatccagagctgatgttctcaacctgaaagctccactgcccacagtggctgctgatacaacttcctcaacccttgcctgccattgtcttgtgcaggttgctatcacaactactcaagtgtttttaattctgtcaccctctattggctggtaccataagcctcagctgatggctttcaaaggaagagctcttctaataaaactgatggcagaactcagagttaggaatcaaggacccgaatagtatgtatcattgccatggtttagtggatgctaatgtctgcatgcatgttcctataaattggttattgcccatacaccgacgaaagctcagtggtttctattttttggaagtaaaatctttttgtccttcagtaaaaatacaaaaggcctgatttgtttgcagggaatgacagcatcacatagaaggcactggcactctggcagctggaaagcctttccttttgaattatacttgaggtgtgcttacgttcctttcaggatcagagactattacctttgcctcctggtgagaggttgagtgatgattcccacaaaggattttggaaacaggtttccctcattggcatccctgccaacccactggaacatctctctgtgaataattcttttcttcctggccaaactagagaatattttcagagaaggagtcgaaatgagcttaaataagtagactgcagctggtttgtatctgactatttaggtcatttgaatattatggatagtgggtatgtgcaggtgtgtgtgtatgagtgtgtgtatttgtatatgtgtgaacagtcacttgacatccaaagcttttagtagtagtctctgtactcagggttctcttgaatccttcccaagtgtaaaaatcattcttgctgctgtttctcaatctgcagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaaggtaagctgtctaaagtggcctgccaagtgcttgtgagcagtgtctgtttgttgtctaacttgatcttgagcctcatcttcaaggaagccaatggcagtgcattgcagattttggcaaaggtgatgatgctttctgtgggaaatgcagtatttgacatgaccagagaggaaaaactagaaatgatctgtagccagtggcaagagtgtccattatggcatatgagggcttatgatgtgtaggaaagaaaaatatgaagaaagtctccttacttaggcaaggcacgcaagtgccctcaatgtccaaatgcatcttctagggctttttaatttctctggacaaacattagcatctccacagtccagttatactctaagtctcctgggtcctaccaaccacatgttcttcccagcctgctgggatcactgatctatgtggtaggcttgacttgggaaaattttacctgcagaaggctagagctgaattccaaggctataaagtatactcataaggtgaaatccagagtggcccttttcatttgaactatgtctagagaaatggtttggtatccagtatgctcattctgtcgtatctccacatctcagggtactttttttagagtgatgttatctcatgatgatattcaggtaatcttatttctaaggctgccacagtggctagaaaggaggttccaagtcctttcttcatttattctgtccctttccaggaaagacttaagattcctcattgaaccgcagcccccactgtggccaggccatccgactgactaggatgatgcaaaaatgatggcagtcatcattcagcttgactttacaagttccaaaacagaggatattctctcggagttgcatacctaatgagagtacagtttgagcatcccaaatctaaaaatccaaaatccaaaatgctccaaatctgaaactttttgagcactgacatgacactcaggagaaataagtgttcactggagcattttcagattttggatttttgaattcgagatgctcaactggtaagtttaatgcaaatattccaaaattcaaaaatattcaaagtctgaaacatttctggtcccaactattctggataatggctactcagcctatattccaaaatagggaccaagaagtcaaagacctttgccctaccactgattctccacatttagtgatgacaacagtacaaccacagctgacagtgtaccttcaaaacagcacatgcaaaagtccaaaggtgtgctttgaacgtggttcatttccttacgtgatgctcattgtgtaagcaacctttatatgtcagccatgatccccatgctgcttggacaggatttatgtcacattcaagttacaatgttagtttctaaactactcatttgtgggggcattgttgatgggagaagtgtccaaaaattgtattaatagattctctttacttttgttgtgagattcccatgccacccagtctttacacagaggttcagatcacacagttgtactctctcaaatgccaacttctttgtaggactcggctaggcaaggttgattgcttttctgtctgatcaaaggtgcacatttaactcacctacctaatctagaagttaaaataaaagcaaactatgtatcttgctcatttttagtgtataaaatatggatgtctgaatggtgccatgcatttcaagctctgtgtatttttttccctgttaaagccaatagaagttgcagagaagatccctgagaagaagcagcgcctggaggaggccacaactatctgcttgctccctccttgcatctcaccagccccaccccacaagcctcccaacactagagagtgagtttgccctggccctgtctgatggcttggtatgattgttcagactcctaagaaatcctaattgaacctgtttgggggatcttgccccagaagactttaaggtaaaaaacaggagtctctcagtcaaggcctgacagctgtccctggccactggtctaacaagggtgtgataaggggtagaacatatgctgccagaattggggtgactccatgagcttttagcaacatttctttactctaattcagatttatcactaaaattagtcaaaacgaacttttagcactcagtgaagggtaaaaggaagtaaataaattaacaagaagcatcaagagaacccctatcactttaaccagatcacctgcttctacccaacattcagttctgatggtgattactcagtttccctggaaaagcaactccttgatcttgacagaacgaggcagctgcttcctctttgatgtcattacttaacattcatatgaatcttgaggaccagtagctatgtccggaactccacagaagccaagggaatgaaaaaaaaaaaaaaaaaaagctgtcttttcctgacacagaactgtcccaggaggagggccactcccagacagctcatctctctggcctcctcaaacatgtcattccaaggagctggcacctgttcttccttctctctgtgtgtggaaggttccagagtccagcaggaggcctcctggcacctcctcactcaaacagcttgagtcttcttcagagaagtcctgccttctgtttctgccaagcattgtgaccaagttatttctgtcttataaatatcacttaactaacaatcatgtcagcaacttgaaccattctgtctgagtaattattgccataaattcattcaacattagagattacttccatcaaagccagttttggagcctattagcagcccagagcagagaggcaatctggctaactgcagctaacaattgatttcacagattacagtttaacatcagggatatggcatcaatctgctacagataagatgtcggaaataagttatcagcttacatttgtctggatctttgttgttttgagatgaaaggaaagaaaagatcaattaccactagatctggtttaactaataaggagatttgggtcctgggctgccccctgcccccaggatcagtagttattggtgaggttcatcagtattctctgatataagtttgctctgaaacatcccttcacatacatacttgaagttctcagaactagagacccttccagtggagcaagctgaccccttcacctcagggtagaccaggcatgtgaggaagcatgctcccctgatggtaagacgtggtcattccagagccctccttcgttgtttgcaaggaggaaggactaaaatggcatagctgtggtggcattgttccctcagtttccaggcttggaccagtttgggccatccagccttgccacagcctttggtccccactgctacactctctaggtgacccagtggcctgtcgccttccccatcttataaaagagagatgaccaagtattacataaaggcctagtcatttgagttggttcttaccaaatgtcacactcagggttggggtccacccccagctgaggtctgaggggagtgtgtggatgtggagcagggagcttggagaacactcaagagacagcaggtaaatgacacatagctttatttagcagctccttcactgggtgagtgttacatttatacattacacaaacaatagtggctgagagccaggtggtgagcttctctgtgttacgtcttcatggctatgattatataagacatgggactgtgcacttgtgccccaatccactgagtcatctaggctgtttacctcagcctatgcctgctgccctatgcctgcttggctgcagcacagccatgttccttacaccaaatggtgtctttaatccactatctttacaatgtctctgcttttctagtaggtgggaaagcagtgtttcccttgtagcctttatcgttcagaaagagcctcaattagtttcttacgcccatcaaacagatgagttttctctggaaaactttctggagttgaagaagaatgaagcaatgactgacctcttaggggtctcctcctgggaatcccctcctcaagctttgcacctttgtgccttattaacctttcaaacaaaatgggagacaacattcacttttctaaatgactattctaaacctaacaaagattccacaccagactatgacagctatagttccccatagttcaacagaaggactctcctggacctccccttcttctttagagctggtaccttcagcaggccctctgaggaattgagtgcaggtggtgatgctcttcttttgtctcctgttctactctggcctattggaagaggtacccaaagacgcaaaagctgcttttctagttgtaagtcataacaatgactgagtggtctctagaaaatgctccctaggtgtctttcaccaagaaagtccttaaagaccccgtggttccagatcatgaccaggcagatgtaaagggggccaggtcacgggtgctcactgtacagaatgcactgaatccccgctggttgctttagtggcagacaggcaggcattgcatgactgtagttgccaatggcaaattaactgcctctcagaagcagctctttcccttgaagcccccagtttctcctcaggcagctcaagtagtgggggagtatttacagctaatgaaccaccattcacctcctgtagatgccacagcaatgcttgacatccacacgtataaattcccaaaggcctggtgcctttgtaattattacacttaatgtgatctgcttgttgtggagcttcctcatggacaagaatcttaatccatatgttcaccatcattttaatcaggcatcactactattttaaaatggttatacatgtcaaagcaatttttcaaatccattggaaagtatttttaattaattttaatcaattgaggtaatgacagaaacagttgcgttttttcagtttcgctacacaacaaaaagtaacatagggccacatttatgaaacaaaagatggagaagatgacacatattacaattggcaattttgtgcaacacagtggaagtgggccaaggagtctgcattgacttctatttcagggaatcagaccacttgaatgcttgttcatctttgatttgttgctttgagatattgtaaatctatatttctagacactgactgaaattgaccaagaggaaaacataaattcttgttgacttaatttgccattgaaaattgtagtcaataatcatgaaaagtaaatagctgcacagtgcaatattagttgtctaagcaaagattaaaattcaagtaatcttccttgattagtctaagacagtaactaaaatgaaaatccatgacccaattaccatgttaagcagctagcataaggtttcagttgttctgtttcatttgaagtctcagactatttggtggtgcccatttaatgggcagataaatcagtttgaaagcacgggagtacttttaaaattgcagatgtctagtgtgaatatgacaaaataacatttttaaatggagttttgtaaagtggagtacatcagtacttcagtataacaatttaaggtcagaggctcattatgcttggcgttggagtagaacattctgtatatacaatttgcaatgtatgtcgcaatactatttagtgcattatttatttctaagtaatgcgtaagcataatatttcttaagaaagtattcttccactgattctttattgtgccatttattgcatgattgtgcagttaagtcctagggcaaaataagtaggaaccatcctgaaaaatgatgggattaaagtcctcattgtattttccataaaaatctaattaacagcaatcttgaaaagttgaaaatatcctactgtagcacactccattaggcatttacatttgtcatggagttctgctgcaaagacatgagtttattcttggatacatatgtatgcatatatctatatttatatagagagatatctatatctataaagatatctatatctatgtctatatgcatttttagatatgctcttcaccataggtagagggacagcaattaaaatatgacttcagcttacagtactagcatcatggggaaaatcagaataaagagagagaagactttatgacaccctacacttcttgtttttcacagaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgtaagcatcttggaagaaatattattattgtcaggtagaaacaagttaaccagctcatctaacttgatcatttggggatgttgcaggaggaagggaggaagatgcagagaagaaatatgagaggcctgtgtatacaaatacacaaactttccattatttctttttgtatagtgcctagtatattgtcacaaatcattagggattataaatgatacagatgttattatgacaatgataatgcttaaaagaatctgcaaagtcatttccacaagggctaaaatctactggggaaacatgataaatatattaatatttgctcctagaaatatatcatccttcttagggaaatcactaggcttctctgatagcagtgagcaaccagtgcctcttcttgggccattctttctattaatgatttgaaatctaggagactttgtggcataatttttgccttagcctgtgattaagacacttaactcttgtatagtgctagcactgcaacaaatttgctcgataactctgggccaatcatgaaacatctctgagataataaaatgaggggatttgactagatgatctataaagcttcttctagctccaaaaacgtttgcaattttgtgctcgcagagtcttctctattccatttaggcatgaagtcctgtttattgactcaacaggtgagtgagtgtggagagatgacatttttatgtaacttacatgatcatggctgaattcagccatttccagtcagatgtgccaggactgacataaatgccgtgggtggtggatgtaatgtttcagggttcttgccacatatcttggccatagagacaaatgacactgtcttgggctggcctaactgtttggtctaggccaatcgggctgtggcagtggagacacgaagctggcttacaagttttttacggctctgtttcctttaaaatgtttgggttgaaaaaaaatctttattttcttcgtatccatcataacaatttgtagatgatgcgtaggttctcagcacatttatatcagtgagatctaggtggtaataattattttgtattcagaaggtccaggatgaagtgtaaaagatccacagaaatataagaaatacatttcacatttggcttttatctttaaagtgaccctgttgactatggcaagtgtctgtgcatatgtgcatgcatgcactcagcaaacactgagggcactgggctgtggggtggagggacagtatcgtaaatcagagatggctccagtgctcaaagaactctcagtctaaagtgagcaatgagacatatgctcaaaggactagaatataaaatagctggtgattggtgtcttagggcagggatagagacaggtctctgaatggtccaaggaggattaaagtacttctggctgtaggcataaggtagttttcctggtggaggaggcgtttcctgagttgatccttaatagatgagtagggtttaaaaatgaagggaagtggatgaagaaaatgtggtctatccacacaatggaaaaggaaggaaatcctgtcatattatgcaacatggatgaacctttaagacattatgctaagtgaaataagccagacaccaaaggccaaaaccatgtgattccgttgacatgaggtccctggagtagttaaattcatagagacagacagtagaatgggggttgcaagcgcctaaggcaaagggtaaatggggagacactgtttaatgggtacagagtttccgttttgcaagatgaaaagagttctggggattcacaacaatgtgaatgtacttaacatgactgaactgtacacttaagaatggttaagatggtacattttattatatgtgtgttttaccacaattatgaaaatttcaaaatgcaataaaaataataagttgaataaattatcaccaggtggtaaaaaaagaaacaaatgaatggaaggctttttgaaatctaaaacttcacatgtatcatcaaatcaggaaagtgaaaaaagcggggacatgttcagttcagttgaaactaaggttcatggaagggaacagtcagagattgggcagaaagctgcagccaaatcaggtagggccttgagtgccagcaaaggagcttcagccttgagtttgcatttgagtgcagagcagggagatgctaggaactttgttcaggaagctcaagctagcagacagcagattgagggtggagggagaagctagctcaagggctgggagtccagccaggagactctttgttagtctcagtgagaagccatgagggcctgcattttgaggctttgagggagaaagggacaaattcgagagatgttggggagatacaattaataggagtaattaactgcaattaactggtaatgttgagggagaaaaattaaagatgaaatagaggaattgttttcaagaagagttctaggagcattatcatttttcaaaatgaagtaatttacagaacttcaatatataaagctgattaaagcagagcagctcagatggaaggaaaggtggggagtctctaccttgccagtttcagtgccactagcccagatactactgcagttccctgtgtaactgtgccaaagtcagtttggaaactctttattgacacggagaaattcagctttgatgacagggaagaccatcctgccattaacagaaagacgaaactggtttgattagtgatttggtttgccaaaaatttgaggcgctaatggccatgttggtagaattgtcctaagatggtcactgtaggctggagctttggagattgggtaagattgaggtttccatttgggtgttacctacctactgttgaatctgtgccaacaacacacaagattgacagatcatatcaagaaagaagagaactgcggagtgaactttggggaacaccaatgttagagagataccaattcagaagagcagaaggaagaggaggcaccatgggaagtatggtcagacagagaacagtcaggagagtcccacagttgctgggggcgggagggcagagtcagccacttgaacatggcaggtagtcttgtgatgccacactgtcacataattacagatcttaccacctcctttctccatcctctctatagcaatgacagttcaaagcaaagcccttgtaagtatcttacccatttgattttggacctggtagaaatgaggcttcaccatcctaagattgcaaaacaaaatggagacacactcacatttcacttagctagaaaccaatcaagcgcctcacatgaacaaaagggcggcttcaacctcacttcagccagggcagggatgattagagtacaatttcctagtattttgctggactgtatctggtattttgcagagtgacctgaggacgttacttaccctagagaaagcttctgggttggttcccttatcaaaaatacccacagcggggtcaagggatttatttaatatctctatctctccctctctttgtccatgcatctcttcctttctccctccctcctcctctctcctctctatattcttccttccctttcccctcacatttatcactagatttagacctttgctgtggctgtcttaatgggatggtggagctatgtaatggcagcacccaattagcttgatgtttggtgtcataatagaacaaaagctggtgattcatggcgttcataaaatatccagggtcacctatttatcctcaagctgtgtgcattgttttctttctttttttttttttttgccttctttcgtaacgtgcttgacattcaaagcatttatgacaaggtgttttaaaaagctggacctaatggaaactatttgtcctcctttttcccaggagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcgtatgttgttccagattatcatggacagtttggagtagtgaatggggggtgggggtagcatggcttttctagtgctgtgcatgtgtcaccccaaataagacctcagcatcaaatcctatacccttaaaagtccaccccaccccctgcatacacactcaccactctgtccccaccaagaaatgtttttggcccattttaattaagcagcattgttactgttccaaaggcaggttgttctgtcctttcctatccatgtcctcacatataaccaacacacagatgtatagctaggttttgtttgatctatttggacaactgtaatggttggggttggagcatgtggttatttatcctaatgggccattatgtacttcagatttcatttacagtattatttcaaggttggttatgatatgaatgacagcattagtctgcctttttcaaggcattatatgggaataaatttatagcagaaaaggtttgatgattcagtcttttactgaaaagatgaagcattggtttctgaaagagcttgttttgtttatttagggttcacaatgctgattattacatgcaagaagctaagaagctgaagcacaaagctgatgcactggtaagtttcctttttctcattgctttgttcctattaaggatttatgtttcaaaggaaaacaaagaaagcacttttccaaacaaattttcagtatcacagcccacacctgcctgtcaacacattgctgccctgacatagggagatttgaactagtgaattacttagttctgtaattcccaaagttctcagggcttggttatcatgtcatttgttttcccactgttcttccccttaccccaacttcagaagctcaatggcatataccactgtcattacctttcaagtgattttggaatgacttatgaaacttccctggaaatgatgtgcttttttggtccagtaagccagaactcgtgtgggaatgtgagagttgtttagagctgtctaaatggcctcaaaaattggctttgggaaaactaggcctgaggaaaaactcagctccttgctgcatttgatgacatgttttcagagtgagccccacagttaggctggggccccaagcagagaagagaaatgctgtcatctggatttctcaagatactttgcccagctgcctccaagggttttagccacctagatcagtcataagctcaacattttgagttgtttgatttggctgaggctcctaacagtgggtctcaaccacacatcacattgaaagctttagaataactctgatgcctagcccatatcccagaccaatgaaataagaatttctgggactgggacccaggaatgagtattaaagctccccaggagattcccaattgcagatatttgagaacgactgtcctagggaaggccctaaattcaggcttctcactttgactaaaccccattgggttaaaaaatagcatcctcaaacattgcattgtgtcctgctaggacttagttgtcccagtggtgtttgatactgggaatgctgtgatgaaataccatgactagtgtgtagccaacatcaactgtccatggtccttacatctgccttttccctactttctgtcatttccccactgtggtacaaattgcttcgtgtctgcaggtgacctttctgtggtgtaaattgttccttagaagcaattttcccctgctcctgcagacaaaaatgacaaggcaggctgggtgctagctccattggagatgccaggacaacagtgcctgtgaccattgtataggtgatgagagatttgaaaggcactggatggtaatgctgctccctcaaagaccaaaggttttctctaaatgtcctcaattctgtgacactacagagcactcaagtgctcctagggtttgccatctgtcaaagcaggggttagggagcatacacatgttccattgacaagctgttacatgagctgatgaagactgggatatacataggagaccatgtaaatgaaatgtttgaagaactgagaaaaatcggtaccacagacatatatacatatgattatgaactaacatcactctacattccaaggttgtgtttatatgtatgtctttcaagggatcacatttggcctaatccatttagaatatgcattcccaattggggagatgctgcccctatgggggtaaaaattggttttggagatggggtgaaaagatcttagttattgcaatggggtgtgaccctccaaagggccacagggcataaagagagaataagtatatttcttgtattaaaatttcattgggggtacgtgaaaaaatacagtgatccctccgtatccatagaagattggttccaggaccccctcggacaccaaaatcctcagatgctcaagtctctgatataaaatggccatttgcatataacctgttcacatcctctaatatacattaaatcatctctagatcacttataatatctaatacaatgcaatggtatgttaagagttgttatactgaattgtttagggaatgatgacaagaaaaagtctgtatatgttcagtgcgaatggaaccattcatttttttctgaatatttttgatttaagattggttaaatccatggatgcagaacccacggatacagagggctgactgtatcttaaaaattccttggtggtggtgggggggtgatatggaaaaacaaggttgaggaacacttagaggaatgatatttttgctaggcttatgcatatattagcctgggaagcacccttatagtttaagccactcattttatggatggggaaacagtcccaggggtggggggcataacttggctattaattggcactatagtcatgtaattttctgtctggacatcagctactcctagggacgaaggggtttaggctaggtgatctctacagatctctccagctattgggttgtgaatgaaaagtcactttcagaaatcaggatctaagaacaatttccaaatgggagagccagtggagccagatgacctaaggaaattgtcctgtaaggcaaaagagaaagtacctagtttgcatatatgtacacaggttttcacaaaatccgcttgaatttgattgaaaccgatatttctccacagtagcttacagaaagaaaaccacagaattcctgcagctcataaaagctggagaacatttattgtaaaaagtcatttacaataaaagattctgcaggacctctagctaatcattttatagttgtacttaatcctttgctagagacagctactctgccattttgagaattgaaactttcacagttgcatagaaaatattttgataaaaggtatacaagaaaattaaaacagctaaatctgcattatattccttcttttacataaaataccatattagtggaattcttacatcctgctatcaaaaattgaaaatgttaaatcctgttataaaatactcactataaaagtgtcatgtataatattcattacacataaaaaagaaatcagtatgtctaagtcagtttaatcatgaccattatcagggctaaaacctttgcaataaaattttaccaaactaaaatatttagtagtactatattttttggctttttgacacactatttcaaactatcatttataatgaaagtgatgggattattgtcaacagtcatactacagcttctcatctttcatgacaatagcatcaatttgttaatcttctcctgagagtgaaattgatgtcctcacaaagagttctaaagcaaaaatgtatgtgttcattgtccatgagacttctaaaaagcagcccttagttgcaagtactgtctataggacactacaatgagcagatagtttagtaaatttcatgaatagaaactagttgaggcaatgatttggattcaggtccaccaaaaagatagcaataacagcaacaacaatgccacaaaccacatatgataccctgcctgcatttttctcttctcaactagccttggtgtcatgatgatagaaccttaagccggtaacttcattgtttttttttttttttttttgaaaatagccaatcaagtttatttataggtggttaactggaatatatattaagaatagttgggcattgaaaagtatacataggcagataggtggcatatagttggctaagtgttgctaataagtttgaaaaaacagttgcagacatgtcactgtccttttgtctaagtgaggcgatacgggctttatgcccaaaggaaaataggaaattaaacttttttttcatgagactaggtatcagaaaggccaatcaatatctttcaggtcaatggtcttctctgggatttgagaaattgactggtcctctatgtcatccagatttatcagacaatttctcccctatcttgcttattaatttggtggaaactgagacatgctttgttgtttcttgcctctggaggggacagacccttaggtagaaaggaactgtaaagtgcctccatcaccttcccgcctctcatttctccctgcctatattaatgaaagaaaattgaaggcagggtcccaaggcatgtcaagaagaattgcagattaagtaatgttgttgtgttattttaattagacaggctttttcaatcctagaaaatatttttttttctatttcttttttttttttttttttttttaatgttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttgtcaggtttgtcaaagatcagatagttgtagatatgcggcattatttctgagggctctgttctgttccattgatctatatctctgttttggtaccagtaccatgctgtttgttaagaccaattcatacattgtcttctgtatcagggtttcttagcctgggcactgctgacattttgggccagctcattctctattgtgggagctattttgggcactgcagaagtttataagcatttctggcctctgttcaccagatgccccctctccccaggggtgacaactgaaagtgtctccagacattgccaaatgttccctgtgggaagggggcaaaactaccccccagtttcaaaccactcttttatatgaaggagaaaacagagagtattatcttgacgagtcatcttcctgtttcagttcgagaaatttggcaaagctgtgaattatgctgatgccgccctctccttcactgaatgtggcaatgccatggaacgcgaccctctggaagcaaagtccccatacaccatgtactctgagactgtggagctcctcaggtgaatagcctttctgcaatcatcttcctacactcatttcagctagaattagaagctatgttttaaaaaatgtatcatttccacttattaataatttgtccaagccatcctcttagaagtcatcataattagttcttgccattttattaatatcatggaaaatttataattgatggatgctgactttataaattatcccctccagaagttataatgtgagtgttataattttcaatattcgtaacattaaaatggaaatgtagtgggtagaaataagtataatcattttaccgtttagcattgacttgtcttttcaaaggtgcagttttataattcaaaaaaatggtgctctcaggatttctattacaaaccatgttttctaagaatttttatcttggttattaaaaagggaggggcactgttccaactcagagttggtgtttaaggctgcaggtgtggagtagactttccatgcatctggaattagggaaatagatgaggtggtagtaggggctggcggtacagatgagaggatgagaataagagaggggatattaactgcacacattattggtttcatttacattttaaatgaaattttctggctgttggtcttggtggtgtagaaattctgtgttatcaaaaaattcatagaagaagaggaagaagaggtagaagaagaaataatccattctggtgttatccagtgatttgcagatatttgtacaataatttaatccacccctgaatagtggataagcaccatcgttcactagatggactaaataatcacttttgattgattgagtaagcagttttttacctgaaaagtccttatgtccagtcccatctggcttgattaatcaataatgccaggactggtttatactatctatcttgcttgtacctgcattaactgttacaaatctgaggatatttgtacctaaatcttcagacaaacactggacagatttagtgtgcatattttcccagtgacacattccaaaagataaaaagaactatttttttaaagcaactctgctcacatagaatcagaagtttagttagagccacaaaagtagggtgattataagggcagctctagccttgcctgctgagccaatcagccatctttctctttgcactgctctgaaatgtaggcactgagaaaagtgtcaagtatttctccttgacttattttatatactgtgaaaagcaccaccaccattctgtagctttcaaggagaaattgattgcccagtgtctagtcaaactacctgtgattttcaaagatacacaagatgaacatactggcaaaaatcataaggattcaaaactgaagggaaacattagtgaacaaacacagggacaattcatgctctctattcattcaaaaatgcaaattaaaacaaggcactttttaaattaacaagaaaacgtaacaatgataatatctagcactaaaaactacagcaaaaaaaggcctagcagtgaaccagacctctcctatgcagctgatgggaatggaaattgattattgtaaattgagggcaatttggcattgtgtagggaaagccatacaaatgagtattcatatcttttgatccagtactttaactgtggaaatctgagttttctctcctgaagaaaacaattgtaaagactagaacaagtaatcggtatgatgttcaatttgacattatatgtaatagcacacaattggaagcacaccaaataataatagaacagtaattacatagtaggacactcaacagaatactttgcagcgattgaaatacaacaatgacagagactatgcagccgcacaaaatatatttattatatgatgttaaaataaaatcgagctgcagaataacatgcacactacaattatgatcatgaaaagtttgtatatgcatctgaaccaaactggaagggaaatgaaatcatagctgtaataagtcagtgagattatgggtgatttccctctctgcatattcttctttcttattttcttttaagaagacacatgctgtcttaaaaatatgaaagtaaggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaatatgaaagtaaaatacaaatttcattttatggtaaaagtgcaacgtgaatcattaagtaattttcttttaattattcacgaaaaagttatttagggaaaaaaacatgatttatgttttattatatgctattttacttcccatagaagtttatttcaatgaaatctgaaagtcaatggagaatttacgagcattcactttaaagtcagtgtttttaaactttattttgaggtaattgtagttgcacatgcagttgtaagaactaatacagagagttcctgtgtattcttcacccagtctcccccaatgggaacatcttgcttaactatattacagtatcacagcctgaacattgacattgaaacactccgaagacttcattcagatttcaccagttttgttttgtttccaacttcaccatttttgcatgtacccatttatgtcttctctatgttttactttttttatactttctgtaaattacatgtgtgtataatatttttttaatgagaggaatttcagttgggaataaaatgagttaaagcaactaggtcttctggtccacttaagcaattgaaactccactatcaagtcacttcaaatgtggttgcaattagagggtgagtgtaatgtgaacatagtttttagtagtgcaatatcatgttgaagaaatttttattactctctccccgacagtatgctggctacagagagagagccccattttcttcattcaagtaattatagttgctctgagctctgggaatctgcaatagaaatgtatttgtgaaaacaagtggggcatcacaatgacttgacatttcagtgatccaactgtcaaagaaagctagatttattacataataaaaattcctttgcttaatattgcaacaaaggaagggacccacgttaaatgtacaagtgcctttcctggaaaatgttcactcaacagaactagagcaataaccaggagagcaaggcggctagaatgctgaggaggccgagtctcagggggtgagcctgggctccccagtgttctgcgggggaaggttgctgaaagcgaggagtcaggcatgccagctcagtggccctgcaggctttctgtcgccttcttataaatgagaactttcaacttccttctgccacactgaactccattacttattctactacaagtacctgtgaaattgcattaaagctcagacaatgattttatgcaatgaattgattttcaagagtctaaatgctctgaatggaatgtacttggctagaagaaaaaaaaatgggaactactcaaccttttatcaccccagtgcagaacagtaacaattaaggagaatagaaagacaaaatatacaagcatcataaattaagggtgcttagaccttaaaatgctgtgaaatcgaccttcctttaaaaaaaaaaaccaaaccactttcaataggaatatattcaaaacctgagccattagaaaagaccttttagctgtgtgattgaggtctccctatgctcatgtcagacatagttatatattatttacctaatctgtcataaactgaactgaaactgacattcttgtccacctctcattgaaaaccagtcatagtatttagctacagtgttcctagaaacagtattttaccagcatttagacacacacacacacacacacacacacacacacacacacacacactcacggtaattccacagcattgtcctaaggctcatgatttcactgctttctccagagttcaactctgtatttcacatgagtcctcttatgacatttttatcctcattttgtgtatgttttcggggaagcatgcttttgcccacatgtaccagtcagtcctcttgcccagaacaaatgtgggaataactcattcaggcaatcagaataccagtgactttaggcatttctgaagggtaatacagattccactttagcttttcttttctcttcaaaggtatgcaatgaggctgaagaactttgcaagtcccttggcttcggatggggacaaaaagctagcagtactatggtgagtcccatggaggccacaaggaaattgctgaaatgtcatggaaggatttgaaaactctagatcaacttaagctgcttaccccagatcattactcttgttttccattaaactattaaaggataactaatggatttcttcagtcactgactaaacatttactctcctaacttatacccttatcaaaatgggattttaatgcttgccccttccctctttagaatttctttatttacttatgtttctcaatctaaccataggaaagtaactgcaaattgtgaatcagcagtcttcttaacagtttataaagtttcactaagcactggcattaacagaagcctttcctcatcaccacagctaccgatgtttatcactcctctatttgagaatgtttaagctgaagaaggaccatgctatgaagtactccagatcactgatggaatattttaaggtaatgcttattttgtataatttataggtacaggatgataaaatcactaataagacacgacatgcaggttatcgaatgtcaaatgctgccaaaggcttaacctctctcctccctgctggccatggccgtcctacccttccttaagggctcagcaaggagtttatggctgatttggttccagggagagaaggcacgatggtgcaatctgctgacttttttccagactcaccaaatgacccttggcagtctcctggttgcagtgaggagtatgtcacctttttgctgctctgtgaggtgggcacagcttgtggctataggtttggccagtcttttgttaaatgataggtcagcccaggaatctctcagaagtgagagaagtcactgtggccaccctggctctatgtgcacgtccacaaccctggaaggcctttgtccatggggagtcttggagtgcagtagttgtaattaaaaacaactgattgctttggttaccaaaacaaacaaacaaagccatatcgtagggagctggggcttttaacttataagcacaaaaaatataggcaatctcaaaatgcaacgccaaaatttgagaatgagcccaggtaaaaattgcaaacagcaacttcatactaggcctgatcactgtactctccaacaacagtcatgatttagagttggggagactcaagctccttctgttgggcaggtctaaaaagaaaaggacatgattttttttctttcttgccaagtgcgtgagacctcttggctaaatcataccaaagtagttgtttgaaatgagcgaaattatggccttatgtgaaacatgcagtgagtggaagtgcacagctttatgacgacactgtggcacagttgggaaaaagagcatgtttcccagctattatgtggtgtggccataatgccataaggctagtattgatgtgggtaaaagggagtcatatacaacaggccctcttctcttcatatgcctacactcttaacttctgctttagaaagttctttattgaacttcagtgggcatcagaatcccccagagggcttgtgaaacaagaatgccttgccccagctcccagatacctgattctgtaggtctgaggtatggcccaagaatttgtattgctaataagttccctggtgatgcttctgctgctgttcttgtgatcacactttgagacccactgatgtaatatttgccctctttggcctaccctctatagtttacagggtattgtaaaattccaaacaaatactaaataattcattcatccaggagtatgttgagccttcttgagattaaaaactggagtctgcagaatgcaccttaggtgtgggtctacaaagctccagagaagtattccgttctcactggactcccgaaaatgctgactctttccctgaccctcctttcgcaaagggggctgggctagcagcaaagaggcagaagatgagcatcactggggatgtaacttccgagagcaggtctgagtcaggcacagtgccatgagtgtgagttgtggccatctgtgctgcttgaccttccacctggctaggccattacaatgagcctgatccctgtcctgtagtggtaatgctgaatgtcagttttccctctgatccacaagtgtgtggtcttgaaaatacaaggaagcccatcctttaaaccagcccacttccatcagaggaacaaaggcatatttagtatttgattgcaatgcagccctggaccagtcactttgttaaatagggaagctctttagccatgagggtttgcatgtaaatagagcaaatcaaggtgattcctgaaaacaaacaaacaaacgaaaatactgcttggctctgacacattcttggattattagaaatgacagctcactctgcatcccagggaaaaagtttgcaactggagctaaaggtgaaaagcttacttgcactctgaagagcttgtttggcagaataaatttcagatgaggataattaaaccacttcttggagaaccgagtctgatttcactgggccttttagtatataagatctttcatcaagtgactttcatggtcctgattggagcccactaattatcctaaccagctattttcatcgagtgtgcgtcgtggtgtgctgacgtgcacatacatcccagctctgcatcccgaaatgctgcaatcaatattaatgtactctaaatcacacttccatctgtttctgaattaataaaacacaaaatagatgtccttatttccctttctcttctctctctcttttagcaaaatgcttcaaaagtcgcacagataccctctccatgggtaagcaatggaaagtaagtattttctgaaaattgctttttcgtgaagatgagtgattcaatagaccccagatattttgcattgacaagtcaggagtgaaggtcaattctagaactacagtcatttttgtgcatacaaaattccagccaggcttcggctaatggcaagacagaaaagtttaaaaagatgtgcttcagagttatttaactatttgatctttaagccaaattatagccataaaaatatctgctaataagatggcaagcaccatgccattttagggaggcaggacaaagttaactccactgcagtgatttttcaatgattcactcaataatgaaagaccaatgaaatattcattgatatatggtaagtgctgtttaataaaaccaaaggcataatagtgctgaaaatgtgaaggcacttgctcagccaattatccaagccttcatgataatttttatattaatactaaaatgccctagcctaagatagaaaagcatccactataatgctgattggaggctcagggaactcacctgcgcctgaggccttatttagagttctatctgcttgggacagctcagtcttaatagcagtggagtaggggcccaaaaaccgttgacctggtgctgaagctgcccttggcttacagggtaagctaagagggccccttcctctatctgggcttgttctttatcgctaaaatgaaggggttggacccaatgccctcgaagtcccactgaagagatgtctcttatagagagtgagttcgaatcccagttctgtgtcagctgtgaagttagctaacttgcctgagcatcagtttctcctctgatttccaaataccccttaccagcccaagcccacacccctcagtgatgggaagggaaactagatgactgtggacatagaccgctttataactccaagctgctttttcagtttttcatcatttcaaaattcctgcatctctgatcaaaataatttcttcaagaataaaacagtctctactgccactttataaatatctagaaaacgtactccaaaagcaacgggacaatgaactctactttgaaatcataaaaacattcagtgcgagggaacagatccattgaaaactacacattaactcaattacttcactgaaaggaagcactgtttaaaatgttgaattaggtcttactcttatattgacgaacaaaagagaaagagtgcttctctcttaagagaaaaaataagttcagaaaataaaaataaccggagaaaggcccagctctgttttccctgagcacagagtaaagtaagggcaagggcaggtaagcagctattaaagaatcactggggaaaaaagcgtttttttaaaaaaaattctgaaacgcaagaactcaaacacaacctaagcttgggaagttgcatgaaaagcctcctgaaatgattcttaagcagattttgcatgaagaaagcacattccctttggtaggccacagagcttttgactgaggcaactcaaaacagtcactcaggggttatgtctcgttcattcagcaaatgctttgcgtgcatctgcagcacgatgggctggggacagaaagctgaatttgatatggtccctgcactccagaagcacacagtccagtggaaggaggtgacaggtatgaacaaggtgctgtggaagcctaggagaaggagcttgggcctccctgcgtgaccaggaagggcttcttgtctgcaagcaagattatggccttgtttctctgtgaatgagggtggtgtcccccaaggagggctctcacagcaccttccaggagcagcaccctctgacttcaaaccctcctaggctggctagcaattggggaagtcagctgcccagaggtggttaagggctctgcaggaaattatatggagagatgagcagagggttaagaacagacattcaggaactgcttccatggaagctggagaaagaaagtgcaaagaagcaattggaaggagaagcagaaaaatctgctgagtttacagcaggggccaggaaactttttatttaaagcaccagacactatatattttgggctttgtgctaagaggtgaaaccaaggctactatgtagaaaaatatgagagaaaacaaattttcacaaaatttttactgataagattcaaaatataataacaattacatataatttttgaaatacaagtctattggtgagaagaatgtaaatctttttcataacattttgcttaattggggttcaaagttagtgttccctctcaacaaatcgattgcaaatgttcatctttcgcaaactattcagagcttacagcccatacagaaacacaagatgggccagatttgctgactcttgacacagggttctggaatccacattgtggagagtttaaaaaggctgagcaacaatttcgaatgtcacagagagataataaaaagaaagaagctgggcaaacatggatggcaggactttgaggtgacatggtggaatggaaagagaatgaagagaatgggctttggaggaaaatggacctgctattagatcctggctttttggctctctgggctctgtggccctcaggacggagctgaacttctctgaggccagaaacagtggcagcagaactttccctgcagagttatggtgaggcttggacagaatattggtgaagccctgaactatgcttggcacatagagactgtgcaacaaatgatggctgctgcagctactgttgccatgattactgttgtaattgttacctatttaagttagaaaagataatgatcctacctctagaattcccacagcacttggttagcaccacagttttggcacttactccagattgccagaaaagaatgtaatttgctcctctagtatactctttgctcttttgcaataagtagccatccatcctatcattccccaaatatttattgagtgcctaccttgtgtgagacactctgccaggccttttgtagacatatcccctatcctcatgctatatatgctcttctccttctaccttccagagcgctttatatgtagtagatactaaacaaagaatagaagcaagtcattcatttattcagctggtgttcattgagaacatatacgccagacactgttctagatactgaagtatggcacagagtgaaatagacaaaaaaaaaaaaaaactgccctcatcaaggtcacattctgttgaaggagaaagataacaacaaacatgtggcatactaggttgtgggaagtgtcatggagaaaactgaaacaaggaaggcaggcagaaagggctgctgaggataggggagggagcagtggtaccatgctgaatcttgagtagggattttagagaaggatgatggtagagaaagccatggcaatgctggaggagtttcttccaagcatagggatggcagctgcctctgaagcaggagggagcatgcctgacaagttcaaggaacagcatggcagagtgtggcttagaggtgagaggatggtgggttggaccagggtggtagtggcggaagtggtgggaagcatgtgcttctgtgtgcatgctcatttgcatgtgccatggaaatgtggaaaaaagggtgagatctgcaagcagatacacacaaagaacaggaagggaaaccccacgcagtgatgagagctaagtcagagttggagagcacactgaagtgagtgggccctgcatcagccctctcttagccacagtcacaacttcttaggcaggttttcatttaatgagcacaaggtagtgtgcagacatgtgcatcagaatatgtcagaccttagagcctggtgtgagaacagtaacaattgaaaacagacacttatcctagctgttcttgcctccaccactgagtatttaaaataaataaattagagaatagtagggagaaaagtccccaataacacttcagtgtaataaagtaaaaagggcttttcaagatgtatgtggtaaagagagatgatttggtttctcctgtgactcctggacatgattggaaatcattgaatccaaccttttcttgcagtcaagaaaagtaaggccaagcaaggagaagggatatgctcaggggcacacagcaattttatggcagggccagggctagagtccacatctcctgggattccagcacctctttccctgcaccatgtggtctctctttcccttttgttttctttttttctgtcttttttttgggagatggagtctcactctgtcacccaggctggagtgcagtgtcttggctcactgcaacctctgccttctcagatcaagtgattctcctgcttcagcctcccaagtagctgggactacaggcgtgtgccaccatgcccagctaattttcgtatttttagtagagacggggtttcaccatgttggccaggctggttttcgaactcctgacctcaggtgatccgacccccttggcctcccaaagtactgggattacaggcatgagcccctgtgcctggccttttttttttttttttttttttttttttttttttatgatacagccttgctctgactcccaggctggagcacagttgtgcgatcatggctcactgcagcctcagtctcctgggctcaagcaatcctctcgcttcagcctcccgagtagctgcaactacaggcacacgtcacatgcctttctaacttctttcgacatttgtggcacatgacaactttgtcattttctctaagaattacagacgagaaagtctttctttcttgccataaattgacatttaagagttaatgactaacactggggaaaaagactaggaaatagcttttgcaacctaccacaacaaagaaacccagctttcactgcctttttgtcatttcactgtcttctgtgcctagaccccttagcttggacatctcctcatcccactcctaccttaagaataaatctttctatcaagaagtgacgaagtagctcagaaattataaacatagcagaaacactctcgaacccattcacaccagacaagcacagagcaagtgtgaggatgaacttgctccctcagaccagaccagaacataccagaaaatagatggtttgcagaaatggtccaactctgtcctatagctgtaggcacagcctgtgtgagtctcaagagcattgcagttgtaattgttcccagatctagtcagcagcatttcagcattttggtatgctacaattgctgtttccccaaatcatctgtatgtgctgcccgtcagggtgcacatctgttctgggagccacactggaaaactagagttgccaacaatagcaactggtaagggggtggggggtggggcagaagacagagttccttgattgtgtgataaggtgtgttcagaggaataatgaagagattctttcaaacatgcagactcatggagtcctaaagacatcttccctccatttcatttactcactcattatgttctgtcctgaaaaattgatgcgtttgcctgggcagatgttcatagtgtgactggaggaggagagagaaccagaggggcacacagaccttgctttagtgactgttcctgggcaagccttcaggttccttaggtagccagatctaaccctgggccctggaagaaaaacgacccccatgctgtatacagccagcaggtgactccttgttgcgaatattaaagaatataatgaaaatgtgtgtctaaacactggtactctctgaagtggaaaccctgaagacttctttttataaatcagcatgcaggtaaatagtcagcaattaacagcccatctctgtagcatgtcttaaagaatcctaaagagagagaatactacttttcccagcttcccaaatactgctccttggggggctgtaagaattgcactttgcttattgtggtaacagtatttggagcaaactgacattgtggtttccacaaaacactttgatgatagaccaatattggacatcaagtgttttctaactgctgatagccgttccagcagcaggtagagaaatcatcatagctctgagctgtttctttctctgaaacatcacaacacttgttatatgtattcaaaggaagagctatatttgtgggtagaattaatgccagagaaatatccacccagccctctctggtatttgaagacaaaagcagtggtgtgcatggagccctcggtggtggtcaaaggcagtggagactttggtgtttaatgttagaaaagaagaagagtgggcctcattctatagtgtggcactgtagctctgggtggcttggtcagatgaggcaggtatggggtggtaataatctctgtatccactagagcccctggaaaaagctattgtgttgacaaaagctattgcattgacaaaagctgtagctgtactgtgagaagagtcagtgggatgtcagaacaagctccactctgatggggcttcacatgtgtacgctatgctaaacttcactccagcaaatggcattctgatgagatcccagcgtgatggggaaggcctagaaccccactgtcactctttcctaccagcctaacaaggcttgtctctttccatttcccaggaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaaggtatgctcatctgttctacccatatagctcacagaccatgatggagttaacttcactttgaaggacttgagttgtacttggtggccttatatctttctgtctctctgatttccagaacttagataagggaagacagagttcgctcagggctgacacagtgacctattattcctgagagcataaaaaagccccggaattttgtcctcctttaaagcttaaactcatttgaactgtgatgtgttttgaatttcactcactgacaaagatcaacacagagaaacagaggcaaagacaaaaataatggtttacaattaattatgaccctgttggctcctgttattattgttattattatttttttgagaggtgaggttgaactaaggccttcaaccttcaatataattattagctccagttgagtacacgataacgcagcttgcatttggaagcaagggccaaagttcagctagtacttttcacacaccgatggctgggatgaagaatcagggtgctgttcatgatgacacttgaactttgctacaaaacaaatgcaaagaggaccctgctttaccagagtgaatccgtggtctttggtgactcatgcagacatctgtgaccttagctgtcattgaggatcacaacaaagcctcactaccctaatgaaggtgggaagtaaaattaaactgcacatttgtctcagccattcatttgacttggctgattctggcccagcagtcacagactgctccacaccagtcaaggtggggacaaatgtgggctacccattactactgtatcgctgagcatgtggggaaaccatctcattggaataggaaggatgcagattttgcaacccaatcatttaagtttgaatcctacctgggtcatgcattacctaggcaacctaggcaagttaattaaatctgtgagctgcttcctagcttctgtctctataatggacgtaatggtgatgatgatggtgaaacgtcccagatggatgatagagatgggttgaattaaataatgggtgtaaagcacctagtataaaattctgagttcaaggtagaaattctacaaagatttattatctttccttactccataatattatgtatctatataactcaaagattttgtggctcacaaagcacattccataatttgagacctcacccctcaacgcagctataaatttacactgactcctgggaatatctgcatgtattggttccacaggtttgtgcagcaatttctatgtgccaggaactgcactattgctttatcatttgttgtctcatttgcccttatttcatacatgaggaaactgaggctctatgagattaagaaactcacccatgttatcacagctcttgcttgttagaagcagaaatctagaagtgtctgattccagagtctcatttcttaatcaataggctacactgcccatctagagagcaagattaatgacaggtcctcagagacctttggtgagatcccaaaccagttatctgagcaatggataattattaaattgtctacttttctacacctctggaaactcagagacaactggcctatacaaccagactcatccaggggttctagaattgcaagtgaagatagacacatcttaagatttgcctagcatgtctgcctctgctatttctctcttattttgtattagtaactggagggcagttcaatatttatggatttcctttatcattgcatccattttcaaaatctgttaaaagtatttccttctaaattaactaacttcagaactttccaggagcaatgtgatggctgtgctgatgttagggtgaaatggtgttaatcttgtcattagcacagtgtgtcaaagagttgctaaattccctgtgtcatcttgaatgaaaacaactccgtcactctaccagcagagagaaaatgtgtcctgttaatgctgtcattggggttttcagcggactggggagaagactagtgtgaaatcttctgctcaaagcctggagtttcatactttgtcatttctgatctacttagctttggggattctattcacatctaccttgtctacatagaaaagagagaactgaagagcttcccttttggttgcagctctgcatctcactggagacaaccacgtatttgcacgttttttacccagtggagatgggtgaagttggttctcccagtgaaaggtctccactcctgcctcatactgcccacaatgcagctgcagatggcttattgtagaaggttctggtgctgaaatgagccaatggcacttatgctgccctctggcctttggtctagaagcttacctgcccagctgcttatactgctcatttggagcagttattaaaatggtgtctaattaagaatgccacagagagctttgtacagaatacccagggaacatcctggctcatatgaggctcacattcattcaacaatgactaggtccttaaatgttttccttaatactgtattacataggaaaatattttagatgccagaaataatttactcttttatcagcagaaattattttattgcatagtacaggttaaaaagtatcatataatcaaatgaggttgacacctagagaaggatcccatatgttatatataacatgaagagtaaatgcattgtttgatgaaattccatctgctgagcaatcaagcacatgtaacccatgcatggaaatcactttccaagaaggcaggagagcatcccacgttagggcagtctccagtcctatcccctcaccccaccccctgacacggattccttgctgccagccagcacatagctgaggctgcttcctttgccagagagctctctcataactaagtgccaggcaaatgaattcgtacatgaaaagggaacacctagctagtttttagagatcatatagtttttcccacatagtacttctatcgcctaaggcagacgttccaaaactccagtcgcgctagttagtagtgtagcctcagggctgcccccttccctaagtgaaccaaggggaaatcagctgggcattcttaccattaatgtcctaggtcaggggctggaaaagttgttaagtgacagatacttgcaggccattttccatccccaatgaaattggtaagaagacttacagaatcaaattcctcctagatgtttatttagctgtggaggctgacggctactattaatgtccagattcatgggccttgtctagaccatgccaagaaaactcagtaaactcggttcatttagacaaaaggaaaagaggatattttcaattcattaacacattgaatgacaaacagcttgacattagatagaccatggctccctacaattttgtgtagaaatacccttttctaaatataaatgtataatctatgaaaacataaatgtattatgtactgcagagtttttggagctcactaaagattaaaataatagggcttgataaacttgtggagttttggtctcctagtaggcactctataaatgtttgttgaatgaatgaatggacaaatgaatcacatttccattgtccatgtggttgtggtgttgtgtgaaagcagcttctcaatgtggtgcatattttcatgatatcatataaaggcctaactgagaactgctctgcttttcagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcc

SEQ ID NO: 5142 - DNA, 500054 bp, human; identical to SEQ ID NO: 5138

SEQ ID NO: 5143 - DNA, 500054 bp, human; identical to SEQ ID NO: 5138

SEQ ID NO: 5144 - DNA, 403378 bp, human; identical to SEQ ID NO: 5140

SEQ ID NO: 5145 - DNA, 493726 bp, human; identical to SEQ ID NO: 5141

SEQ ID NO: 5146 - DNA, 5669 bp, human; identical to SEQ ID NO: 3908

SEQ ID NO: 5147 - DNA, 1568 bp, human; identical to SEQ ID NO: 3909

SEQ ID NO: 5148 - DNA, 2802 bp, human; identical to SEQ ID NO: 3910

SEQ ID NO: 5149 - DNA, 5669 bp, human; identical to SEQ ID NO: 3908

SEQ ID NO: 5150 - DNA, 35352 bp, human; identical to SEQ ID NO: 3912

SEQ ID NO: 5151 - DNA, 35271 bp, human; identical to SEQ ID NO: 3914

SEQ ID NO: 5152 - DNA, 35186 bp, human; identical to SEQ ID NO: 3915

SEQ ID NO: 5153 - DNA, 5669 bp, human; identical to SEQ ID NO: 3908

SEQ ID NO: 5154 - DNA, 5669 bp, human; identical to SEQ ID NO: 3908

SEQ ID NO: 5155 - DNA, 35352 bp, human; identical to SEQ ID NO: 3912

SEQ ID NO: 5156 - DNA, 10813 bp, human; identical to SEQ ID NO: 3913

SEQ ID NO: 5157 - DNA, 35271 bp, human; identical to SEQ ID NO: 3914

SEQ ID NO: 5158 - DNA, 35186 bp, human; identical to SEQ ID NO: 3915

SEQ ID NO: 5159 - DNA, 11177 bp, human; identical to SEQ ID NO: 3922

SEQ ID NO: 5160 - DNA, 35352 bp, human; identical to SEQ ID NO: 3912

SEQ ID NO: 5161 - DNA, 26565 bp, human; identical to SEQ ID NO: 3924

SEQ ID NO: 5162 - DNA, 35271 bp, human; identical to SEQ ID NO: 3914

SEQ ID NO: 5163 - DNA, 22986 bp, human; identical to SEQ ID NO: 3926

SEQ ID NO: 5164 - DNA, 35186 bp, human; identical to SEQ ID NO: 3915

SEQ ID NO: 5165 - DNA, 28006 bp, human; identical to SEQ ID NO: 3928

SEQ ID NO: 5166 - DNA, 5668 bp, human; identical to SEQ ID NO: 3929

SEQ ID NO: 5167 - DNA, 2471 bp, human; identical to SEQ ID NO: 3931

SEQ ID NO: 5168 - DNA, 5668 bp, human; identical to SEQ ID NO: 3929

SEQ ID NO: 5169 - DNA, 2799 bp, human; identical to SEQ ID NO: 3930

SEQ ID NO: 5170 - DNA, 285969 bp, human; identical to SEQ ID NO: 3934

SEQ ID NO: 5171 - DNA, 285969 bp, human; identical to SEQ ID NO: 3934

SEQ ID NO: 5172 - DNA, 108678 bp, human; identical to SEQ ID NO: 3935

SEQ ID NO: 5173 - DNA, 149709 bp, human; identical to SEQ ID NO: 3936

SEQ ID NO: 5174 - DNA, 150667 bp, human; identical to SEQ ID NO: 3937

SEQ ID NO: 5175 - DNA, 150897 bp, human; identical to SEQ ID NO: 3938

SEQ ID NO: 5176 - DNA, 68728 bp, human; identical to SEQ ID NO: 3939

SEQ ID NO: 5177 - DNA, 41232 bp, human; identical to SEQ ID NO: 3940

SEQ ID NO: 5178 - DNA, 68728 bp, human; identical to SEQ ID NO: 3939

SEQ ID NO: 5179 - DNA, 149709 bp, human; identical to SEQ ID NO: 3936

SEQ ID NO: 5180 - DNA, 150667 bp, human; identical to SEQ ID NO: 3937

SEQ ID NO: 5181 - DNA, 150897 bp, human; identical to SEQ ID NO: 3938

SEQ ID NO: 5182 - DNA, 68728 bp, human; identical to SEQ ID NO: 3939

SEQ ID NO: 5183 - DNA, 41232 bp, human; identical to SEQ ID NO: 3940

SEQ ID NO: 5184 - DNA, 68728 bp, human; identical to SEQ ID NO: 3939

SEQ ID NO: 5185 - DNA, 149709 bp, human; identical to SEQ ID NO: 3936

SEQ ID NO: 5186 - DNA, 150667 bp, human; identical to SEQ ID NO: 3937

SEQ ID NO: 5187 - DNA, 150897 bp, human; identical to SEQ ID NO: 3938

SEQ ID NO: 5188 - DNA, 4844 bp, human; identical to SEQ ID NO: 3957

SEQ ID NO: 5189 - DNA, 68728 bp, human; identical to SEQ ID NO: 3939

SEQ ID NO: 5190 - DNA, 68728 bp, human; identical to SEQ ID NO: 3939

SEQ ID NO: 5191 - DNA, 149709 bp, human; identical to SEQ ID NO: 3936

SEQ ID NO: 5192 - DNA, 150897 bp, human; identical to SEQ ID NO: 3938

SEQ ID NO: 5193 - DNA, 2644 bp, human; identical to SEQ ID NO: 3964

SEQ ID NO: 5194 - DNA, 3876 bp, human; identical to SEQ ID NO: 3965

SEQ ID NO: 5195 - DNA, 4812 bp, human; identical to SEQ ID NO: 3966

SEQ ID NO: 5196 - DNA, 1486 bp, human; identical to SEQ ID NO: 3967

SEQ ID NO: 5197 - DNA, 8591 bp, human
ggtcactggcatcgagtctggaacagtcattctcagcaagagctctttgaactctgacattctctagttttacggactcgggtgagtgttttaactcctcccagctgccaagggcttgacttcctaccactgcgggcagtaattaatgaggcatttatttgctcaagtagtggcgaaataatgcgcactgcttttttgtgttgtcgtcggcggaatacgctcagttgcctagcaccacagccctctggctggtagtccctcttcgcggctcatatgctcgggtctccttgcggcccccagctcagcgaccgagacgcagacgaggaccagtgttcacgcgagttcagggggcggcgtagccgccgcccgcccaggaggaccatgttgcgcggcaagtcccggctcaacgtggagtggctgggctactcgccaggcctgctcctcgagcacaggcccctcctggcagggcgcacgccgcggagccaccgccggtaagtcatgtgagcgcccgcccccgcgccggcaacagccctgcgtcgctgcggcgcgccgcgccgcgccgcgcctgcgtactgtggcccgccgcccggcgcgaacgggcacttccggcgcgaacgggcacttccggcgcgaaccgctacttccggtgcgaaccgcctcggccgttccctcgcggagcttactgagcgcggccgccgagcccagctccgccgccgagcgcctgtgccggcacggctacaccatggagcgcccggataaggcggcgctgaacgcactgcagcctcctgagttcaggtagccctgagcggggcctggaccgcgaggcggactggccccagcctggagcagggcttgagggaaggccctagctgaatgggtgggcgtgaggtctggaccccggggacctggcctcagggaagggggcggggaaagcaggttggagcctgagacgtctaaactcccggccccgaactttcgctcgggaacaagggatccggggtcatggggaataggtcagtgggccttcagctcatgctcctatcctagcactttctctcgctgtgtctatattgcagtctctttcattaccgcagggtcagccttctgaggacaggaatgcagtctccttcatctccgtgttccctagggggcctgcatagtcggggcttaataaatgtttgctgtatgaatgaaggagtagaagggaatagtcccctggtgtgagattgcttcacttggggaatcagtaagatagaggctggtgactgagttgaaggaatgtatgagagagcaggtggttctggcccaccccagtaggcaagggagtggtgagggagttagctatcattcgttaagacctactgtatgccaggctcagtgcacgtgctttacatacattgtcagaattcttaatttctctaactgcttgatttcccaattttgaagaggatgcagttgagggtaagtgacttgaaactgagggtgagtgattacagaattaggcgacaaagttagtatgtaattgaagctaacgtttgaccaagctcactgactccaaagcccacgatctttggagctctgtgatgccttctctttccgacagggtcattgtgagttttttttttttttttttaacttttattttaggttcatgagtacatgcgcaggtttgttatataggtaaactgcatgtcacgggggcttggcgtacaggtaattttgtcacccaggtaataagcatagtacccgataggcgttttttctgattctctccctcctcccagcctccaccctcaagtagaccgcactgtctgttgttcctctcctagtgtccatctgttcttgttgtttagttcccacttatgagaacgtgcagtatttggttttcttttcctgtcttaatttgcttagaataatggcttccagctccagtcatgttgctgcaaaggacatgatctcattcttttttatggctgcatagtgttccatggtgtatatgtaccgcattttctttatccagcctcaatgtgggtttttttttaattattcatttatgagaataccaacatatttttattagatacacttacagcatagtccttctagactgattctggtttcctaatggaatttgcagtgaaatcttgactgtgggagaaagaattcctgttgtcttacttgctacaaaagggaatgtggtaggctctgtctgctcaatgttggctgcagaagtttgtatgaagtgggaaaactaggtggtgttataaatggaggcagattaaggttcatcctgaactttttcctttgtgtgaggacaactttaattccagcctttctcattcctcacttctaacaaatctctgctcagtaacacccaaagatacataggataaatcaattgaatagcatcagttgctttgtcttggataagccactgattttacccaaggtggcttgcatcagcaaaaccaacagctcttgtggctggaatccagggagaaaatgtcctataaacagtagaggaagtttgctagttttcaaaagtttgtatgtacactttgacttaatgcttagtcccatattagtgaggtcacaacacagaaaagtagtcacatttttgaagtttgaggtaaagagagaagtgagaaggaattagccataaattattaaggtatgctgtgtatagattgtgtgggggctagaaattaatatgtagaaaggttatatttgggtggtgggattataggtgattttgtttactttaaaacatttttatggtgttatatcatcttttcaataataaactttttaaaagccagaccagataatagatactcaagagaggtcatgtaaagaacaaaacaatcagttaacacttcctttctgttcctttaacaagttagataatctgaaagttgcattcctaaaacatacttttttactcaccatagaaacaccaaagtcaagtgctttttttagggtgcacaaaagaattggccaattagtgactctttgtattttttgtagattctccactgcagacactcatactcttcatgaggattacacaataaatttctctaaaaatttactagtaggaaacagtttaagggagcttatgtatattaaatgagagttgtatagctcagtaataaccaaaatgaggcctgctaaaagatgatccatttaagtaccaaaagaaaatattagaacttttttttttacagcagtaagcatttaatttctcacacatgtgcagagcatgtgatcaagaaataggcatgaggttagttatatttaatatatattttactcaatgtttttgtgggttttttgttcaggttctttttaaataaatttcattgtgtatatttgaggttcataacatgatgttatggcatacatatagtaaaatgattactatggtgaagcagattaatatatctgtcatctcacatacttttgtgtgtgtgtgaccagaggcagctaaaatcttatttacaaaagtccctaataccatgcaactttattgcctatagtcctcttgtacattagatatctcacttgttaatccatatatctactgctttgtgtcctttgatgtatatcttcctatttcctcccctccagcctcccacccccaccgccatggtaactactgttttattctctgtccctgtgtagttgaccgttgaccttttttttttttttttaaagattccacatataagtgagctcatgtagtattcgtctttctgcgtttggcttattttacttaacatgtcttccaggtccatccatgttgtggcaaatggcagatgtcctcttttaaggctgaataaaatattcccttgtatatatacactacggtttctttattttgtctgtctacatacacgtaggttgttttcaaatcttggctattgtgaataatgctgcaatgaacatggaagtgcagatatttttacgaggtagtgatttcatctcctttgcttatattccagaagagagattgctgggctgtgtggtagttctatttttaatttctttaggaactgttttccataatggctgtaccagtctacatttccagtcacaatgtagtagggtttctttttctccacacttttacaaacatttgttatcacttgcctttttgataatagctgtccttagaagtgtgaggttatatctcatagtggttttgatttgcatttccctgatgatttagtgatgttgagcacattttcatttatctcttggccatttttatgtctttggagaaatgtctgtccagctgttgtccatattttaatcaggtggtttttctgctgagttgtaagagttctttataaattttggggtattaaccccttacaagataggtggttcgcaaatatgttttcctagtctgtaagctgccttttcattttgttgattgtttcctttgcagtacagaagctttttagtttgatgcaagccgctttattttttcttttgtagcctgagcttttggtgtgatatccaaaaaatcattactgaggccaatgttaaggacctttccctctgtgttcttttatgtcttaaaactttatatctttatgttttagttattttatccattttgggttgatttttgtttatggtgtaagagtccagtttttttctttgcatgtagaaatcctgttttcccagtaccacttattgaagggactgtcctttccccattgtgttcctcttaacacccctgtcgaagattagttggccatatatgtttggatttatttctgggctctattctgtttcattgttatatgtttctgtttttatgccaataccatattgttttgattactataactgtaatattttaaatcagaaagtgtgatgcttacaactttttcaatgttgctttggctatttggggctttttgtggttctgtatgatgaattttaggattgtttttctattttaatgaagaatgctactgtaattttgatagagattgtgttatatctgtatgttgctttgggtgctgtagacatttcaacagtattaattcttccaatccatgaacacaggatatctttacatttatttgtgtcatcttcaatttctttcatcagtgttttatacttttcagtgtacaagtcactcatcgccttggttaaatttattcctaagtttctttttttttgaaatagagtcttgctctgtcacccaggccagagtaaagtgccccaatcactgctcactgcagccttgacctctggggctcaaacaatcctcccacttcagcctcttgagtagctgagattacaggcacgtgccaccatgcccagcgaattatcaaaatttttttttgtagaggtggggttttgctgtgttacctaggcttgcgtcaaactcccggcctcaagcctcagccttcccaaagtgctgggattacaggcatgagccactgagcctggcccctaagtatttttttttaatgctattataaatgagattgttttcttgatttctttttcagctcagtaaaggatgcggaagtttgtcaagtgctttttctgcatcaactgagatgatcctacttggtcataatatataatctttttgatgtattggttttgtttgtttgtgacagagtcttgctctgttgcccagactggagtgtgattttggctcattgcaacctctgcctcccaggatcaagggattcttgtgccttggcctcccaagtagctgggactataggcacacgccaccactctcagctaatttttgtatttttagtagagactgggttttgccatgttggccaggctgatctcgaactcctggcctcaagtgatccgcctgcctcggcctcccaaagtgctgggattacaggtgtgagccaccacacctggcctgattattgttgaatttggtttgaaaatatgttattgaggaattttgcaccagtgttcatcagtgatgttgtcctgtagttttcttgctgtgtctgtctggcttaggtatcaaggtgattggagcctcttaaaacgtgtttggaagtattccctctagctcgatttttcacccataacagaagttcctattccagctggggagggcgcactggtccgttcgccctgcctacctccttcagtggtctggtgtctggtgctggtggtcagggttgctgcacgggctcagggactggtgtggcagtggcttccctgggccaaagctctgatcccagtgggggagggcacgctggtgcgtcggctccacctggttagtttgctggtccactgtctggtgctggaggacaggaggctggcagctttcccagatgcaagctccgattccagcgggagagggcacactgctccacctgtggtgcctgccgagttccctggtctggtgtccggtgctggtggtcagggttgctgcgtgggctcagggaccagtgtgacagtggcttccctgggcaaaagctctgattccagtgtgggagggtgcacaggtgtgtctgcctcgttagttccctggtccactgtctcatgctggaggacagcaagctggtcgcttcccgtgacggaagctctgattccagcaaaagagggcgcgctgatccacccatggtgcctgctgcgttcccagctctggtgtctggtgctggtggacacggttgccgcatgggttgggcactggtgccgctgtccgccgtggcttccctgggtaaaagctccagttccagaggcaggggcactgagtttcttcacttagtttgttcacccagcttgttggcagttgatctgaggtgccctgacgcttcgtcttacactggatatgaatgacagtccctaaaggtggtgtataatcttcatgttccagctcaagaaattcccactacccacagctggttctctaggatcttcggattacgagtccctgcctgtgatcttcctcctgcatagcatctcatttgtggatgtttatagtttcagggacataagagcgtttggatatgactgtgcaggttctgattttctctttgtttactttattccagaaatgaaagctcattagcatctacactgaagacgctcctgttcttcacagctttaatgatcactgttcctattgggttatatttcacaactaaatcttacatatttgaaggtaatcttagacccattaaaacaagatgttttcccccaatttaagattctgtgcttttatgacctctttatatctttaaactgggtattcttatttttttcttgtttagcttttcaaaaaatcatattgctcataatgagtctttatgaaataacttattgtttcagcttgacagttttcctatggttttctgtgaaatagcttgcaaatcctttctcttagtaccttttaaagaataggggttggctgacatgggaggaggaattttgggggaatggactttagtgtcagataacggaaggaagagagaatgaagtcccctttttgatgttgaaattttttttttttttttgagacagtttcactcttgttgcacaggctggagtgcaatggcgcgatctcggctcaccgcaacccccgcctcccatgttcaagcgattctcctgtctcagcctcctgagtatctgggattacaggcacccgccactacacccgactgatttttggtatttttagtagagacggggtttcgccatgttggccaggctggtctcgaactcgtgacctcaggtgatccacccgcctcggcctcccagagtgctgggattacaagcgtgagccaccgcacccggcctgaagtctttataattatggttttgtttaaaacaatgtttgtttgtttgtttgtttgtttttgagacggagtctcgctcagtcacccaggctggagtgcagtggtgcgatctcggctcgcgtcaagctctgcctcccaggttcacgccattctgctgcctcagcctcccgagtagctgggactacaggcgcctgccactacgcctggctaattttttttgtatttttagtagagacggggtttcacggtgctagccaggatggtttccatctcctgacctcgtgatctgcccgtcttggcctcccaaagtgctgggattacaggcgtgagccactgcacccggccaacataatgttcttaatatatagaaggtactcatatcttttagtgaatactttattcattaccacccaaaatattactttttaattgcctgactagttaaataaatacatcataaaaattaggatgctttgttttttttttttgtactttggtaaattttgcaataaaatggaaactgttttttttctcttgataggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaa

SEQ ID NO: 5198 - DNA, 12160 bp, human
tacttccggtgcgaaccgcctcggccgttccctcgcggagcttactgagcgcggccgccgagcccagctccgccgccgagcgcctgtgccggcacggctacaccatggagcgcccggataaggcggcgctgaacgcactgcagcctcctgagttcaggtagccctgagcggggcctggaccgcgaggcggactggccccagcctggagcagggcttgagggaaggccctagctgaatgggtgggcgtgaggtctggaccccggggacctggcctcagggaagggggcggggaaagcaggttggagcctgagacgtctaaactcccggccccgaactttcgctcgggaacaagggatccggggtcatggggaataggtcagtgggccttcagctcatgctcctatcctagcactttctctcgctgtgtctatattgcagtctctttcattaccgcagggtcagccttctgaggacaggaatgcagtctccttcatctccgtgttccctagggggcctgcatagtcggggcttaataaatgtttgctgtatgaatgaaggagtagaagggaatagtcccctggtgtgagattgcttcacttggggaatcagtaagatagaggctggtgactgagttgaaggaatgtatgagagagcaggtggttctggcccaccccagtaggcaagggagtggtgagggagttagctatcattcgttaagacctactgtatgccaggctcagtgcacgtgctttacatacattgtcagaattcttaatttctctaactgcttgatttcccaattttgaagaggatgcagttgagggtaagtgacttgaaactgagggtgagtgattacagaattaggcgacaaagttagtatgtaattgaagctaacgtttgaccaagctcactgactccaaagcccacgatctttggagctctgtgatgccttctctttccgacagggtcattgtgagttttttttttttttttttaacttttattttaggttcatgagtacatgcgcaggtttgttatataggtaaactgcatgtcacgggggcttggcgtacaggtaattttgtcacccaggtaataagcatagtacccgataggcgttttttctgattctctccctcctcccagcctccaccctcaagtagaccgcactgtctgttgttcctctcctagtgtccatctgttcttgttgtttagttcccacttatgagaacgtgcagtatttggttttcttttcctgtcttaatttgcttagaataatggcttccagctccagtcatgttgctgcaaaggacatgatctcattcttttttatggctgcatagtgttccatggtgtatatgtaccgcattttctttatccagcctcaatgtgggtttttttttaattattcatttatgagaataccaacatatttttattagatacacttacagcatagtccttctagactgattctggtttcctaatggaatttgcagtgaaatcttgactgtgggagaaagaattcctgttgtcttacttgctacaaaagggaatgtggtaggctctgtctgctcaatgttggctgcagaagtttgtatgaagtgggaaaactaggtggtgttataaatggaggcagattaaggttcatcctgaactttttcctttgtgtgaggacaactttaattccagcctttctcattcctcacttctaacaaatctctgctcagtaacacccaaagatacataggataaatcaattgaatagcatcagttgctttgtcttggataagccactgattttacccaaggtggcttgcatcagcaaaaccaacagctcttgtggctggaatccagggagaaaatgtcctataaacagtagaggaagtttgctagttttcaaaagtttgtatgtacactttgacttaatgcttagtcccatattagtgaggtcacaacacagaaaagtagtcacatttttgaagtttgaggtaaagagagaagtgagaaggaattagccataaattattaaggtatgctgtgtatagattgtgtgggggctagaaattaatatgtagaaaggttatatttgggtggtgggattataggtgattttgtttactttaaaacatttttatggtgttatatcatcttttcaataataaactttttaaaagccagaccagataatagatactcaagagaggtcatgtaaagaacaaaacaatcagttaacacttcctttctgttcctttaacaagttagataatctgaaagttgcattcctaaaacatacttttttactcaccatagaaacaccaaagtcaagtgctttttttagggtgcacaaaagaattggccaattagtgactctttgtattttttgtagattctccactgcagacactcatactcttcatgaggattacacaataaatttctctaaaaatttactagtaggaaacagtttaagggagcttatgtatattaaatgagagttgtatagctcagtaataaccaaaatgaggcctgctaaaagatgatccatttaagtaccaaaagaaaatattagaacttttttttttacagcagtaagcatttaatttctcacacatgtgcagagcatgtgatcaagaaataggcatgaggttagttatatttaatatatattttactcaatgtttttgtgggttttttgttcaggttctttttaaataaatttcattgtgtatatttgaggttcataacatgatgttatggcatacatatagtaaaatgattactatggtgaagcagattaatatatctgtcatctcacatacttttgtgtgtgtgtgaccagaggcagctaaaatcttatttacaaaagtccctaataccatgcaactttattgcctatagtcctcttgtacattagatatctcacttgttaatccatatatctactgctttgtgtcctttgatgtatatcttcctatttcctcccctccagcctcccacccccaccgccatggtaactactgttttattctctgtccctgtgtagttgaccgttgaccttttttttttttttttaaagattccacatataagtgagctcatgtagtattcgtctttctgcgtttggcttattttacttaacatgtcttccaggtccatccatgttgtggcaaatggcagatgtcctcttttaaggctgaataaaatattcccttgtatatatacactacggtttctttattttgtctgtctacatacacgtaggttgttttcaaatcttggctattgtgaataatgctgcaatgaacatggaagtgcagatatttttacgaggtagtgatttcatctcctttgcttatattccagaagagagattgctgggctgtgtggtagttctatttttaatttctttaggaactgttttccataatggctgtaccagtctacatttccagtcacaatgtagtagggtttctttttctccacacttttacaaacatttgttatcacttgcctttttgataatagctgtccttagaagtgtgaggttatatctcatagtggttttgatttgcatttccctgatgatttagtgatgttgagcacattttcatttatctcttggccatttttatgtctttggagaaatgtctgtccagctgttgtccatattttaatcaggtggtttttctgctgagttgtaagagttctttataaattttggggtattaaccccttacaagataggtggttcgcaaatatgttttcctagtctgtaagctgccttttcattttgttgattgtttcctttgcagtacagaagctttttagtttgatgcaagccgctttattttttcttttgtagcctgagcttttggtgtgatatccaaaaaatcattactgaggccaatgttaaggacctttccctctgtgttcttttatgtcttaaaactttatatctttatgttttagttattttatccattttgggttgatttttgtttatggtgtaagagtccagtttttttctttgcatgtagaaatcctgttttcccagtaccacttattgaagggactgtcctttccccattgtgttcctcttaacacccctgtcgaagattagttggccatatatgtttggatttatttctgggctctattctgtttcattgttatatgtttctgtttttatgccaataccatattgttttgattactataactgtaatattttaaatcagaaagtgtgatgcttacaactttttcaatgttgctttggctatttggggctttttgtggttctgtatgatgaattttaggattgtttttctattttaatgaagaatgctactgtaattttgatagagattgtgttatatctgtatgttgctttgggtgctgtagacatttcaacagtattaattcttccaatccatgaacacaggatatctttacatttatttgtgtcatcttcaatttctttcatcagtgttttatacttttcagtgtacaagtcactcatcgccttggttaaatttattcctaagtttctttttttttgaaatagagtcttgctctgtcacccaggccagagtaaagtgccccaatcactgctcactgcagccttgacctctggggctcaaacaatcctcccacttcagcctcttgagtagctgagattacaggcacgtgccaccatgcccagcgaattatcaaaatttttttttgtagaggtggggttttgctgtgttacctaggcttgcgtcaaactcccggcctcaagcctcagccttcccaaagtgctgggattacaggcatgagccactgagcctggcccctaagtatttttttttaatgctattataaatgagattgttttcttgatttctttttcagctcagtaaaggatgcggaagtttgtcaagtgctttttctgcatcaactgagatgatcctacttggtcataatatataatctttttgatgtattggttttgtttgtttgtgacagagtcttgctctgttgcccagactggagtgtgattttggctcattgcaacctctgcctcccaggatcaagggattcttgtgccttggcctcccaagtagctgggactataggcacacgccaccactctcagctaatttttgtatttttagtagagactgggttttgccatgttggccaggctgatctcgaactcctggcctcaagtgatccgcctgcctcggcctcccaaagtgctgggattacaggtgtgagccaccacacctggcctgattattgttgaatttggtttgaaaatatgttattgaggaattttgcaccagtgttcatcagtgatgttgtcctgtagttttcttgctgtgtctgtctggcttaggtatcaaggtgattggagcctcttaaaacgtgtttggaagtattccctctagctcgatttttcacccataacagaagttcctattccagctggggagggcgcactggtccgttcgccctgcctacctccttcagtggtctggtgtctggtgctggtggtcagggttgctgcacgggctcagggactggtgtggcagtggcttccctgggccaaagctctgatcccagtgggggagggcacgctggtgcgtcggctccacctggttagtttgctggtccactgtctggtgctggaggacaggaggctggcagctttcccagatgcaagctccgattccagcgggagagggcacactgctccacctgtggtgcctgccgagttccctggtctggtgtccggtgctggtggtcagggttgctgcgtgggctcagggaccagtgtgacagtggcttccctgggcaaaagctctgattccagtgtgggagggtgcacaggtgtgtctgcctcgttagttccctggtccactgtctcatgctggaggacagcaagctggtcgcttcccgtgacggaagctctgattccagcaaaagagggcgcgctgatccacccatggtgcctgctgcgttcccagctctggtgtctggtgctggtggacacggttgccgcatgggttgggcactggtgccgctgtccgccgtggcttccctgggtaaaagctccagttccagaggcaggggcactgagtttcttcacttagtttgttcacccagcttgttggcagttgatctgaggtgccctgacgcttcgtcttacactggatatgaatgacagtccctaaaggtggtgtataatcttcatgttccagctcaagaaattcccactacccacagctggttctctaggatcttcggattacgagtccctgcctgtgatcttcctcctgcatagcatctcatttgtggatgtttatagtttcagggacataagagcgtttggatatgactgtgcaggttctgattttctctttgtttactttattccagaaatgaaagctcattagcatctacactgaagacgctcctgttcttcacagctttaatgatcactgttcctattgggttatatttcacaactaaatcttacatatttgaaggtaatcttagacccattaaaacaagatgttttcccccaatttaagattctgtgcttttatgacctctttatatctttaaactgggtattcttatttttttcttgtttagcttttcaaaaaatcatattgctcataatgagtctttatgaaataacttattgtttcagcttgacagttttcctatggttttctgtgaaatagcttgcaaatcctttctcttagtaccttttaaagaataggggttggctgacatgggaggaggaattttgggggaatggactttagtgtcagataacggaaggaagagagaatgaagtcccctttttgatgttgaaattttttttttttttttgagacagtttcactcttgttgcacaggctggagtgcaatggcgcgatctcggctcaccgcaacccccgcctcccatgttcaagcgattctcctgtctcagcctcctgagtatctgggattacaggcacccgccactacacccgactgatttttggtatttttagtagagacggggtttcgccatgttggccaggctggtctcgaactcgtgacctcaggtgatccacccgcctcggcctcccagagtgctgggattacaagcgtgagccaccgcacccggcctgaagtctttataattatggttttgtttaaaacaatgtttgtttgtttgtttgtttgtttttgagacggagtctcgctcagtcacccaggctggagtgcagtggtgcgatctcggctcgcgtcaagctctgcctcccaggttcacgccattctgctgcctcagcctcccgagtagctgggactacaggcgcctgccactacgcctggctaattttttttgtatttttagtagagacggggtttcacggtgctagccaggatggtttccatctcctgacctcgtgatctgcccgtcttggcctcccaaagtgctgggattacaggcgtgagccactgcacccggccaacataatgttcttaatatatagaaggtactcatatcttttagtgaatactttattcattaccacccaaaatattactttttaattgcctgactagttaaataaatacatcataaaaattaggatgctttgttttttttttttgtactttggtaaattttgcaataaaatggaaactgttttttttctcttgataggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcagtcttaaggagtcacgtttgagtatgtaaattttgatctttctaatatgttggtttgtatattcagttttaactgtatgaatctgatttgcaaatgagaatttggaaaagttagttacaaagaaatatgttaatttaattagacaatactctggaaggaattttatcttctttcaacaaaacatgttttatagtattctgacttacggttgcttttgagttttactcatttggatatattaagatgcacacagtgaagcaaattaaactccactttacgctggaatgctttctttagcatgaaaataccaggtccttggatttgggattttaatttcctatggaaagttgcttaaattgtggacactggaattaatctgaatgtcactgaggaatttcacatgaagtgtaatccctagtcaataagaattatccattacattattttatgggaaaactaggctaaattacatccattcaggtaaaaggaccttagcttactgaaggatctaaagagcaaagcaaagatctcactactcaaacactcagcctgcttccttcaagtccccttgcaggccagctttgtgctttgcagaccaactttttaatgagatactttgcttcctcattcaacattgaagctaggcttcaattaaaaggttcgaggaagctccatttaaaattgttttttttactattttttaaaattgtagtgtatatgataggaatttgcatttaaatatgttcatttttgcatatgttaggagtggaaacaatctggaaaacatttttttttcatccaaaaagtattctccttgggcatatctgatggaaaaaaaccttgattttattttcgtatctttagtctgtgttctttctagttatttggtactaattatgtgcaatctaaaaacactcccacaagtatttgttttttaattataaaatcatagtatatgttctttgtagaaaactggaaaaatacatattcaaacaggaaaaaaaatcaaaattccccataatgttgccatctaaaaataacctctattttagttgatatcccgtattcatttttgaaagccattccttaatgctagtttgatacacactaaaagtttagcttacaagttcaaattctgccagcttttcctgacagctatttgcatttttttcagatgagtgattattggccattttctttttctttttctttattttatttatttatttttttgagacagagttttgctctgttgcccaggctggagtgcagtggtgcaatctcggctcactgcaacctctgcctcctgggttcaagtgattctccacctcagcctcccaagtagctgggactacggatgcctgccaccacgcctggctaatttttttttgtatttttttgtagagacggggtttcaccatgttgtccaggctaatcttgaacttgtgacctcaggtgatccacccgcctcggcctccgaaagtgctgggattacaggcgtgagctaccacgcccggccttattgaccattttctaaataagcacattctatctttattctcttaaaattcaaattttctgttactgataatcctaatactaggattcttgcttaagtatgtgaaaccattaccgatttgttgttcacatttattttttatgttgtgaaactggactaaaggaatagagggatgattagtcataaaagtcaaatagcatttgtgtttaactgttgagaaaagtgaaagatcagtatgattattatggaactgtttttaattcttgcttaaagactacaattttagtataatgacatttgagtctagggtagtatgtggtagatttctagatggtccctaattaagaagtattgttgtatttagaattgtccacctaatttctttttatataatgccaaggtatttcttgtgcttttgggatcttatgctgtttgtaaaatgttactgtccaatgttggattattgttttggtttcaggcatttgctgaataggtgatgatacatgggtatttttctgcaagtatttaaaccaggggcatatgcaaaggcagttgtaatttcctcttggaaaaagcgccaaatgtttgaaggttaaaatcaaatgctagggttgatatttaggcttataacaaaataggcttgttttcaaagcagttttttcctagagttttaactgttaactcactagtttgctgctgtttttaactatgttaaataacatatggtatttggcaaatagatttatttttcaaaatgtctcactagtttccttttacacaatgtatatacttcaagatgtatagaaaggaaagctacagttgagcccttatacatgttttaaggtagaaatatgttccctattgtttgaaaactgattgtaagaataacctcagttaggagatataacttgaagtgtcagtccaaactactgatttaaccctatttacggtaacacattaccttcctcacctcctgtttggccctggagaatgtagtcctttttctcatttgtgttgagaaatgaaaagtctgctgtagaatgtatctgatgtcattagttcttcaaatggataccattgtacatataacagtagaatttggtttggggttgttagtgaaaaaaaatttaaacctgccattaaaaatccccatgtttcatggaaatctaacagaaatacattgtaataattagaacattttgttttcttttttctttttttttttttcgagacggagttttgcccttcttgcccaggctggagtgcaagggcgcaatctcggctcgctgcaacctccgcctcccgggttcaagcagttctcctgcctcagccccctgagtacctcagatgacaggtgcgtgccaccacacccggctaatttttgtatttttagtagagacggggtttcaccatgttagccaggctagtctcgaactcctgacctcaggtgatccacccgcctccgcctcccaaagtgctgggattacaggtatcagccaccgtgcctggcctaataattggaacattttcatcatgaaaatgtcatcagctttgccaaaagaaacaaccaattgacttgtttggcgtttgttttccattttcatgtcaattttatgtatacagttagaatacccaaggagaccactaaaatcagttaaacaagtagggtatatacaaagaaagatgaaacccgaaagtacataaaaaggatttaaatccgattttagatgtacctagtgtgtatttcttatctctagacaagttcatgtttattgtttaatttatgcccaagtgaagttgtaaacttatggttcaactctgacacagaatttgtcacttgtctgaggtcagtggcaggtttctctgctgtcaagcactctgtgtcacccaccagattagtataactattaattcagactgtactcctatgtttaagataatttttacaagagctggctgaagcagcacattagtaacctgacaagatttctttttcccttttcagggggaaagggtcaccttaaaaataaattattttcagggactttgggaatctaatgataaatattacacataatctatgaatagcttaatcctttatatattccttaaaataggaattcctcgacatcactcctggccacactttccttgcctgtgttgttgctatgtgtatttgaaagtaatatctgcattccttttaagatgttctgtaagtcatatttgtcagttatacagagtagtcttccttttccccacgttcagtgtaatctcactgaacagtaataatagcaatagctaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtattgaatagtgccctgactagggggaggatttggatgtgctgcatttcaagccgtgtataatcatcaaaatggggggcttgagttctttagctacttgaatccgatttacttctgttaagtgatgcttttctaaccgttttctggatggattttgtattcactatattgtagcttgtaatttgtataaatgtaccatctgatgtcattaaaaaaagtgtttgtagtgcta

SEQ ID NO: 5199 - DNA, 8642 bp, human
gctttctgagcagctgcaaaatatgtttttaacttttaagtggaagttgggggtcactggcatcgagtctggaacagtcattctcagcaagagctctttgaactctgacattctctagttttacggactcgggtgagtgttttaactcctcccagctgccaagggcttgacttcctaccactgcgggcagtaattaatgaggcatttatttgctcaagtagtggcgaaataatgcgcactgcttttttgtgttgtcgtcggcggaatacgctcagttgcctagcaccacagccctctggctggtagtccctcttcgcggctcatatgctcgggtctccttgcggcccccagctcagcgaccgagacgcagacgaggaccagtgttcacgcgagttcagggggcggcgtagccgccgcccgcccaggaggaccatgttgcgcggcaagtcccggctcaacgtggagtggctgggctactcgccaggcctgctcctcgagcacaggcccctcctggcagggcgcacgccgcggagccaccgccggtaagtcatgtgagcgcccgcccccgcgccggcaacagccctgcgtcgctgcggcgcgccgcgccgcgccgcgcctgcgtactgtggcccgccgcccggcgcgaacgggcacttccggcgcgaacgggcacttccggcgcgaaccgctacttccggtgcgaaccgcctcggccgttccctcgcggagcttactgagcgcggccgccgagcccagctccgccgccgagcgcctgtgccggcacggctacaccatggagcgcccggataaggcggcgctgaacgcactgcagcctcctgagttcaggtagccctgagcggggcctggaccgcgaggcggactggccccagcctggagcagggcttgagggaaggccctagctgaatgggtgggcgtgaggtctggaccccggggacctggcctcagggaagggggcggggaaagcaggttggagcctgagacgtctaaactcccggccccgaactttcgctcgggaacaagggatccggggtcatggggaataggtcagtgggccttcagctcatgctcctatcctagcactttctctcgctgtgtctatattgcagtctctttcattaccgcagggtcagccttctgaggacaggaatgcagtctccttcatctccgtgttccctagggggcctgcatagtcggggcttaataaatgtttgctgtatgaatgaaggagtagaagggaatagtcccctggtgtgagattgcttcacttggggaatcagtaagatagaggctggtgactgagttgaaggaatgtatgagagagcaggtggttctggcccaccccagtaggcaagggagtggtgagggagttagctatcattcgttaagacctactgtatgccaggctcagtgcacgtgctttacatacattgtcagaattcttaatttctctaactgcttgatttcccaattttgaagaggatgcagttgagggtaagtgacttgaaactgagggtgagtgattacagaattaggcgacaaagttagtatgtaattgaagctaacgtttgaccaagctcactgactccaaagcccacgatctttggagctctgtgatgccttctctttccgacagggtcattgtgagttttttttttttttttttaacttttattttaggttcatgagtacatgcgcaggtttgttatataggtaaactgcatgtcacgggggcttggcgtacaggtaattttgtcacccaggtaataagcatagtacccgataggcgttttttctgattctctccctcctcccagcctccaccctcaagtagaccgcactgtctgttgttcctctcctagtgtccatctgttcttgttgtttagttcccacttatgagaacgtgcagtatttggttttcttttcctgtcttaatttgcttagaataatggcttccagctccagtcatgttgctgcaaaggacatgatctcattcttttttatggctgcatagtgttccatggtgtatatgtaccgcattttctttatccagcctcaatgtgggtttttttttaattattcatttatgagaataccaacatatttttattagatacacttacagcatagtccttctagactgattctggtttcctaatggaatttgcagtgaaatcttgactgtgggagaaagaattcctgttgtcttacttgctacaaaagggaatgtggtaggctctgtctgctcaatgttggctgcagaagtttgtatgaagtgggaaaactaggtggtgttataaatggaggcagattaaggttcatcctgaactttttcctttgtgtgaggacaactttaattccagcctttctcattcctcacttctaacaaatctctgctcagtaacacccaaagatacataggataaatcaattgaatagcatcagttgctttgtcttggataagccactgattttacccaaggtggcttgcatcagcaaaaccaacagctcttgtggctggaatccagggagaaaatgtcctataaacagtagaggaagtttgctagttttcaaaagtttgtatgtacactttgacttaatgcttagtcccatattagtgaggtcacaacacagaaaagtagtcacatttttgaagtttgaggtaaagagagaagtgagaaggaattagccataaattattaaggtatgctgtgtatagattgtgtgggggctagaaattaatatgtagaaaggttatatttgggtggtgggattataggtgattttgtttactttaaaacatttttatggtgttatatcatcttttcaataataaactttttaaaagccagaccagataatagatactcaagagaggtcatgtaaagaacaaaacaatcagttaacacttcctttctgttcctttaacaagttagataatctgaaagttgcattcctaaaacatacttttttactcaccatagaaacaccaaagtcaagtgctttttttagggtgcacaaaagaattggccaattagtgactctttgtattttttgtagattctccactgcagacactcatactcttcatgaggattacacaataaatttctctaaaaatttactagtaggaaacagtttaagggagcttatgtatattaaatgagagttgtatagctcagtaataaccaaaatgaggcctgctaaaagatgatccatttaagtaccaaaagaaaatattagaacttttttttttacagcagtaagcatttaatttctcacacatgtgcagagcatgtgatcaagaaataggcatgaggttagttatatttaatatatattttactcaatgtttttgtgggttttttgttcaggttctttttaaataaatttcattgtgtatatttgaggttcataacatgatgttatggcatacatatagtaaaatgattactatggtgaagcagattaatatatctgtcatctcacatacttttgtgtgtgtgtgaccagaggcagctaaaatcttatttacaaaagtccctaataccatgcaactttattgcctatagtcctcttgtacattagatatctcacttgttaatccatatatctactgctttgtgtcctttgatgtatatcttcctatttcctcccctccagcctcccacccccaccgccatggtaactactgttttattctctgtccctgtgtagttgaccgttgaccttttttttttttttttaaagattccacatataagtgagctcatgtagtattcgtctttctgcgtttggcttattttacttaacatgtcttccaggtccatccatgttgtggcaaatggcagatgtcctcttttaaggctgaataaaatattcccttgtatatatacactacggtttctttattttgtctgtctacatacacgtaggttgttttcaaatcttggctattgtgaataatgctgcaatgaacatggaagtgcagatatttttacgaggtagtgatttcatctcctttgcttatattccagaagagagattgctgggctgtgtggtagttctatttttaatttctttaggaactgttttccataatggctgtaccagtctacatttccagtcacaatgtagtagggtttctttttctccacacttttacaaacatttgttatcacttgcctttttgataatagctgtccttagaagtgtgaggttatatctcatagtggttttgatttgcatttccctgatgatttagtgatgttgagcacattttcatttatctcttggccatttttatgtctttggagaaatgtctgtccagctgttgtccatattttaatcaggtggtttttctgctgagttgtaagagttctttataaattttggggtattaaccccttacaagataggtggttcgcaaatatgttttcctagtctgtaagctgccttttcattttgttgattgtttcctttgcagtacagaagctttttagtttgatgcaagccgctttattttttcttttgtagcctgagcttttggtgtgatatccaaaaaatcattactgaggccaatgttaaggacctttccctctgtgttcttttatgtcttaaaactttatatctttatgttttagttattttatccattttgggttgatttttgtttatggtgtaagagtccagtttttttctttgcatgtagaaatcctgttttcccagtaccacttattgaagggactgtcctttccccattgtgttcctcttaacacccctgtcgaagattagttggccatatatgtttggatttatttctgggctctattctgtttcattgttatatgtttctgtttttatgccaataccatattgttttgattactataactgtaatattttaaatcagaaagtgtgatgcttacaactttttcaatgttgctttggctatttggggctttttgtggttctgtatgatgaattttaggattgtttttctattttaatgaagaatgctactgtaattttgatagagattgtgttatatctgtatgttgctttgggtgctgtagacatttcaacagtattaattcttccaatccatgaacacaggatatctttacatttatttgtgtcatcttcaatttctttcatcagtgttttatacttttcagtgtacaagtcactcatcgccttggttaaatttattcctaagtttctttttttttgaaatagagtcttgctctgtcacccaggccagagtaaagtgccccaatcactgctcactgcagccttgacctctggggctcaaacaatcctcccacttcagcctcttgagtagctgagattacaggcacgtgccaccatgcccagcgaattatcaaaatttttttttgtagaggtggggttttgctgtgttacctaggcttgcgtcaaactcccggcctcaagcctcagccttcccaaagtgctgggattacaggcatgagccactgagcctggcccctaagtatttttttttaatgctattataaatgagattgttttcttgatttctttttcagctcagtaaaggatgcggaagtttgtcaagtgctttttctgcatcaactgagatgatcctacttggtcataatatataatctttttgatgtattggttttgtttgtttgtgacagagtcttgctctgttgcccagactggagtgtgattttggctcattgcaacctctgcctcccaggatcaagggattcttgtgccttggcctcccaagtagctgggactataggcacacgccaccactctcagctaatttttgtatttttagtagagactgggttttgccatgttggccaggctgatctcgaactcctggcctcaagtgatccgcctgcctcggcctcccaaagtgctgggattacaggtgtgagccaccacacctggcctgattattgttgaatttggtttgaaaatatgttattgaggaattttgcaccagtgttcatcagtgatgttgtcctgtagttttcttgctgtgtctgtctggcttaggtatcaaggtgattggagcctcttaaaacgtgtttggaagtattccctctagctcgatttttcacccataacagaagttcctattccagctggggagggcgcactggtccgttcgccctgcctacctccttcagtggtctggtgtctggtgctggtggtcagggttgctgcacgggctcagggactggtgtggcagtggcttccctgggccaaagctctgatcccagtgggggagggcacgctggtgcgtcggctccacctggttagtttgctggtccactgtctggtgctggaggacaggaggctggcagctttcccagatgcaagctccgattccagcgggagagggcacactgctccacctgtggtgcctgccgagttccctggtctggtgtccggtgctggtggtcagggttgctgcgtgggctcagggaccagtgtgacagtggcttccctgggcaaaagctctgattccagtgtgggagggtgcacaggtgtgtctgcctcgttagttccctggtccactgtctcatgctggaggacagcaagctggtcgcttcccgtgacggaagctctgattccagcaaaagagggcgcgctgatccacccatggtgcctgctgcgttcccagctctggtgtctggtgctggtggacacggttgccgcatgggttgggcactggtgccgctgtccgccgtggcttccctgggtaaaagctccagttccagaggcaggggcactgagtttcttcacttagtttgttcacccagcttgttggcagttgatctgaggtgccctgacgcttcgtcttacactggatatgaatgacagtccctaaaggtggtgtataatcttcatgttccagctcaagaaattcccactacccacagctggttctctaggatcttcggattacgagtccctgcctgtgatcttcctcctgcatagcatctcatttgtggatgtttatagtttcagggacataagagcgtttggatatgactgtgcaggttctgattttctctttgtttactttattccagaaatgaaagctcattagcatctacactgaagacgctcctgttcttcacagctttaatgatcactgttcctattgggttatatttcacaactaaatcttacatatttgaaggtaatcttagacccattaaaacaagatgttttcccccaatttaagattctgtgcttttatgacctctttatatctttaaactgggtattcttatttttttcttgtttagcttttcaaaaaatcatattgctcataatgagtctttatgaaataacttattgtttcagcttgacagttttcctatggttttctgtgaaatagcttgcaaatcctttctcttagtaccttttaaagaataggggttggctgacatgggaggaggaattttgggggaatggactttagtgtcagataacggaaggaagagagaatgaagtcccctttttgatgttgaaattttttttttttttttgagacagtttcactcttgttgcacaggctggagtgcaatggcgcgatctcggctcaccgcaacccccgcctcccatgttcaagcgattctcctgtctcagcctcctgagtatctgggattacaggcacccgccactacacccgactgatttttggtatttttagtagagacggggtttcgccatgttggccaggctggtctcgaactcgtgacctcaggtgatccacccgcctcggcctcccagagtgctgggattacaagcgtgagccaccgcacccggcctgaagtctttataattatggttttgtttaaaacaatgtttgtttgtttgtttgtttgtttttgagacggagtctcgctcagtcacccaggctggagtgcagtggtgcgatctcggctcgcgtcaagctctgcctcccaggttcacgccattctgctgcctcagcctcccgagtagctgggactacaggcgcctgccactacgcctggctaattttttttgtatttttagtagagacggggtttcacggtgctagccaggatggtttccatctcctgacctcgtgatctgcccgtcttggcctcccaaagtgctgggattacaggcgtgagccactgcacccggccaacataatgttcttaatatatagaaggtactcatatcttttagtgaatactttattcattaccacccaaaatattactttttaattgcctgactagttaaataaatacatcataaaaattaggatgctttgttttttttttttgtactttggtaaattttgcaataaaatggaaactgttttttttctcttgataggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaa

SEQ ID NO: 5200 - DNA, 59038 bp, human; identical to SEQ ID NO: 3976

SEQ ID NO: 5201 - DNA, 59038 bp, human; identical to SEQ ID NO: 3976

SEQ ID NO: 5202 - DNA, 17814 bp, human; identical to SEQ ID NO: 3978

SEQ ID NO: 5203 - DNA, 59038 bp, human; identical to SEQ ID NO: 3976

SEQ ID NO: 5204 - DNA, 55360 bp, human; identical to SEQ ID NO: 3981

SEQ ID NO: 5205 - DNA, 59038 bp, human; identical to SEQ ID NO: 3976

SEQ ID NO: 5206 - DNA, 54472 bp, human; identical to SEQ ID NO: 3983

SEQ ID NO: 5207 - DNA, 17456 bp, human; identical to SEQ ID NO: 3984

SEQ ID NO: 5208 - DNA, 59038 bp, human; identical to SEQ ID NO: 3976

SEQ ID NO: 5209 - DNA, 55615 bp, human; identical to SEQ ID NO: 3986

SEQ ID NO: 5210 - DNA, 59038 bp, human; identical to SEQ ID NO: 3976

SEQ ID NO: 5211 - DNA, 45421 bp, human; identical to SEQ ID NO: 3988

SEQ ID NO: 5212 - DNA, 59018 bp, human; identical to SEQ ID NO: 3989

SEQ ID NO: 5213 - DNA, 59038 bp, human; identical to SEQ ID NO: 3976

SEQ ID NO: 5214 - DNA, 59038 bp, human; identical to SEQ ID NO: 3976

SEQ ID NO: 5215 - DNA, 17814 bp, human; identical to SEQ ID NO: 3978

SEQ ID NO: 5216 - DNA, 59038 bp, human; identical to SEQ ID NO: 3976

SEQ ID NO: 5217 - DNA, 28071 bp, human; identical to SEQ ID NO: 3980

SEQ ID NO: 5218 - DNA, 55360 bp, human; identical to SEQ ID NO: 3981

SEQ ID NO: 5219 - DNA, 59038 bp, human; identical to SEQ ID NO: 3976

SEQ ID NO: 5220 - DNA, 54472 bp, human; identical to SEQ ID NO: 3983

SEQ ID NO: 5221 - DNA, 17456 bp, human; identical to SEQ ID NO: 3984

SEQ ID NO: 5222 - DNA, 59038 bp, human; identical to SEQ ID NO: 3976

SEQ ID NO: 5223 - DNA, 55615 bp, human; identical to SEQ ID NO: 3986

SEQ ID NO: 5224 - DNA, 59038 bp, human; identical to SEQ ID NO: 3976

SEQ ID NO: 5225 - DNA, 45421 bp, human; identical to SEQ ID NO: 3988

SEQ ID NO: 5226 - DNA, 59018 bp, human; identical to SEQ ID NO: 3989

SEQ ID NO: 5227 - DNA, 5800 bp, human; identical to SEQ ID NO: 3990

SEQ ID NO: 5228 - DNA, 6178 bp, human; identical to SEQ ID NO: 3991

SEQ ID NO: 5229 - DNA, 1031 bp, human
tcctgggtatccctgatgactgcaaggaacatgagttccaggaggccgtgcgggctgccctgtcgcccctgggcaggtaccgagtactcaccaagcacttcagaaaggagctcggggccaaggcagccttggtggagttcgctgagtatttaaaccgaagcttgattccccatcaaataccaggcaatggggggccctggaaagtgatcttcctgccccaagtacctgttattgagtttcaggatatgcccagttttcctgcacagccccagggtcaagcagtagcaaaagctgcaggtgagggaggaggcgcaggtgaggcaggaggtgtaggtgaggtaggagcagcaggtgaggcaggaggcacaggtgaggcaggagcaacaggtgaggcaggagcagcaggtgaggcaggaggcgcaggtgaggcaggaggtgtaggtgaggcaggagcagcaggtgaggcaggaggcgcaggtgaggcaggagcagcaggtgagggaggagcagcaggtgaggcaggaggcgcaggtgaggcaggaggtgtaggtgaggcaggagcagcaggtgaggcaggaggcgcaggtgaggcaggaggtgtaggtgaggcaggagcagcaggtgaggcaggaggcgcaggtgaggcaggagcagcaggtgaggcaggaggcgcaggtgagggaagagcagcaggtgaggcaggagcagcaggtgaggcaggagctgtgggtgaggcaggagcagcaggtgaggcaggagctgtgggtgaggcaggagctgcaggtgaggcaggagctgtgggtgaagcaggagggacaaatgtaacaaaagcctgggtccagccttggcgctgcaccctacagcctgtgctggaaaacagggcctaccgggaattgagacccttttccaggagggagcagccaggctgcgaggaagagtcctttgagagctgggtggagcatgccaaggatatgctgcagctgtggtgccatgcgtcggaaagggagaagaagaggtggctgctggagagc

SEQ ID NO: 5230 - DNA, 1886 bp, human
atggctctggcgatgcttcgggactggtgcaggtggatgggtgcgaacgcagagcgctccctgctcatcctgggtatccctgatgactgcaaggaacatgagttccaggaggccgtgcgggctgccctgtcgcccctgggcaggtaccgagtactcaccaagcacttcagaaaggagctcggggccaaggcagccttggtggagttcgctgagtatttaaaccgaagcttgattccccatcaaataccaggcaatggggggccctggaaagtgatcttcctgccccaagtacctgttattgagtttcaggatatgcccagttttcctgcacagccccagggtcaagcagtagcaaaagctgcaggtgagggaggaggcgcaggtgaggcaggaggtgtaggtgaggtaggagcagcaggtgaggcaggaggcacaggtgaggcaggagcaacaggtgaggcaggagcagcaggtgaggcaggaggcgcaggtgaggcaggaggtgtaggtgaggcaggagcagcaggtgaggcaggaggcgcaggtgaggcaggagcagcaggtgagggaggagcagcaggtgaggcaggaggcgcaggtgaggcaggaggtgtaggtgaggcaggagcagcaggtgaggcaggaggcgcaggtgaggcaggaggtgtaggtgaggcaggagcagcaggtgaggcaggaggcgcaggtgaggcaggagcagcaggtgaggcaggaggcgcaggtgagggaagagcagcaggtgaggcaggagcagcaggtgaggcaggagctgtgggtgaggcaggagcagcaggtgaggcaggagctgtgggtgaggcaggagctgcaggtgaggcaggagctgtgggtgaagcaggagggacaaatgtaacaaaagcctgggtccagccttggcgctgcaccctacagcctgtgctggaaaacagggcctaccgggaattgagacccttttccaggagggagcagccaggctgcgaggaagagtcctttgagagctgggtggagcatgccaaggatatgctgcagctgtggtgccatgcgtcggaaagggagaagaagaggtggctgctggagagcttgggcggcccggccctggaagtcgtgagcggcctcctggaggaagataccaacttgtccgcgctggactgcctggcggcgctggggcaggtatttaggaaccaggacactcgaatgacttcgaggctgaagttcctgacctgcacgcaggggccccaggaggggctgtttgccttcgtggtgcgcctggaaggcctgctgcagagggctgtggagaagggggccgtctgcccagccttggccaattacctgcgactacagcaggtgctgtcttgggcccgccccagcgaggcactccaggataccctgagagggatgcagctggagaagaggccacctggcttcctggggctgctccggctcatccgggagatggaggcatgggcagccttcccagcgaggagccagcagggtgtggcctgggcagcggccccagtggagagtgaagacccagctgctgcccaggcctccccagcccaggggaatgccagcgaggctggtcccggagcagaagatgctgccgaggccgcttctgccaccaaagaggctgcaaggggagcccctgccgctggggaaggtgaaagtgcccctgcaggccccgaaggcctaggtcaggcaaggcccatagaggtcccctggggctcctccccagcccggatgagcagtgctgtctgggtgttcccaagaggtcttagctggggtccagagggcctcatccaggtgagaggccaggaagccaggaaacccccactggaggggctccagaccatcttggaggagccggaaaa

SEQ ID NO: 5231 - DNA, 11633 bp, human
tgcccaggagtgagtagctgctttcggtccgccggacacaccggacagatagacgtgcggacggcccaccaccccagcccgccaactagtcagcctgcgcctggcgcctcccctctccaggtagggctggcttcaagctgcctcctcagcaacccagagatgcccctggctctgctgcctccgctgtcccaagccctggtcctgctgtccccagtgccgcgagggtgtccacagatttccccggtgctctctgtaggctgctgatccacgccccttcatcgccaccctgcggcccccttggtccctgtcaggcttctgcctcgtctcgccgccctccaggcacctttccctcaccccttcctctccctctcccttctgaccttgctctgcttcatccacctcttgtctctctgcctcccgctcggggtccgtcttcttggctaccaccctagagcgtggctgggtgactggtaccccagctttgccaatggccctgtttcatcattgcaagtcccaggcgcatgctccactccctcagcctcgctctgcccaggcgcctccttgctccagggcttggcgcctggcccgggttgggtcggatcggggaggaccgcccagcgcccaccgagctcagcacccaggagcagtcctccgctgcactgcctgaggccagtccttggcatgggctgaaagacttagtttcccaggcacaccccaggcaccctgcccagatgttcctcgctcgctcacccccaggttaatgctctgcctctacatcctctgtgagaagtctgggtcctgggagccctggctgcaagggccctgactgggggtgcctgggtggctcagccctgtctgtttccaggacccccttggactgggactcagaatgggtgtggaggggaaggagagaaaatcaggcaactgtgccatgctccccagggcggacctggcttggggtcccagaggggcctgccaagggacccaggagagggagcgagagagtgccctggaaggcccacggaggggagcgccccctcactgctccatgggcggggctgggtgcctgagcgcctgctgagcagagcagggggcccagggatctgcagggcacagggtacatcagtctccagtggtctgtcttggtgggcaggcctctctcctgctgtcctggctgccagactgctcaggtcccatcctcagggggtcctgtttctgggccctcgcccctccctggcctgccagctctctgccctatagcaactaattggaactgagacaagctggagatgctcagcccccctgcccccgtgccagaaaggctcccggggaccagcgcccaggggtgcgggtgagcacctcctggtgacacccagccgccggtgccagccgcaccccaggagagctggtgtatgagcatggatgtcttggtgcggagcatgcccatgtatggccactgtgggccagcatggtgagcctttgagggcaagcccgtgtgggtatattgaaaggaagatgcagggctgcctccaagccaccagggctgggcggtgggagcaggttgcgagccagggagcagagagggctcccatggcaagctggccagctgtgggtggcagccctggcctccctggcccaccttcaagccccaaggacccgtacggcagtgggcattaaccctaccaacgcatagatggggagtctgggaaaggaaggggggtgtttccaaggcaagaatgagtttcctgtctttagcaacattccagagtcactcaaacaaagctatagcgtgtcccttccagtgacagcgccaagtccccagaggaggggtttgtaatgagttcacacttgacagttagcactcagagccttcagcaagggcttctgagtccttgccaccccgtatagaggtgggatgaggacctccccacctgccgtctcctgtgcttcccgggcccaccccccaccccccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacccctgcttgtcggaaatgtcttcccatgcccaccacgaccccctcccactcatctgtgggccggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttcccagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgtggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccagaagatcccctccaccacttgaatcccacagccagaagccccttctgggactctagactcctgggaaccatcccagctgcccccttcgctgtttcgctgtttgccttcttcccctgccccgtcatggctctaggtcagagcagcctctggggtggctatggaggggccaccagccttggctcttccgaggactgcagaaccctcccactcccagcttcccacctgcgcagctctgatcccagccagcccaaggggcagggtcaggtcccggctccctggcaggcctggtgaaggtgctgcccattcccatgaggctcatctctgaggcttaggggcctggggctctagccagccttcttgcatggaactctcctggtccactgcatcttaagcctgagctccacttaaacactggcctgagataagctggaggaccaggggcccaacggactctgtgggcctcttgaacttgcctctgctggccatcccagtcctgtttggtccctgaggtgttcagatgggccaaggggagcatggcgggcagactcctgggtggccagaagattagaaggcagccctgtccctggaggcaggggaagtctgggaagccagtgtgacttctatcctctggaagtctgagtccctgcttggccttgactgccatcccatggttcttggaggctgccctcatgcaaagagacacacacccatgggagcccagcagtcccaggagcctgaagctaagcaggctgtgggccaccctggctggctgaaggaggctaatcccagcccagcctgagcccccggcagagagcgggttgcggcagggaggggctgcaggaaaccttcccctcccctcctggccttggtgggcctgtaccagggagggagggaggcagggccccaggctctggggggcaggccgggaacaccttccctggggccctgaagtgctcgcctggggagacgatggcttttccaggagactccctgcagacagaggcagaggtgagaggctgggcgggggctgccctgctggctgtgttggggctgaggaggggcttctggatctgtgggccatagggagctactgatggtcctcagaagggccatgcttccaggggagccccctgcacagccccgagagtgtgaagcgtgtcagctttggggcctgtggcactgtgtgcattgggagagggtgggtccagacatgggggcaaggacacagacggacagacagacagtgtgtgcagccccagctctgctgtttcctcaccgtgtggccttgggcaagagtttggggccaacttcctgagcctcagtttaccccttcatcaagttctaagagcattgcttccttcttatagtcaacgggggacggcaggatgctaagtaaagaaatcacatgagtcccctgctctgcctctgagaggtgacagcatcctcccttttccttggagactctagcaggaggccccggatctcttcggagagtgggagggggcagcagtagtccgtgtgcagaggaccaggagcgcacagtgggaagggctgagtcccgcactccgccgactgtggggacaggctggaccttgacatgggcgccacaggctgcaaagggctggcacagagaggtgggaggtggctgggcgcatcaagggagaactccacccttgtcgccaccctgccagaaaacctctggaaaggatttgagcagcagatgagccggggtttcccagcccctccacacgtggctgcaaggggagcagacgcccaagcgtggctgcctgaagggcatgctccggcaacggcaggggcttggaatgtggcacaaggtccacccctccccactccagcccccagcccctcaggcagccactcccacagatgaacgcacacgccgggctttggcaaggccagggagggtacacatcccctctctggttgatgcccaagtacaggctggagccatcggcggggagggactggtggactggggcctgggagagtggcagggggcaggccgggtgtcagcgggggcacaagcaccaggctgctggttgaaactgggcccaaaaggctttggaggccagaggggaggggaggaaggacacagtcccggggaccccgcagggctgcgtggaaggtggcacatgtgtcagagttcaggtcgggttgctcaggggggcagacgcccagggctgaggctgcggagacagcatccggcgtctgccacttggcagctgtgagccacaccatctgcaggcgagctcccagggcccgccagacctcaagccctgctcccgccgcccttggcctggcctgaatgcctggcacggaccctccatgttctcagaggctgccaacgcatcttgtttggctgtgacctcgagcaatccagtgcagaggactgcgctagctttcagaggggcagacaaggagggccctattggggtggtggcggaggctccaggaagcccagcctcctccctcactcacacctgcggtcgccaaacctggggcttatgccattgccgcccctgtcctttgctctaaagagatggtatccagggagctcagggcacactttggtggggcttgaaaccctccctgaagtccctgaagacacacccagagaggccaatgaagggaaactgaggcccagaggcctcagttgtggtggtggagagttgaggactggagggacttgctgtgggtctcacaggatctgactatggggtattcctgcttcctgggctggggtccccgcctgccttatctatgtgtggatatatgtgtatgtatgtgtatatgtatacatatgtatatgtgaatgtgtgtatgcatgtgtgtatagatgtgtgcatgtatgtgtgtacatatgtgtatgcgtgtatacaggtgtatatgtgcaggtatgtatgtatgtatgtgtgcatgtatgcatgtgtgtgtgtgtgtacgtgtgtataaatgtgtatgtgtgcgtgtgtgtgcatgtgtgtgcatgtgtgtatgtgtgcatgtgtgcatgtgtgtatacatgcatgcatgtgcgcatgtggatgtacatgtgcatgtatgtgtatagatgtgtgcatgagtgtgtgtgcatctgtgtatatatgtgtgtatatgtgtatcatatgtgtatgtgaatgtgtatacatgggtatgcatgtgtgagtgtctaggtgtgtgcatgtatatgtgtgtacatgtgtgtataggtgtgtgcacgtatatgtgtggatgtgtgcatgtatgtggatgcatgtggatgtgtgtacatatgtgttttgtataggtgtgtgcatgtgtgtgtgcacgtgtgtacatatgtgttttgtataggtgtgtgcgtgtgcacgtgtgtgtatgtgagcgtgtatgtgtgcatctgtgtgtgtgtttgtgtgtgtatgtgtgtacgtgtgtgtgtgtgcatgttctggcaggagggaggggcttggtgtgaggtggtggggagaaggcaggggccaggctttgggaggacagctgagcctatactgccaggacctcccaaactgccacccccagtcttgggcattcaggctctcacaggcccagagacatggctggagccctgtggctgaggagcacagctgagagctcaggcggggcctggaggcgccaaagctgagttccaagtcaggctgagtgacttgggagaaatcagagcctctctctcggccttagcttttgtgtccataaaatggggatactcatcaggccagctccaggggatcctatccttccccccaggctcccctggctccctctgacttcatgggccccttgctgcctcctgtgggctcagacacggagcctgccccttcctcgggagaggtctcagttttgtgccagttctttgaggggaaatgagggatgtgccgggaagcctgcccggcccccgcccctccagcctgcccactgcttgggcacagccatgagccatggaaaaccagccaaaccttgtccttctgcctctgtcacggggcccgggtgtatgggccttccagccctcagcctccctccccgctctgagggaacctcttccccttgcccctttctcagtctcttggagaccccccagacatcctactgtatcaggcagcctgcctccagagccctcgttgccccacagctggtcccgggaacccgcctgagaccccgatggccagtcttgccgtgactggcctgccctgtgcctgtgccccctgccctggtggagggcccgattccctaacaggagggcctgcagggaagtcccagctcctggggagaccccttgccccggggcaggagtccctgtagagtcctcctccaggccaatgcgtgggtcctggggggctccaagctggccatggtcagatggtcctctgtcccctcggccttccccagcccctccccacagcctcccgtaggcccagccggaccaccccaaccctacctgtccaggtggactgcccaccctggagcttgccagggctctggcggggtgtcccagccctgactcactctccctgggaggtagcggctttggcaggggcatcggcaaggaggggcagggcagtctcctccctcccccactccatcttgctctcctgcttccaccctgcccttcctgttctctcccactgctcctcctcctcctcctccttctgcccccgggtgtccactggcactgggagagggtcctacagcggcagcaggcatcggaggccctgccctgccctggaggaagggaaacaccatccaggtaggtgagtgttgagccttctccctacttgggggccaagaccctccgggcggttcccctaggttctgctgggccggcctgaggctggcaggccctgggctgcaactgtgggatctcaaggctcaaaagaatgagggaggctcggtgctgccccagcaggggcctcctggtgaccccaggggtcagcatgaagtccagctccacatgagggggaagctgagctaagccttgggctccgactcccactttgcagtgtggcccagggcctgtgggctcaggagggctccggggctggctgcggaaaggccactccacaggcctggcagccgctatagccacagcctcaccacaggcccctctgtccacaggtgtgggagggcgcatgggtggcttctaggggggatgccaatgcaggggggacgcgtgccagcagatgctccctggagcacccgaggagctgcatgggggcgacaggacaggcctccatcccaaccctctcctgggcttgtgctcagacccaacctggccctgaagtggcctcaggcccccggcccgctggtagcaaggactccaaagcggcagccccgggcagccagcccagcccccagggcaactggggaagcatcgggcagggcggggctgctcatagggtgctggcctgggggcagagcccccacctccccacggcctccttagacccctgcaaccagcagctgggcttagggggctcacctcgctctgctggagccccagacagcccctccccagctagtactggccctaagtgagggtctcctgggcgtgcgactgcttcaggtctgccagaggcccctgctgcccagctgggctccccatctccagatgcaccgagggccaccccaggctgggtggcaagcagggcaggcatgtttattcccacttaacagatggggaaggtgaggctgggatgagacctgggcctttgctggagagtcagggtggatgaagtggtgagagaggcagggctccagcctcttcctgtagggcacattcccggctgcctctggacgggagaccgtgtctgatgaggagggaggaggcaagcagaggtgggtgctgggggcaggctcgggcagggctgcttcgcctccactcccactcgccgcctcggcctggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggataccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcagaggcgtgggggcctgcagacttgctgatgaggagacatttcatcgcctgattaagccaagtcctgtccgggatggggaggggggtagtggaagcagtgaagggagtggagtggagggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaaggggacacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggcttggagcggcaaggcagtggtggcactgctggggctcaggaccgggcctgggtgctgcctcctgccctgcactctgctcacaagcatggactgaacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgact

SEQ ID NO: 5232 - DNA, 14615 bp, human
ctgcccagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtagggctggcttcaagctgcctcctcagcaacccagagatgcccctggctctgctgcctccgctgtcccaagccctggtcctgctgtccccagtgccgcgagggtgtccacagatttccccggtgctctctgtaggctgctgatccacgccccttcatcgccaccctgcggcccccttggtccctgtcaggcttctgcctcgtctcgccgccctccaggcacctttccctcaccccttcctctccctctcccttctgaccttgctctgcttcatccacctcttgtctctctgcctcccgctcggggtccgtcttcttggctaccaccctagagcgtggctgggtgactggtaccccagctttgccaatggccctgtttcatcattgcaagtcccaggcgcatgctccactccctcagcctcgctctgcccaggcgcctccttgctccagggcttggcgcctggcccgggttgggtcggatcggggaggaccgcccagcgcccaccgagctcagcacccaggagcagtcctccgctgcactgcctgaggccagtccttggcatgggctgaaagacttagtttcccaggcacaccccaggcaccctgcccagatgttcctcgctcgctcacccccaggttaatgctctgcctctacatcctctgtgagaagtctgggtcctgggagccctggctgcaagggccctgactgggggtgcctgggtggctcagccctgtctgtttccaggacccccttggactgggactcagaatgggtgtggaggggaaggagagaaaatcaggcaactgtgccatgctccccagggcggacctggcttggggtcccagaggggcctgccaagggacccaggagagggagcgagagagtgccctggaaggcccacggaggggagcgccccctcactgctccatgggcggggctgggtgcctgagcgcctgctgagcagagcagggggcccagggatctgcagggcacagggtacatcagtctccagtggtctgtcttggtgggcaggcctctctcctgctgtcctggctgccagactgctcaggtcccatcctcagggggtcctgtttctgggccctcgcccctccctggcctgccagctctctgccctatagcaactaattggaactgagacaagctggagatgctcagcccccctgcccccgtgccagaaaggctcccggggaccagcgcccaggggtgcgggtgagcacctcctggtgacacccagccgccggtgccagccgcaccccaggagagctggtgtatgagcatggatgtcttggtgcggagcatgcccatgtatggccactgtgggccagcatggtgagcctttgagggcaagcccgtgtgggtatattgaaaggaagatgcagggctgcctccaagccaccagggctgggcggtgggagcaggttgcgagccagggagcagagagggctcccatggcaagctggccagctgtgggtggcagccctggcctccctggcccaccttcaagccccaaggacccgtacggcagtgggcattaaccctaccaacgcatagatggggagtctgggaaaggaaggggggtgtttccaaggcaagaatgagtttcctgtctttagcaacattccagagtcactcaaacaaagctatagcgtgtcccttccagtgacagcgccaagtccccagaggaggggtttgtaatgagttcacacttgacagttagcactcagagccttcagcaagggcttctgagtccttgccaccccgtatagaggtgggatgaggacctccccacctgccgtctcctgtgcttcccgggcccaccccccaccccccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacccctgcttgtcggaaatgtcttcccatgcccaccacgaccccctcccactcatctgtgggccggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttcccagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgtggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccagaagatcccctccaccacttgaatcccacagccagaagccccttctgggactctagactcctgggaaccatcccagctgcccccttcgctgtttcgctgtttgccttcttcccctgccccgtcatggctctaggtcagagcagcctctggggtggctatggaggggccaccagccttggctcttccgaggactgcagaaccctcccactcccagcttcccacctgcgcagctctgatcccagccagcccaaggggcagggtcaggtcccggctccctggcaggcctggtgaaggtgctgcccattcccatgaggctcatctctgaggcttaggggcctggggctctagccagccttcttgcatggaactctcctggtccactgcatcttaagcctgagctccacttaaacactggcctgagataagctggaggaccaggggcccaacggactctgtgggcctcttgaacttgcctctgctggccatcccagtcctgtttggtccctgaggtgttcagatgggccaaggggagcatggcgggcagactcctgggtggccagaagattagaaggcagccctgtccctggaggcaggggaagtctgggaagccagtgtgacttctatcctctggaagtctgagtccctgcttggccttgactgccatcccatggttcttggaggctgccctcatgcaaagagacacacacccatgggagcccagcagtcccaggagcctgaagctaagcaggctgtgggccaccctggctggctgaaggaggctaatcccagcccagcctgagcccccggcagagagcgggttgcggcagggaggggctgcaggaaaccttcccctcccctcctggccttggtgggcctgtaccagggagggagggaggcagggccccaggctctggggggcaggccgggaacaccttccctggggccctgaagtgctcgcctggggagacgatggcttttccaggagactccctgcagacagaggcagaggtgagaggctgggcgggggctgccctgctggctgtgttggggctgaggaggggcttctggatctgtgggccatagggagctactgatggtcctcagaagggccatgcttccaggggagccccctgcacagccccgagagtgtgaagcgtgtcagctttggggcctgtggcactgtgtgcattgggagagggtgggtccagacatgggggcaaggacacagacggacagacagacagtgtgtgcagccccagctctgctgtttcctcaccgtgtggccttgggcaagagtttggggccaacttcctgagcctcagtttaccccttcatcaagttctaagagcattgcttccttcttatagtcaacgggggacggcaggatgctaagtaaagaaatcacatgagtcccctgctctgcctctgagaggtgacagcatcctcccttttccttggagactctagcaggaggccccggatctcttcggagagtgggagggggcagcagtagtccgtgtgcagaggaccaggagcgcacagtgggaagggctgagtcccgcactccgccgactgtggggacaggctggaccttgacatgggcgccacaggctgcaaagggctggcacagagaggtgggaggtggctgggcgcatcaagggagaactccacccttgtcgccaccctgccagaaaacctctggaaaggatttgagcagcagatgagccggggtttcccagcccctccacacgtggctgcaaggggagcagacgcccaagcgtggctgcctgaagggcatgctccggcaacggcaggggcttggaatgtggcacaaggtccacccctccccactccagcccccagcccctcaggcagccactcccacagatgaacgcacacgccgggctttggcaaggccagggagggtacacatcccctctctggttgatgcccaagtacaggctggagccatcggcggggagggactggtggactggggcctgggagagtggcagggggcaggccgggtgtcagcgggggcacaagcaccaggctgctggttgaaactgggcccaaaaggctttggaggccagaggggaggggaggaaggacacagtcccggggaccccgcagggctgcgtggaaggtggcacatgtgtcagagttcaggtcgggttgctcaggggggcagacgcccagggctgaggctgcggagacagcatccggcgtctgccacttggcagctgtgagccacaccatctgcaggcgagctcccagggcccgccagacctcaagccctgctcccgccgcccttggcctggcctgaatgcctggcacggaccctccatgttctcagaggctgccaacgcatcttgtttggctgtgacctcgagcaatccagtgcagaggactgcgctagctttcagaggggcagacaaggagggccctattggggtggtggcggaggctccaggaagcccagcctcctccctcactcacacctgcggtcgccaaacctggggcttatgccattgccgcccctgtcctttgctctaaagagatggtatccagggagctcagggcacactttggtggggcttgaaaccctccctgaagtccctgaagacacacccagagaggccaatgaagggaaactgaggcccagaggcctcagttgtggtggtggagagttgaggactggagggacttgctgtgggtctcacaggatctgactatggggtattcctgcttcctgggctggggtccccgcctgccttatctatgtgtggatatatgtgtatgtatgtgtatatgtatacatatgtatatgtgaatgtgtgtatgcatgtgtgtatagatgtgtgcatgtatgtgtgtacatatgtgtatgcgtgtatacaggtgtatatgtgcaggtatgtatgtatgtatgtgtgcatgtatgcatgtgtgtgtgtgtgtacgtgtgtataaatgtgtatgtgtgcgtgtgtgtgcatgtgtgtgcatgtgtgtatgtgtgcatgtgtgcatgtgtgtatacatgcatgcatgtgcgcatgtggatgtacatgtgcatgtatgtgtatagatgtgtgcatgagtgtgtgtgcatctgtgtatatatgtgtgtatatgtgtatcatatgtgtatgtgaatgtgtatacatgggtatgcatgtgtgagtgtctaggtgtgtgcatgtatatgtgtgtacatgtgtgtataggtgtgtgcacgtatatgtgtggatgtgtgcatgtatgtggatgcatgtggatgtgtgtacatatgtgttttgtataggtgtgtgcatgtgtgtgtgcacgtgtgtacatatgtgttttgtataggtgtgtgcgtgtgcacgtgtgtgtatgtgagcgtgtatgtgtgcatctgtgtgtgtgtttgtgtgtgtatgtgtgtacgtgtgtgtgtgtgcatgttctggcaggagggaggggcttggtgtgaggtggtggggagaaggcaggggccaggctttgggaggacagctgagcctatactgccaggacctcccaaactgccacccccagtcttgggcattcaggctctcacaggcccagagacatggctggagccctgtggctgaggagcacagctgagagctcaggcggggcctggaggcgccaaagctgagttccaagtcaggctgagtgacttgggagaaatcagagcctctctctcggccttagcttttgtgtccataaaatggggatactcatcaggccagctccaggggatcctatccttccccccaggctcccctggctccctctgacttcatgggccccttgctgcctcctgtgggctcagacacggagcctgccccttcctcgggagaggtctcagttttgtgccagttctttgaggggaaatgagggatgtgccgggaagcctgcccggcccccgcccctccagcctgcccactgcttgggcacagccatgagccatggaaaaccagccaaaccttgtccttctgcctctgtcacggggcccgggtgtatgggccttccagccctcagcctccctccccgctctgagggaacctcttccccttgcccctttctcagtctcttggagaccccccagacatcctactgtatcaggcagcctgcctccagagccctcgttgccccacagctggtcccgggaacccgcctgagaccccgatggccagtcttgccgtgactggcctgccctgtgcctgtgccccctgccctggtggagggcccgattccctaacaggagggcctgcagggaagtcccagctcctggggagaccccttgccccggggcaggagtccctgtagagtcctcctccaggccaatgcgtgggtcctggggggctccaagctggccatggtcagatggtcctctgtcccctcggccttccccagcccctccccacagcctcccgtaggcccagccggaccaccccaaccctacctgtccaggtggactgcccaccctggagcttgccagggctctggcggggtgtcccagccctgactcactctccctgggaggtagcggctttggcaggggcatcggcaaggaggggcagggcagtctcctccctcccccactccatcttgctctcctgcttccaccctgcccttcctgttctctcccactgctcctcctcctcctcctccttctgcccccgggtgtccactggcactgggagagggtcctacagcggcagcaggcatcggaggccctgccctgccctggaggaagggaaacaccatccaggtaggtgagtgttgagccttctccctacttgggggccaagaccctccgggcggttcccctaggttctgctgggccggcctgaggctggcaggccctgggctgcaactgtgggatctcaaggctcaaaagaatgagggaggctcggtgctgccccagcaggggcctcctggtgaccccaggggtcagcatgaagtccagctccacatgagggggaagctgagctaagccttgggctccgactcccactttgcagtgtggcccagggcctgtgggctcaggagggctccggggctggctgcggaaaggccactccacaggcctggcagccgctatagccacagcctcaccacaggcccctctgtccacaggtgtgggagggcgcatgggtggcttctaggggggatgccaatgcaggggggacgcgtgccagcagatgctccctggagcacccgaggagctgcatgggggcgacaggacaggcctccatcccaaccctctcctgggcttgtgctcagacccaacctggccctgaagtggcctcaggcccccggcccgctggtagcaaggactccaaagcggcagccccgggcagccagcccagcccccagggcaactggggaagcatcgggcagggcggggctgctcatagggtgctggcctgggggcagagcccccacctccccacggcctccttagacccctgcaaccagcagctgggcttagggggctcacctcgctctgctggagccccagacagcccctccccagctagtactggccctaagtgagggtctcctgggcgtgcgactgcttcaggtctgccagaggcccctgctgcccagctgggctccccatctccagatgcaccgagggccaccccaggctgggtggcaagcagggcaggcatgtttattcccacttaacagatggggaaggtgaggctgggatgagacctgggcctttgctggagagtcagggtggatgaagtggtgagagaggcagggctccagcctcttcctgtagggcacattcccggctgcctctggacgggagaccgtgtctgatgaggagggaggaggcaagcagaggtgggtgctgggggcaggctcgggcagggctgcttcgcctccactcccactcgccgcctcggcctggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggataccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcagaggcgtgggggcctgcagacttgctgatgaggagacatttcatcgcctgattaagccaagtcctgtccgggatggggaggggggtagtggaagcagtgaagggagtggagtggagggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaaggggacacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggcttggagcggcaaggcagtggtggcactgctggggctcaggaccgggcctgggtgctgcctcctgccctgcactctgctcacaagcatggactgaacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatctgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgaccgcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtggctccgtg

SEQ ID NO: 5233 - DNA, 14563 bp, human
ctccacaaactgcccaggagtgagtagctgctttcggtccgccggacacaccggacagatagacgtgcggacggcccaccaccccagcccgccaactagtcagcctgcgcctggcgcctcccctctccaggtagggctggcttcaagctgcctcctcagcaacccagagatgcccctggctctgctgcctccgctgtcccaagccctggtcctgctgtccccagtgccgcgagggtgtccacagatttccccggtgctctctgtaggctgctgatccacgccccttcatcgccaccctgcggcccccttggtccctgtcaggcttctgcctcgtctcgccgccctccaggcacctttccctcaccccttcctctccctctcccttctgaccttgctctgcttcatccacctcttgtctctctgcctcccgctcggggtccgtcttcttggctaccaccctagagcgtggctgggtgactggtaccccagctttgccaatggccctgtttcatcattgcaagtcccaggcgcatgctccactccctcagcctcgctctgcccaggcgcctccttgctccagggcttggcgcctggcccgggttgggtcggatcggggaggaccgcccagcgcccaccgagctcagcacccaggagcagtcctccgctgcactgcctgaggccagtccttggcatgggctgaaagacttagtttcccaggcacaccccaggcaccctgcccagatgttcctcgctcgctcacccccaggttaatgctctgcctctacatcctctgtgagaagtctgggtcctgggagccctggctgcaagggccctgactgggggtgcctgggtggctcagccctgtctgtttccaggacccccttggactgggactcagaatgggtgtggaggggaaggagagaaaatcaggcaactgtgccatgctccccagggcggacctggcttggggtcccagaggggcctgccaagggacccaggagagggagcgagagagtgccctggaaggcccacggaggggagcgccccctcactgctccatgggcggggctgggtgcctgagcgcctgctgagcagagcagggggcccagggatctgcagggcacagggtacatcagtctccagtggtctgtcttggtgggcaggcctctctcctgctgtcctggctgccagactgctcaggtcccatcctcagggggtcctgtttctgggccctcgcccctccctggcctgccagctctctgccctatagcaactaattggaactgagacaagctggagatgctcagcccccctgcccccgtgccagaaaggctcccggggaccagcgcccaggggtgcgggtgagcacctcctggtgacacccagccgccggtgccagccgcaccccaggagagctggtgtatgagcatggatgtcttggtgcggagcatgcccatgtatggccactgtgggccagcatggtgagcctttgagggcaagcccgtgtgggtatattgaaaggaagatgcagggctgcctccaagccaccagggctgggcggtgggagcaggttgcgagccagggagcagagagggctcccatggcaagctggccagctgtgggtggcagccctggcctccctggcccaccttcaagccccaaggacccgtacggcagtgggcattaaccctaccaacgcatagatggggagtctgggaaaggaaggggggtgtttccaaggcaagaatgagtttcctgtctttagcaacattccagagtcactcaaacaaagctatagcgtgtcccttccagtgacagcgccaagtccccagaggaggggtttgtaatgagttcacacttgacagttagcactcagagccttcagcaagggcttctgagtccttgccaccccgtatagaggtgggatgaggacctccccacctgccgtctcctgtgcttcccgggcccaccccccaccccccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacccctgcttgtcggaaatgtcttcccatgcccaccacgaccccctcccactcatctgtgggccggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttcccagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgtggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccagaagatcccctccaccacttgaatcccacagccagaagccccttctgggactctagactcctgggaaccatcccagctgcccccttcgctgtttcgctgtttgccttcttcccctgccccgtcatggctctaggtcagagcagcctctggggtggctatggaggggccaccagccttggctcttccgaggactgcagaaccctcccactcccagcttcccacctgcgcagctctgatcccagccagcccaaggggcagggtcaggtcccggctccctggcaggcctggtgaaggtgctgcccattcccatgaggctcatctctgaggcttaggggcctggggctctagccagccttcttgcatggaactctcctggtccactgcatcttaagcctgagctccacttaaacactggcctgagataagctggaggaccaggggcccaacggactctgtgggcctcttgaacttgcctctgctggccatcccagtcctgtttggtccctgaggtgttcagatgggccaaggggagcatggcgggcagactcctgggtggccagaagattagaaggcagccctgtccctggaggcaggggaagtctgggaagccagtgtgacttctatcctctggaagtctgagtccctgcttggccttgactgccatcccatggttcttggaggctgccctcatgcaaagagacacacacccatgggagcccagcagtcccaggagcctgaagctaagcaggctgtgggccaccctggctggctgaaggaggctaatcccagcccagcctgagcccccggcagagagcgggttgcggcagggaggggctgcaggaaaccttcccctcccctcctggccttggtgggcctgtaccagggagggagggaggcagggccccaggctctggggggcaggccgggaacaccttccctggggccctgaagtgctcgcctggggagacgatggcttttccaggagactccctgcagacagaggcagaggtgagaggctgggcgggggctgccctgctggctgtgttggggctgaggaggggcttctggatctgtgggccatagggagctactgatggtcctcagaagggccatgcttccaggggagccccctgcacagccccgagagtgtgaagcgtgtcagctttggggcctgtggcactgtgtgcattgggagagggtgggtccagacatgggggcaaggacacagacggacagacagacagtgtgtgcagccccagctctgctgtttcctcaccgtgtggccttgggcaagagtttggggccaacttcctgagcctcagtttaccccttcatcaagttctaagagcattgcttccttcttatagtcaacgggggacggcaggatgctaagtaaagaaatcacatgagtcccctgctctgcctctgagaggtgacagcatcctcccttttccttggagactctagcaggaggccccggatctcttcggagagtgggagggggcagcagtagtccgtgtgcagaggaccaggagcgcacagtgggaagggctgagtcccgcactccgccgactgtggggacaggctggaccttgacatgggcgccacaggctgcaaagggctggcacagagaggtgggaggtggctgggcgcatcaagggagaactccacccttgtcgccaccctgccagaaaacctctggaaaggatttgagcagcagatgagccggggtttcccagcccctccacacgtggctgcaaggggagcagacgcccaagcgtggctgcctgaagggcatgctccggcaacggcaggggcttggaatgtggcacaaggtccacccctccccactccagcccccagcccctcaggcagccactcccacagatgaacgcacacgccgggctttggcaaggccagggagggtacacatcccctctctggttgatgcccaagtacaggctggagccatcggcggggagggactggtggactggggcctgggagagtggcagggggcaggccgggtgtcagcgggggcacaagcaccaggctgctggttgaaactgggcccaaaaggctttggaggccagaggggaggggaggaaggacacagtcccggggaccccgcagggctgcgtggaaggtggcacatgtgtcagagttcaggtcgggttgctcaggggggcagacgcccagggctgaggctgcggagacagcatccggcgtctgccacttggcagctgtgagccacaccatctgcaggcgagctcccagggcccgccagacctcaagccctgctcccgccgcccttggcctggcctgaatgcctggcacggaccctccatgttctcagaggctgccaacgcatcttgtttggctgtgacctcgagcaatccagtgcagaggactgcgctagctttcagaggggcagacaaggagggccctattggggtggtggcggaggctccaggaagcccagcctcctccctcactcacacctgcggtcgccaaacctggggcttatgccattgccgcccctgtcctttgctctaaagagatggtatccagggagctcagggcacactttggtggggcttgaaaccctccctgaagtccctgaagacacacccagagaggccaatgaagggaaactgaggcccagaggcctcagttgtggtggtggagagttgaggactggagggacttgctgtgggtctcacaggatctgactatggggtattcctgcttcctgggctggggtccccgcctgccttatctatgtgtggatatatgtgtatgtatgtgtatatgtatacatatgtatatgtgaatgtgtgtatgcatgtgtgtatagatgtgtgcatgtatgtgtgtacatatgtgtatgcgtgtatacaggtgtatatgtgcaggtatgtatgtatgtatgtgtgcatgtatgcatgtgtgtgtgtgtgtacgtgtgtataaatgtgtatgtgtgcgtgtgtgtgcatgtgtgtgcatgtgtgtatgtgtgcatgtgtgcatgtgtgtatacatgcatgcatgtgcgcatgtggatgtacatgtgcatgtatgtgtatagatgtgtgcatgagtgtgtgtgcatctgtgtatatatgtgtgtatatgtgtatcatatgtgtatgtgaatgtgtatacatgggtatgcatgtgtgagtgtctaggtgtgtgcatgtatatgtgtgtacatgtgtgtataggtgtgtgcacgtatatgtgtggatgtgtgcatgtatgtggatgcatgtggatgtgtgtacatatgtgttttgtataggtgtgtgcatgtgtgtgtgcacgtgtgtacatatgtgttttgtataggtgtgtgcgtgtgcacgtgtgtgtatgtgagcgtgtatgtgtgcatctgtgtgtgtgtttgtgtgtgtatgtgtgtacgtgtgtgtgtgtgcatgttctggcaggagggaggggcttggtgtgaggtggtggggagaaggcaggggccaggctttgggaggacagctgagcctatactgccaggacctcccaaactgccacccccagtcttgggcattcaggctctcacaggcccagagacatggctggagccctgtggctgaggagcacagctgagagctcaggcggggcctggaggcgccaaagctgagttccaagtcaggctgagtgacttgggagaaatcagagcctctctctcggccttagcttttgtgtccataaaatggggatactcatcaggccagctccaggggatcctatccttccccccaggctcccctggctccctctgacttcatgggccccttgctgcctcctgtgggctcagacacggagcctgccccttcctcgggagaggtctcagttttgtgccagttctttgaggggaaatgagggatgtgccgggaagcctgcccggcccccgcccctccagcctgcccactgcttgggcacagccatgagccatggaaaaccagccaaaccttgtccttctgcctctgtcacggggcccgggtgtatgggccttccagccctcagcctccctccccgctctgagggaacctcttccccttgcccctttctcagtctcttggagaccccccagacatcctactgtatcaggcagcctgcctccagagccctcgttgccccacagctggtcccgggaacccgcctgagaccccgatggccagtcttgccgtgactggcctgccctgtgcctgtgccccctgccctggtggagggcccgattccctaacaggagggcctgcagggaagtcccagctcctggggagaccccttgccccggggcaggagtccctgtagagtcctcctccaggccaatgcgtgggtcctggggggctccaagctggccatggtcagatggtcctctgtcccctcggccttccccagcccctccccacagcctcccgtaggcccagccggaccaccccaaccctacctgtccaggtggactgcccaccctggagcttgccagggctctggcggggtgtcccagccctgactcactctccctgggaggtagcggctttggcaggggcatcggcaaggaggggcagggcagtctcctccctcccccactccatcttgctctcctgcttccaccctgcccttcctgttctctcccactgctcctcctcctcctcctccttctgcccccgggtgtccactggcactgggagagggtcctacagcggcagcaggcatcggaggccctgccctgccctggaggaagggaaacaccatccaggtaggtgagtgttgagccttctccctacttgggggccaagaccctccgggcggttcccctaggttctgctgggccggcctgaggctggcaggccctgggctgcaactgtgggatctcaaggctcaaaagaatgagggaggctcggtgctgccccagcaggggcctcctggtgaccccaggggtcagcatgaagtccagctccacatgagggggaagctgagctaagccttgggctccgactcccactttgcagtgtggcccagggcctgtgggctcaggagggctccggggctggctgcggaaaggccactccacaggcctggcagccgctatagccacagcctcaccacaggcccctctgtccacaggtgtgggagggcgcatgggtggcttctaggggggatgccaatgcaggggggacgcgtgccagcagatgctccctggagcacccgaggagctgcatgggggcgacaggacaggcctccatcccaaccctctcctgggcttgtgctcagacccaacctggccctgaagtggcctcaggcccccggcccgctggtagcaaggactccaaagcggcagccccgggcagccagcccagcccccagggcaactggggaagcatcgggcagggcggggctgctcatagggtgctggcctgggggcagagcccccacctccccacggcctccttagacccctgcaaccagcagctgggcttagggggctcacctcgctctgctggagccccagacagcccctccccagctagtactggccctaagtgagggtctcctgggcgtgcgactgcttcaggtctgccagaggcccctgctgcccagctgggctccccatctccagatgcaccgagggccaccccaggctgggtggcaagcagggcaggcatgtttattcccacttaacagatggggaaggtgaggctgggatgagacctgggcctttgctggagagtcagggtggatgaagtggtgagagaggcagggctccagcctcttcctgtagggcacattcccggctgcctctggacgggagaccgtgtctgatgaggagggaggaggcaagcagaggtgggtgctgggggcaggctcgggcagggctgcttcgcctccactcccactcgccgcctcggcctggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggataccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcagaggcgtgggggcctgcagacttgctgatgaggagacatttcatcgcctgattaagccaagtcctgtccgggatggggaggggggtagtggaagcagtgaagggagtggagtggagggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaaggggacacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggcttggagcggcaaggcagtggtggcactgctggggctcaggaccgggcctgggtgctgcctcctgccctgcactctgctcacaagcatggactgaacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatctgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgaccgcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 5234 - DNA, 47850 bp, human; identical to SEQ ID NO: 3992

SEQ ID NO: 5235 - DNA, 13585 bp, human
gcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtagggctggcttcaagctgcctcctcagcaacccagagatgcccctggctctgctgcctccgctgtcccaagccctggtcctgctgtccccagtgccgcgagggtgtccacagatttccccggtgctctctgtaggctgctgatccacgccccttcatcgccaccctgcggcccccttggtccctgtcaggcttctgcctcgtctcgccgccctccaggcacctttccctcaccccttcctctccctctcccttctgaccttgctctgcttcatccacctcttgtctctctgcctcccgctcggggtccgtcttcttggctaccaccctagagcgtggctgggtgactggtaccccagctttgccaatggccctgtttcatcattgcaagtcccaggcgcatgctccactccctcagcctcgctctgcccaggcgcctccttgctccagggcttggcgcctggcccgggttgggtcggatcggggaggaccgcccagcgcccaccgagctcagcacccaggagcagtcctccgctgcactgcctgaggccagtccttggcatgggctgaaagacttagtttcccaggcacaccccaggcaccctgcccagatgttcctcgctcgctcacccccaggttaatgctctgcctctacatcctctgtgagaagtctgggtcctgggagccctggctgcaagggccctgactgggggtgcctgggtggctcagccctgtctgtttccaggacccccttggactgggactcagaatgggtgtggaggggaaggagagaaaatcaggcaactgtgccatgctccccagggcggacctggcttggggtcccagaggggcctgccaagggacccaggagagggagcgagagagtgccctggaaggcccacggaggggagcgccccctcactgctccatgggcggggctgggtgcctgagcgcctgctgagcagagcagggggcccagggatctgcagggcacagggtacatcagtctccagtggtctgtcttggtgggcaggcctctctcctgctgtcctggctgccagactgctcaggtcccatcctcagggggtcctgtttctgggccctcgcccctccctggcctgccagctctctgccctatagcaactaattggaactgagacaagctggagatgctcagcccccctgcccccgtgccagaaaggctcccggggaccagcgcccaggggtgcgggtgagcacctcctggtgacacccagccgccggtgccagccgcaccccaggagagctggtgtatgagcatggatgtcttggtgcggagcatgcccatgtatggccactgtgggccagcatggtgagcctttgagggcaagcccgtgtgggtatattgaaaggaagatgcagggctgcctccaagccaccagggctgggcggtgggagcaggttgcgagccagggagcagagagggctcccatggcaagctggccagctgtgggtggcagccctggcctccctggcccaccttcaagccccaaggacccgtacggcagtgggcattaaccctaccaacgcatagatggggagtctgggaaaggaaggggggtgtttccaaggcaagaatgagtttcctgtctttagcaacattccagagtcactcaaacaaagctatagcgtgtcccttccagtgacagcgccaagtccccagaggaggggtttgtaatgagttcacacttgacagttagcactcagagccttcagcaagggcttctgagtccttgccaccccgtatagaggtgggatgaggacctccccacctgccgtctcctgtgcttcccgggcccaccccccaccccccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacccctgcttgtcggaaatgtcttcccatgcccaccacgaccccctcccactcatctgtgggccggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttcccagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgtggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccagaagatcccctccaccacttgaatcccacagccagaagccccttctgggactctagactcctgggaaccatcccagctgcccccttcgctgtttcgctgtttgccttcttcccctgccccgtcatggctctaggtcagagcagcctctggggtggctatggaggggccaccagccttggctcttccgaggactgcagaaccctcccactcccagcttcccacctgcgcagctctgatcccagccagcccaaggggcagggtcaggtcccggctccctggcaggcctggtgaaggtgctgcccattcccatgaggctcatctctgaggcttaggggcctggggctctagccagccttcttgcatggaactctcctggtccactgcatcttaagcctgagctccacttaaacactggcctgagataagctggaggaccaggggcccaacggactctgtgggcctcttgaacttgcctctgctggccatcccagtcctgtttggtccctgaggtgttcagatgggccaaggggagcatggcgggcagactcctgggtggccagaagattagaaggcagccctgtccctggaggcaggggaagtctgggaagccagtgtgacttctatcctctggaagtctgagtccctgcttggccttgactgccatcccatggttcttggaggctgccctcatgcaaagagacacacacccatgggagcccagcagtcccaggagcctgaagctaagcaggctgtgggccaccctggctggctgaaggaggctaatcccagcccagcctgagcccccggcagagagcgggttgcggcagggaggggctgcaggaaaccttcccctcccctcctggccttggtgggcctgtaccagggagggagggaggcagggccccaggctctggggggcaggccgggaacaccttccctggggccctgaagtgctcgcctggggagacgatggcttttccaggagactccctgcagacagaggcagaggtgagaggctgggcgggggctgccctgctggctgtgttggggctgaggaggggcttctggatctgtgggccatagggagctactgatggtcctcagaagggccatgcttccaggggagccccctgcacagccccgagagtgtgaagcgtgtcagctttggggcctgtggcactgtgtgcattgggagagggtgggtccagacatgggggcaaggacacagacggacagacagacagtgtgtgcagccccagctctgctgtttcctcaccgtgtggccttgggcaagagtttggggccaacttcctgagcctcagtttaccccttcatcaagttctaagagcattgcttccttcttatagtcaacgggggacggcaggatgctaagtaaagaaatcacatgagtcccctgctctgcctctgagaggtgacagcatcctcccttttccttggagactctagcaggaggccccggatctcttcggagagtgggagggggcagcagtagtccgtgtgcagaggaccaggagcgcacagtgggaagggctgagtcccgcactccgccgactgtggggacaggctggaccttgacatgggcgccacaggctgcaaagggctggcacagagaggtgggaggtggctgggcgcatcaagggagaactccacccttgtcgccaccctgccagaaaacctctggaaaggatttgagcagcagatgagccggggtttcccagcccctccacacgtggctgcaaggggagcagacgcccaagcgtggctgcctgaagggcatgctccggcaacggcaggggcttggaatgtggcacaaggtccacccctccccactccagcccccagcccctcaggcagccactcccacagatgaacgcacacgccgggctttggcaaggccagggagggtacacatcccctctctggttgatgcccaagtacaggctggagccatcggcggggagggactggtggactggggcctgggagagtggcagggggcaggccgggtgtcagcgggggcacaagcaccaggctgctggttgaaactgggcccaaaaggctttggaggccagaggggaggggaggaaggacacagtcccggggaccccgcagggctgcgtggaaggtggcacatgtgtcagagttcaggtcgggttgctcaggggggcagacgcccagggctgaggctgcggagacagcatccggcgtctgccacttggcagctgtgagccacaccatctgcaggcgagctcccagggcccgccagacctcaagccctgctcccgccgcccttggcctggcctgaatgcctggcacggaccctccatgttctcagaggctgccaacgcatcttgtttggctgtgacctcgagcaatccagtgcagaggactgcgctagctttcagaggggcagacaaggagggccctattggggtggtggcggaggctccaggaagcccagcctcctccctcactcacacctgcggtcgccaaacctggggcttatgccattgccgcccctgtcctttgctctaaagagatggtatccagggagctcagggcacactttggtggggcttgaaaccctccctgaagtccctgaagacacacccagagaggccaatgaagggaaactgaggcccagaggcctcagttgtggtggtggagagttgaggactggagggacttgctgtgggtctcacaggatctgactatggggtattcctgcttcctgggctggggtccccgcctgccttatctatgtgtggatatatgtgtatgtatgtgtatatgtatacatatgtatatgtgaatgtgtgtatgcatgtgtgtatagatgtgtgcatgtatgtgtgtacatatgtgtatgcgtgtatacaggtgtatatgtgcaggtatgtatgtatgtatgtgtgcatgtatgcatgtgtgtgtgtgtgtacgtgtgtataaatgtgtatgtgtgcgtgtgtgtgcatgtgtgtgcatgtgtgtatgtgtgcatgtgtgcatgtgtgtatacatgcatgcatgtgcgcatgtggatgtacatgtgcatgtatgtgtatagatgtgtgcatgagtgtgtgtgcatctgtgtatatatgtgtgtatatgtgtatcatatgtgtatgtgaatgtgtatacatgggtatgcatgtgtgagtgtctaggtgtgtgcatgtatatgtgtgtacatgtgtgtataggtgtgtgcacgtatatgtgtggatgtgtgcatgtatgtggatgcatgtggatgtgtgtacatatgtgttttgtataggtgtgtgcatgtgtgtgtgcacgtgtgtacatatgtgttttgtataggtgtgtgcgtgtgcacgtgtgtgtatgtgagcgtgtatgtgtgcatctgtgtgtgtgtttgtgtgtgtatgtgtgtacgtgtgtgtgtgtgcatgttctggcaggagggaggggcttggtgtgaggtggtggggagaaggcaggggccaggctttgggaggacagctgagcctatactgccaggacctcccaaactgccacccccagtcttgggcattcaggctctcacaggcccagagacatggctggagccctgtggctgaggagcacagctgagagctcaggcggggcctggaggcgccaaagctgagttccaagtcaggctgagtgacttgggagaaatcagagcctctctctcggccttagcttttgtgtccataaaatggggatactcatcaggccagctccaggggatcctatccttccccccaggctcccctggctccctctgacttcatgggccccttgctgcctcctgtgggctcagacacggagcctgccccttcctcgggagaggtctcagttttgtgccagttctttgaggggaaatgagggatgtgccgggaagcctgcccggcccccgcccctccagcctgcccactgcttgggcacagccatgagccatggaaaaccagccaaaccttgtccttctgcctctgtcacggggcccgggtgtatgggccttccagccctcagcctccctccccgctctgagggaacctcttccccttgcccctttctcagtctcttggagaccccccagacatcctactgtatcaggcagcctgcctccagagccctcgttgccccacagctggtcccgggaacccgcctgagaccccgatggccagtcttgccgtgactggcctgccctgtgcctgtgccccctgccctggtggagggcccgattccctaacaggagggcctgcagggaagtcccagctcctggggagaccccttgccccggggcaggagtccctgtagagtcctcctccaggccaatgcgtgggtcctggggggctccaagctggccatggtcagatggtcctctgtcccctcggccttccccagcccctccccacagcctcccgtaggcccagccggaccaccccaaccctacctgtccaggtggactgcccaccctggagcttgccagggctctggcggggtgtcccagccctgactcactctccctgggaggtagcggctttggcaggggcatcggcaaggaggggcagggcagtctcctccctcccccactccatcttgctctcctgcttccaccctgcccttcctgttctctcccactgctcctcctcctcctcctccttctgcccccgggtgtccactggcactgggagagggtcctacagcggcagcaggcatcggaggccctgccctgccctggaggaagggaaacaccatccaggtaggtgagtgttgagccttctccctacttgggggccaagaccctccgggcggttcccctaggttctgctgggccggcctgaggctggcaggccctgggctgcaactgtgggatctcaaggctcaaaagaatgagggaggctcggtgctgccccagcaggggcctcctggtgaccccaggggtcagcatgaagtccagctccacatgagggggaagctgagctaagccttgggctccgactcccactttgcagtgtggcccagggcctgtgggctcaggagggctccggggctggctgcggaaaggccactccacaggcctggcagccgctatagccacagcctcaccacaggcccctctgtccacaggtgtgggagggcgcatgggtggcttctaggggggatgccaatgcaggggggacgcgtgccagcagatgctccctggagcacccgaggagctgcatgggggcgacaggacaggcctccatcccaaccctctcctgggcttgtgctcagacccaacctggccctgaagtggcctcaggcccccggcccgctggtagcaaggactccaaagcggcagccccgggcagccagcccagcccccagggcaactggggaagcatcgggcagggcggggctgctcatagggtgctggcctgggggcagagcccccacctccccacggcctccttagacccctgcaaccagcagctgggcttagggggctcacctcgctctgctggagccccagacagcccctccccagctagtactggccctaagtgagggtctcctgggcgtgcgactgcttcaggtctgccagaggcccctgctgcccagctgggctccccatctccagatgcaccgagggccaccccaggctgggtggcaagcagggcaggcatgtttattcccacttaacagatggggaaggtgaggctgggatgagacctgggcctttgctggagagtcagggtggatgaagtggtgagagaggcagggctccagcctcttcctgtagggcacattcccggctgcctctggacgggagaccgtgtctgatgaggagggaggaggcaagcagaggtgggtgctgggggcaggctcgggcagggctgcttcgcctccactcccactcgccgcctcggcctggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggataccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcagaggcgtgggggcctgcagacttgctgatgaggagacatttcatcgcctgattaagccaagtcctgtccgggatggggaggggggtagtggaagcagtgaagggagtggagtggagggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaaggggacacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggcttggagcggcaaggcagtggtggcactgctggggctcaggaccgggcctgggtgctgcctcctgccctgcactctgctcacaagcatggactgaacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatctgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgaccgcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagcca

SEQ ID NO: 5236 - DNA, 39193 bp, human; identical to SEQ ID NO: 3993

SEQ ID NO: 5237 - DNA, 14565 bp, human
ctctccacaaactgcccaggagtgagtagctgctttcggtccgccggacacaccggacagatagacgtgcggacggcccaccaccccagcccgccaactagtcagcctgcgcctggcgcctcccctctccaggtagggctggcttcaagctgcctcctcagcaacccagagatgcccctggctctgctgcctccgctgtcccaagccctggtcctgctgtccccagtgccgcgagggtgtccacagatttccccggtgctctctgtaggctgctgatccacgccccttcatcgccaccctgcggcccccttggtccctgtcaggcttctgcctcgtctcgccgccctccaggcacctttccctcaccccttcctctccctctcccttctgaccttgctctgcttcatccacctcttgtctctctgcctcccgctcggggtccgtcttcttggctaccaccctagagcgtggctgggtgactggtaccccagctttgccaatggccctgtttcatcattgcaagtcccaggcgcatgctccactccctcagcctcgctctgcccaggcgcctccttgctccagggcttggcgcctggcccgggttgggtcggatcggggaggaccgcccagcgcccaccgagctcagcacccaggagcagtcctccgctgcactgcctgaggccagtccttggcatgggctgaaagacttagtttcccaggcacaccccaggcaccctgcccagatgttcctcgctcgctcacccccaggttaatgctctgcctctacatcctctgtgagaagtctgggtcctgggagccctggctgcaagggccctgactgggggtgcctgggtggctcagccctgtctgtttccaggacccccttggactgggactcagaatgggtgtggaggggaaggagagaaaatcaggcaactgtgccatgctccccagggcggacctggcttggggtcccagaggggcctgccaagggacccaggagagggagcgagagagtgccctggaaggcccacggaggggagcgccccctcactgctccatgggcggggctgggtgcctgagcgcctgctgagcagagcagggggcccagggatctgcagggcacagggtacatcagtctccagtggtctgtcttggtgggcaggcctctctcctgctgtcctggctgccagactgctcaggtcccatcctcagggggtcctgtttctgggccctcgcccctccctggcctgccagctctctgccctatagcaactaattggaactgagacaagctggagatgctcagcccccctgcccccgtgccagaaaggctcccggggaccagcgcccaggggtgcgggtgagcacctcctggtgacacccagccgccggtgccagccgcaccccaggagagctggtgtatgagcatggatgtcttggtgcggagcatgcccatgtatggccactgtgggccagcatggtgagcctttgagggcaagcccgtgtgggtatattgaaaggaagatgcagggctgcctccaagccaccagggctgggcggtgggagcaggttgcgagccagggagcagagagggctcccatggcaagctggccagctgtgggtggcagccctggcctccctggcccaccttcaagccccaaggacccgtacggcagtgggcattaaccctaccaacgcatagatggggagtctgggaaaggaaggggggtgtttccaaggcaagaatgagtttcctgtctttagcaacattccagagtcactcaaacaaagctatagcgtgtcccttccagtgacagcgccaagtccccagaggaggggtttgtaatgagttcacacttgacagttagcactcagagccttcagcaagggcttctgagtccttgccaccccgtatagaggtgggatgaggacctccccacctgccgtctcctgtgcttcccgggcccaccccccaccccccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacccctgcttgtcggaaatgtcttcccatgcccaccacgaccccctcccactcatctgtgggccggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttcccagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgtggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccagaagatcccctccaccacttgaatcccacagccagaagccccttctgggactctagactcctgggaaccatcccagctgcccccttcgctgtttcgctgtttgccttcttcccctgccccgtcatggctctaggtcagagcagcctctggggtggctatggaggggccaccagccttggctcttccgaggactgcagaaccctcccactcccagcttcccacctgcgcagctctgatcccagccagcccaaggggcagggtcaggtcccggctccctggcaggcctggtgaaggtgctgcccattcccatgaggctcatctctgaggcttaggggcctggggctctagccagccttcttgcatggaactctcctggtccactgcatcttaagcctgagctccacttaaacactggcctgagataagctggaggaccaggggcccaacggactctgtgggcctcttgaacttgcctctgctggccatcccagtcctgtttggtccctgaggtgttcagatgggccaaggggagcatggcgggcagactcctgggtggccagaagattagaaggcagccctgtccctggaggcaggggaagtctgggaagccagtgtgacttctatcctctggaagtctgagtccctgcttggccttgactgccatcccatggttcttggaggctgccctcatgcaaagagacacacacccatgggagcccagcagtcccaggagcctgaagctaagcaggctgtgggccaccctggctggctgaaggaggctaatcccagcccagcctgagcccccggcagagagcgggttgcggcagggaggggctgcaggaaaccttcccctcccctcctggccttggtgggcctgtaccagggagggagggaggcagggccccaggctctggggggcaggccgggaacaccttccctggggccctgaagtgctcgcctggggagacgatggcttttccaggagactccctgcagacagaggcagaggtgagaggctgggcgggggctgccctgctggctgtgttggggctgaggaggggcttctggatctgtgggccatagggagctactgatggtcctcagaagggccatgcttccaggggagccccctgcacagccccgagagtgtgaagcgtgtcagctttggggcctgtggcactgtgtgcattgggagagggtgggtccagacatgggggcaaggacacagacggacagacagacagtgtgtgcagccccagctctgctgtttcctcaccgtgtggccttgggcaagagtttggggccaacttcctgagcctcagtttaccccttcatcaagttctaagagcattgcttccttcttatagtcaacgggggacggcaggatgctaagtaaagaaatcacatgagtcccctgctctgcctctgagaggtgacagcatcctcccttttccttggagactctagcaggaggccccggatctcttcggagagtgggagggggcagcagtagtccgtgtgcagaggaccaggagcgcacagtgggaagggctgagtcccgcactccgccgactgtggggacaggctggaccttgacatgggcgccacaggctgcaaagggctggcacagagaggtgggaggtggctgggcgcatcaagggagaactccacccttgtcgccaccctgccagaaaacctctggaaaggatttgagcagcagatgagccggggtttcccagcccctccacacgtggctgcaaggggagcagacgcccaagcgtggctgcctgaagggcatgctccggcaacggcaggggcttggaatgtggcacaaggtccacccctccccactccagcccccagcccctcaggcagccactcccacagatgaacgcacacgccgggctttggcaaggccagggagggtacacatcccctctctggttgatgcccaagtacaggctggagccatcggcggggagggactggtggactggggcctgggagagtggcagggggcaggccgggtgtcagcgggggcacaagcaccaggctgctggttgaaactgggcccaaaaggctttggaggccagaggggaggggaggaaggacacagtcccggggaccccgcagggctgcgtggaaggtggcacatgtgtcagagttcaggtcgggttgctcaggggggcagacgcccagggctgaggctgcggagacagcatccggcgtctgccacttggcagctgtgagccacaccatctgcaggcgagctcccagggcccgccagacctcaagccctgctcccgccgcccttggcctggcctgaatgcctggcacggaccctccatgttctcagaggctgccaacgcatcttgtttggctgtgacctcgagcaatccagtgcagaggactgcgctagctttcagaggggcagacaaggagggccctattggggtggtggcggaggctccaggaagcccagcctcctccctcactcacacctgcggtcgccaaacctggggcttatgccattgccgcccctgtcctttgctctaaagagatggtatccagggagctcagggcacactttggtggggcttgaaaccctccctgaagtccctgaagacacacccagagaggccaatgaagggaaactgaggcccagaggcctcagttgtggtggtggagagttgaggactggagggacttgctgtgggtctcacaggatctgactatggggtattcctgcttcctgggctggggtccccgcctgccttatctatgtgtggatatatgtgtatgtatgtgtatatgtatacatatgtatatgtgaatgtgtgtatgcatgtgtgtatagatgtgtgcatgtatgtgtgtacatatgtgtatgcgtgtatacaggtgtatatgtgcaggtatgtatgtatgtatgtgtgcatgtatgcatgtgtgtgtgtgtgtacgtgtgtataaatgtgtatgtgtgcgtgtgtgtgcatgtgtgtgcatgtgtgtatgtgtgcatgtgtgcatgtgtgtatacatgcatgcatgtgcgcatgtggatgtacatgtgcatgtatgtgtatagatgtgtgcatgagtgtgtgtgcatctgtgtatatatgtgtgtatatgtgtatcatatgtgtatgtgaatgtgtatacatgggtatgcatgtgtgagtgtctaggtgtgtgcatgtatatgtgtgtacatgtgtgtataggtgtgtgcacgtatatgtgtggatgtgtgcatgtatgtggatgcatgtggatgtgtgtacatatgtgttttgtataggtgtgtgcatgtgtgtgtgcacgtgtgtacatatgtgttttgtataggtgtgtgcgtgtgcacgtgtgtgtatgtgagcgtgtatgtgtgcatctgtgtgtgtgtttgtgtgtgtatgtgtgtacgtgtgtgtgtgtgcatgttctggcaggagggaggggcttggtgtgaggtggtggggagaaggcaggggccaggctttgggaggacagctgagcctatactgccaggacctcccaaactgccacccccagtcttgggcattcaggctctcacaggcccagagacatggctggagccctgtggctgaggagcacagctgagagctcaggcggggcctggaggcgccaaagctgagttccaagtcaggctgagtgacttgggagaaatcagagcctctctctcggccttagcttttgtgtccataaaatggggatactcatcaggccagctccaggggatcctatccttccccccaggctcccctggctccctctgacttcatgggccccttgctgcctcctgtgggctcagacacggagcctgccccttcctcgggagaggtctcagttttgtgccagttctttgaggggaaatgagggatgtgccgggaagcctgcccggcccccgcccctccagcctgcccactgcttgggcacagccatgagccatggaaaaccagccaaaccttgtccttctgcctctgtcacggggcccgggtgtatgggccttccagccctcagcctccctccccgctctgagggaacctcttccccttgcccctttctcagtctcttggagaccccccagacatcctactgtatcaggcagcctgcctccagagccctcgttgccccacagctggtcccgggaacccgcctgagaccccgatggccagtcttgccgtgactggcctgccctgtgcctgtgccccctgccctggtggagggcccgattccctaacaggagggcctgcagggaagtcccagctcctggggagaccccttgccccggggcaggagtccctgtagagtcctcctccaggccaatgcgtgggtcctggggggctccaagctggccatggtcagatggtcctctgtcccctcggccttccccagcccctccccacagcctcccgtaggcccagccggaccaccccaaccctacctgtccaggtggactgcccaccctggagcttgccagggctctggcggggtgtcccagccctgactcactctccctgggaggtagcggctttggcaggggcatcggcaaggaggggcagggcagtctcctccctcccccactccatcttgctctcctgcttccaccctgcccttcctgttctctcccactgctcctcctcctcctcctccttctgcccccgggtgtccactggcactgggagagggtcctacagcggcagcaggcatcggaggccctgccctgccctggaggaagggaaacaccatccaggtaggtgagtgttgagccttctccctacttgggggccaagaccctccgggcggttcccctaggttctgctgggccggcctgaggctggcaggccctgggctgcaactgtgggatctcaaggctcaaaagaatgagggaggctcggtgctgccccagcaggggcctcctggtgaccccaggggtcagcatgaagtccagctccacatgagggggaagctgagctaagccttgggctccgactcccactttgcagtgtggcccagggcctgtgggctcaggagggctccggggctggctgcggaaaggccactccacaggcctggcagccgctatagccacagcctcaccacaggcccctctgtccacaggtgtgggagggcgcatgggtggcttctaggggggatgccaatgcaggggggacgcgtgccagcagatgctccctggagcacccgaggagctgcatgggggcgacaggacaggcctccatcccaaccctctcctgggcttgtgctcagacccaacctggccctgaagtggcctcaggcccccggcccgctggtagcaaggactccaaagcggcagccccgggcagccagcccagcccccagggcaactggggaagcatcgggcagggcggggctgctcatagggtgctggcctgggggcagagcccccacctccccacggcctccttagacccctgcaaccagcagctgggcttagggggctcacctcgctctgctggagccccagacagcccctccccagctagtactggccctaagtgagggtctcctgggcgtgcgactgcttcaggtctgccagaggcccctgctgcccagctgggctccccatctccagatgcaccgagggccaccccaggctgggtggcaagcagggcaggcatgtttattcccacttaacagatggggaaggtgaggctgggatgagacctgggcctttgctggagagtcagggtggatgaagtggtgagagaggcagggctccagcctcttcctgtagggcacattcccggctgcctctggacgggagaccgtgtctgatgaggagggaggaggcaagcagaggtgggtgctgggggcaggctcgggcagggctgcttcgcctccactcccactcgccgcctcggcctggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggataccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcagaggcgtgggggcctgcagacttgctgatgaggagacatttcatcgcctgattaagccaagtcctgtccgggatggggaggggggtagtggaagcagtgaagggagtggagtggagggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaaggggacacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggcttggagcggcaaggcagtggtggcactgctggggctcaggaccgggcctgggtgctgcctcctgccctgcactctgctcacaagcatggactgaacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatctgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgaccgcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 5238 - DNA, 33956 bp, human; identical to SEQ ID NO: 3994

SEQ ID NO: 5239 - DNA, 4150 bp, human
tgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaaggggacacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggcttggagcggcaaggcagtggtggcactgctggggctcaggaccgggcctgggtgctgcctcctgccctgcactctgctcacaagcatggactgaacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatctgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgaccgcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctg

SEQ ID NO: 5240 - DNA, 2936 bp, human
tcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatctgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgaccgcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggag

SEQ ID NO: 5241 - DNA, 7102 bp, human
ctgctcctcctcctcctcctccttctgcccccgggtgtccactggcactgggagagggtcctacagcggcagcaggcatcggaggccctgccctgccctggaggaagggaaacaccatccaggtaggtgagtgttgagccttctccctacttgggggccaagaccctccgggcggttcccctaggttctgctgggccggcctgaggctggcaggccctgggctgcaactgtgggatctcaaggctcaaaagaatgagggaggctcggtgctgccccagcaggggcctcctggtgaccccaggggtcagcatgaagtccagctccacatgagggggaagctgagctaagccttgggctccgactcccactttgcagtgtggcccagggcctgtgggctcaggagggctccggggctggctgcggaaaggccactccacaggcctggcagccgctatagccacagcctcaccacaggcccctctgtccacaggtgtgggagggcgcatgggtggcttctaggggggatgccaatgcaggggggacgcgtgccagcagatgctccctggagcacccgaggagctgcatgggggcgacaggacaggcctccatcccaaccctctcctgggcttgtgctcagacccaacctggccctgaagtggcctcaggcccccggcccgctggtagcaaggactccaaagcggcagccccgggcagccagcccagcccccagggcaactggggaagcatcgggcagggcggggctgctcatagggtgctggcctgggggcagagcccccacctccccacggcctccttagacccctgcaaccagcagctgggcttagggggctcacctcgctctgctggagccccagacagcccctccccagctagtactggccctaagtgagggtctcctgggcgtgcgactgcttcaggtctgccagaggcccctgctgcccagctgggctccccatctccagatgcaccgagggccaccccaggctgggtggcaagcagggcaggcatgtttattcccacttaacagatggggaaggtgaggctgggatgagacctgggcctttgctggagagtcagggtggatgaagtggtgagagaggcagggctccagcctcttcctgtagggcacattcccggctgcctctggacgggagaccgtgtctgatgaggagggaggaggcaagcagaggtgggtgctgggggcaggctcgggcagggctgcttcgcctccactcccactcgccgcctcggcctggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggataccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcagaggcgtgggggcctgcagacttgctgatgaggagacatttcatcgcctgattaagccaagtcctgtccgggatggggaggggggtagtggaagcagtgaagggagtggagtggagggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaaggggacacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggcttggagcggcaaggcagtggtggcactgctggggctcaggaccgggcctgggtgctgcctcctgccctgcactctgctcacaagcatggactgaacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatctgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgaccgcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 5242 - DNA, 7096 bp, human
ctgctcctcctcctcctcctccttctgcccccgggtgtccactggcactgggagagggtcctacagcggcagcaggcatcggaggccctgccctgccctggaggaagggaaacaccatccaggtaggtgagtgttgagccttctccctacttgggggccaagaccctccgggcggttcccctaggttctgctgggccggcctgaggctggcaggccctgggctgcaactgtgggatctcaaggctcaaaagaatgagggaggctcggtgctgccccagcaggggcctcctggtgaccccaggggtcagcatgaagtccagctccacatgagggggaagctgagctaagccttgggctccgactcccactttgcagtgtggcccagggcctgtgggctcaggagggctccggggctggctgcggaaaggccactccacaggcctggcagccgctatagccacagcctcaccacaggcccctctgtccacaggtgtgggagggcgcatgggtggcttctaggggggatgccaatgcaggggggacgcgtgccagcagatgctccctggagcacccgaggagctgcatgggggcgacaggacaggcctccatcccaaccctctcctgggcttgtgctcagacccaacctggccctgaagtggcctcaggcccccggcccgctggtagcaaggactccaaagcggcagccccgggcagccagcccagcccccagggcaactggggaagcatcgggcagggcggggctgctcatagggtgctggcctgggggcagagcccccacctccccacggcctccttagacccctgcaaccagcagctgggcttagggggctcacctcgctctgctggagccccagacagcccctccccagctagtactggccctaagtgagggtctcctgggcgtgcgactgcttcaggtctgccagaggcccctgctgcccagctgggctccccatctccagatgcaccgagggccaccccaggctgggtggcaagcagggcaggcatgtttattcccacttaacagatggggaaggtgaggctgggatgagacctgggcctttgctggagagtcagggtggatgaagtggtgagagaggcagggctccagcctcttcctgtagggcacattcccggctgcctctggacgggagaccgtgtctgatgaggagggaggaggcaagcagaggtgggtgctgggggcaggctcgggcagggctgcttcgcctccactcccactcgccgcctcggcctggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggataccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcagaggcgtgggggcctgcagacttgctgatgaggagacatttcatcgcctgattaagccaagtcctgtccgggatggggaggggggtagtggaagcagtgaagggagtggagtggagggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaaggggacacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggcttggagcggcaaggcagtggtggcactgctggggctcaggaccgggcctgggtgctgcctcctgccctgcactctgctcacaagcatggactgaacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatctgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgaccgcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgc

SEQ ID NO: 5243 - DNA, 14615 bp, human; identical to SEQ ID NO: 5232

SEQ ID NO: 5244 - DNA, 14563 bp, human; identical to SEQ ID NO: 5233

SEQ ID NO: 5245 - DNA, 13585 bp, human; identical to SEQ ID NO: 5235

SEQ ID NO: 5246 - DNA, 14565 bp, human; identical to SEQ ID NO: 5237

SEQ ID NO: 5247 - DNA, 62913 bp, human; identical to SEQ ID NO: 3998

SEQ ID NO: 5248 - DNA, 65263 bp, human; identical to SEQ ID NO: 3999

SEQ ID NO: 5249 - DNA, 62913 bp, human; identical to SEQ ID NO: 3998

SEQ ID NO: 5250 - DNA, 65263 bp, human; identical to SEQ ID NO: 3999

SEQ ID NO: 5251 - DNA, 46807 bp, human; identical to SEQ ID NO: 4002

SEQ ID NO: 5252 - DNA, 62913 bp, human; identical to SEQ ID NO: 3998

SEQ ID NO: 5253 - DNA, 44467 bp, human; identical to SEQ ID NO: 4004

SEQ ID NO: 5254 - DNA, 46807 bp, human; identical to SEQ ID NO: 4002

SEQ ID NO: 5255 - DNA, 37028 bp, human; identical to SEQ ID NO: 4006

SEQ ID NO: 5256 - DNA, 65263 bp, human; identical to SEQ ID NO: 3999

SEQ ID NO: 5257 - DNA, 46807 bp, human; identical to SEQ ID NO: 4002

SEQ ID NO: 5258 - DNA, 62913 bp, human; identical to SEQ ID NO: 3998

SEQ ID NO: 5259 - DNA, 44467 bp, human; identical to SEQ ID NO: 4004

SEQ ID NO: 5260 - DNA, 46807 bp, human; identical to SEQ ID NO: 4002

SEQ ID NO: 5261 - DNA, 37028 bp, human; identical to SEQ ID NO: 4006

SEQ ID NO: 5262 - DNA, 65263 bp, human; identical to SEQ ID NO: 3999

SEQ ID NO: 5263 - DNA, 46807 bp, human; identical to SEQ ID NO: 4002

SEQ ID NO: 5264 - DNA, 62913 bp, human; identical to SEQ ID NO: 3998

SEQ ID NO: 5265 - DNA, 44467 bp, human; identical to SEQ ID NO: 4004

SEQ ID NO: 5266 - DNA, 46807 bp, human; identical to SEQ ID NO: 4002

SEQ ID NO: 5267 - DNA, 37028 bp, human; identical to SEQ ID NO: 4006

SEQ ID NO: 5268 - DNA, 65263 bp, human; identical to SEQ ID NO: 3999

SEQ ID NO: 5269 - DNA, 3878 bp, human; identical to SEQ ID NO: 4008

SEQ ID NO: 5270 - DNA, 46807 bp, human; identical to SEQ ID NO: 4002

SEQ ID NO: 5271 - DNA, 62913 bp, human; identical to SEQ ID NO: 3998

SEQ ID NO: 5272 - DNA, 44467 bp, human; identical to SEQ ID NO: 4004

SEQ ID NO: 5273 - DNA, 46807 bp, human; identical to SEQ ID NO: 4002

SEQ ID NO: 5274 - DNA, 37028 bp, human; identical to SEQ ID NO: 4006

SEQ ID NO: 5275 - DNA, 65263 bp, human; identical to SEQ ID NO: 3999

SEQ ID NO: 5276 - DNA, 10921 bp, human; identical to SEQ ID NO: 4015

SEQ ID NO: 5277 - DNA, 46807 bp, human; identical to SEQ ID NO: 4002

SEQ ID NO: 5278 - DNA, 62913 bp, human; identical to SEQ ID NO: 3998

SEQ ID NO: 5279 - DNA, 44467 bp, human; identical to SEQ ID NO: 4004

SEQ ID NO: 5280 - DNA, 46807 bp, human; identical to SEQ ID NO: 4002

SEQ ID NO: 5281 - DNA, 37028 bp, human; identical to SEQ ID NO: 4006

SEQ ID NO: 5282 - DNA, 65263 bp, human; identical to SEQ ID NO: 3999

SEQ ID NO: 5283 - DNA, 10921 bp, human; identical to SEQ ID NO: 4015

SEQ ID NO: 5284 - DNA, 46807 bp, human; identical to SEQ ID NO: 4002

SEQ ID NO: 5285 - DNA, 62913 bp, human; identical to SEQ ID NO: 3998

SEQ ID NO: 5286 - DNA, 44467 bp, human; identical to SEQ ID NO: 4004

SEQ ID NO: 5287 - DNA, 46807 bp, human; identical to SEQ ID NO: 4002

SEQ ID NO: 5288 - DNA, 65263 bp, human; identical to SEQ ID NO: 3999

SEQ ID NO: 5289 - DNA, 371 bp, human; identical to SEQ ID NO: 4028

SEQ ID NO: 5290 - DNA, 2231 bp, human
agatggacaaatgctagagtcagcacctgtctgtgggggcgcccttggcctgggcgctggacctaggccatcaggactggagagccttcttctcttctggccagagaaagagcaaagggtggcttcctgacaggtccggagctggcacagcacaacagagcctagaaaatcactagcagggctgagctcggggttccaccgctgcagccttcctgttggacccagtctgctcaaggactccctcacagcccagtgctttctgttcaccccggggcgctcccagcccagcctcctagcctcagtgagtgggaaatgtctgtactgcccacttgtcctcaaacgcatgtccttgctcggctgctccctgctctgccccatctggaggggacagggtgaggaggcgccctggaggcctggccccagcttgggcaacacagcctagcggggtgatcacacctgggtctgcagcccctccagcacttcctggggctgtgccggccattccagaccattcctgttggtggaactcatgacagggcttgtttacgccagtcactgtgttctgacacctcccccaccccgatcattaacttttctggtccttttcagttattaaaattcagcccagactcacatcccatgggcctcccctccccatccttggggctggaatggactggaatggagaggaggtgacctgacctcccttccctcccttcccaccccccacccccccgggccggggcaggcagaacttgtgccagggtgagggggtgagaggggccccatctttgcctgggctttttgatgcctgccaatggggtcgcccttttctgagggcaggctcagccccttccttgctgaggctaaagaccctctgggattgggaagcgctgtcctctctgggccccaccagcgtctaccggaccccctcagacctctggcccccacaccttgtgcccccagggcagaaggcagctggggtaagagtgccttcagtcctgccaggctcagcaaatgtcctgccttcagaaacctcagcaggcagacaggcaggtgcctcctcaggaatacagcgtgccccccatccccagggggacgtacccagctctccccacagcctccggggactgcgggctgtgtccacagctctggcagggccttattttctcccagctttttggcattttatggattaaaaacacagcattcccctaagggcagcctgcttccgtccgggcttctgtgggagtgagtaaggctggtctcctgagggaagtgtgtgattcttgccggggccagaggccaagacgagccaggagggcacttacccctttggggcatcttgcccttgtcctttctgttttctctactcaggcctctcccctgagctgaggaaaccaagagaattcttgtccttttggataaagaccttttcctaagatcgttttctcctagaaataagcatactttattaagatattttggactggccgtgcacagtggctcatgcctgtaatcccagcactttgggaggccaaggcggcggggatcacgaggtcaggagtttgaaagcagcctggccaacatggtgaaaccccgtctctactaaaaatacaaaaaattagccgggcgtggttgcacacgcctgtaatcctagctactctaggaggctgaggcaggagaattgcttgaacccgggaggcggaggttgcagtgagctgagatcacaccactgcactccagcctgggggacagagtgagacttcgtctaaggaaaaaaaaaaaaaaaaaagatattttggactgattttgtgtgtcctgatgcagtttttctttgtgcattaaacatagtgaaacacacagtgcagccaagtgtggggccacactgcctcgcttccctcttcccctcacagagccgggcacgacagctgcgggcacagggagcaatcgcctggagccagagggggcaacgccagcccaagggcaaatgggcaaccctgtgcaaaaggctctggcaaccagatcatctactttagaagaaaggagaagaaaaagagcccccaggagaggaagtagcccctaacccgactgacaagcaatccgttcgcaaagacagaagggccttcagtgaattggtttcaaagtgcttgatttcttaaaaccagaacaattgatcattagagaactgattaagctacagccgctgttgaataaaaggtaaaaataaa

SEQ ID NO: 5291 - DNA, 5521 bp, human
ccgccacccggggttccggtggcgttaggctgcagcagtggcgcttcccgccgcccgagcttcggaaacttcccggccgcgacgcagggaaccggcgcggagaaccgagcagagcggaggtgagtggagcaagcggcgccccggggacccccaccccccacccggcctggctgcccccgccccgacgtgcgctcctccaccctgcacccccaaagtcctgacaacgcacaccccacgaagccggcgcacgcgcccctacgacacccattcggtgctgctccgcacacccccgcacgccgcccgtgcacctcccgtgtctcctgccacttgcaccggctgcacactcgcgcgcatacaaaccacgcaccacagacccgggtgcctgtagtgcacacactagctgcccctgccccaccactcaccactgtccccaactcatgccaacccaccgagaccctgccacgccccagtacacacccaggcgcacacgcacgcttccaacacgtctctgccatacctgcaccaacatagctccccctaccatgcccccaccacctcgaactccccatctgcccattacagacaccccacccacgttgccagcccagagacactgcagtccacccatcctggagcgaggtcccgtcagaaacccacatcccagtggctgacgctccccacgtcccaggcacacacctccagcatctccaacgcgcactctcatccaccccagcacgcgcgcacacctgctggattcacgctctccagcatcctgccccgcccccatcacaaatagccttcgacaccccccagcacatctctgagtccctccctccctcacccccaacacctggcacgcgggctctagaggctgcagcatttggtggcatccctgccaggcacctctggctccccttcggcagaggctcagcagccttgggccccccaggtgcctccctaaacagaccttgagactccccagcgactagcttggcctcttccctaagaaataaagaaggcactttggggtccaaggtagggtacttagatgtggaagcaaggggccccggggaggggcggggaggcggcggagagagcccggcgctgaaatggaggcggcccaggtgggaccaaaggggcgccagctgcccggcaagcacgtagtaggtgggttccatgggggctggcgtccgcgcgcgctgtctgggtgcctgcctgcgtgtgtgttacggggagggctgtgtgtgcacgtgtgcttgtgcgtgtcggggtgggggaggagtgtgtgatcggcagaaggaaaagcaggagcagctccctcaggcaacaattggtttcattcattcatgccttctttgttaacgagcatttcttccgcgagcgccgggcgcgtgccaggccctgcactgggggctggggccagcctggggccgggcacacacccgttcctgccttggaggaactcccagtcccgcgaggagaccgaccaggaaaagcagaaagccatccccagcagaaagtggatttggtggaaaagacactggatttggcaggcacgctgtcgccgggacttgtgctcttggccatgtgacccggccgcgacagccgaaatcctgtcactcggcccggcgggaacggtgcatctcgtgggggaaggcggcgcggcgccgctctcgggaggctcccgggaccagagggcgcacgcggcgcgcgcgaggcctgcaggcggcggcgtccccgcggcctccagggggcgctggcccggcccggcggaggcccggggcgcccggcgggggcgggtgcgggggcgggggcgggggcggcaggcgcagcgcccaccctgcggcgggcagcgagcgcgcggcctggctcagcccgccggagggggccagacgaggcccgggcgcgcggcgcggcctcccccagcacagcgcacccgggagcggctgccggcggggcggcgcccagagccggcgctacagggggcctgagtgggggcggcccggcgagggtcgcgggtgagagggggattagggggttggctgcgctcagccctgcagtgcggaggtggcaacaggttcccatttgtcctgttgctggcgctgcgggcgctgtgggccccgagcactgagctctgactttggaaattgagcccctcatggcctcctcccaaatgctttctcccggtgcgaggacttggcagcagggctccgcagttaggtgcaggggagcccctcgccaagcgtcgggagacgtggacccttggatcctaggcttcccctcccttccccattgcggaggttgcctctccccgtcctcattccagcccagctcctctcacctccagggaaccctctccagagagcgccactgagcagctcaggagctccctctctagccgaactgagcccccacggcagggcgggccggggaagtggctgtccagctccctgctggtcacagccctgcgccacccccactctccacaacaagactggcacatggcagaacctccgtggtgccttcaacccctgcccactctgagctcccacccacagctgcagtgggcctggaggcagcccccaggctgggtgccggtgtccacctccaccactgtggagctaggctgtggacagaaaacagaagacaaagtccctgccccaggaacacactgagaaagggggaaagtgaccacactagggagcacagaggagggagactactggctccgagttgggaaggctgcctggaggagggggcctgaagaatgagcagaatctcagaatctgggcagggggcataggagggaggcctgggctggggcccttgcccactgggtgagagaaggaagggcacagtccagctgcccaaagcccttggatgcaggaattaggactcttgttagacgcagggacatggggggtgtggccggaaagcagcccagtgccagggtcctgggagtccccggctagcagcccactgcccgaaagggagggagagaggcaaactggaagccccttagaggtgacccacctagctttccgtcacctgccctcttacctaaccatgacctgagacattttctcctctaactccatggctcctgagaggagtctttagactcgtagtttgctttgcattttccacttgttagaaaaatgctttgtggtgcccatcctcgtgtgcataactttgctttcttttactttagttccttagattcccaaaagtggtcaaagggttgggattttttcctagctcttgatattgccagattaatttccaaaggggccgtaccaatatataaccctgcaacagttgaacagcacgctgatttcacagcaatcttgccagcactgcgtgttctcaaaaatgagaacatttctaatgcagtaggtgggaagtgttacctcgttggtcattgttacttgtttattggagtggctttccttccacgcctgaagttgaaccttcccccaaatatttgttaggccaccgcattccctccttcctgcagtatgcagtgttttcaggttctttgcccatttatctacaggggtcttaaccttttagttgggtatgagctttatcttatctggcgtacattttccttcaacactgttatttgcttttgttgagctttaagcagagaagggacttttagccagatcagcattgtggacacctccccctgaccctggtctcctgcctcagtgctcaccacacctgagaccttgtccagtgctcttgctgcctgtggatctgtcccgcctgttgtgcccatggaggaaaggatggaggccaccagccttggttgagtggatggcattctgacgttgggcagggctgggcagggcagggtggagggcaggtcgttgcaggcccggaggcagggagactgttgtgcaagacgtgacagtgacctggcctaaagctgatgaatttgagccctcggctagggcaagggacaggggagagaggcgtggatgtgagagatatttaggtagaaactagttctttccactttgattagccgaaggggggttaagggaaggaggcagaggggggagccacgggtgactcttaggatcagtaatgtgataagagcagagtgccccagtttagggctgggagctcagggttcctgggtgcttttggccagtcctgtgcgagtgaagcgggctggtattggtaggtatccaggagctacccctgcctgcctagccctgcagcagacctctgggccaaagctgcactaagtttctggtcctgcctcctcctcccctccgtgatttcggtggcatcccaagtttgcccaagctgctagctctgagcccattacagagatggggccactgagatccaggcaggggagaagatgctccagtatcaccctgtgagttgggctggaggcagcttctgcggcagaggggctgggctctggtcctcacccctccccctgcctcccgaggccaggctggcgccggccaggggagccgcagctggtcccctgctgggcccctgacctgcccttggcctctgccccgaccccgtcccgcctcggtggaagccccagctcagccgactcgcaggtcccacccgactgcttcggctagcacccgttggctcaccggcccgccgggcccgcccccggagccccgccccggcccgcccctcggagttgtaactccacgtccgaaggcagtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccaggtctctttccttttgttctctcctaggggtagggggagatgggggaccgggggccagaccacctctgagaggactcgctgaggcccagcacctcggcgcctcctctgttcccctggcccacctggccctgggggagatctaggcctcgaacggcactcctcgcacgcacacccccagccagagtcggaagctcgaacttggggagcgttcgcgagaagaccgagacaggagcagaaagggggtatggagggaggcggctgcgacctcagggtaccccaagatgagcctcgaaggggcggttagccgctcagccctcttctcgaggacccttccccgggccgagctgctgcctggggggtttcttggggcgccttgttgggagtcctcatggtgggggaccctgggctcccgccttcaggacgcggggccggcttcaagtctgagccccctcggccctccggtagctcacaccgcgccttctctctcttcgcagcgcccgtggtccagcgtgtagggagccgatcgcccatggagggtctgggccgctcgtgcctgtggctgcgtcgggagctgtcgcccccgcggccg

SEQ ID NO: 5292 - DNA, 8793 bp, human
gcttcccgccgcccgagcttcggaaacttcccggccgcgacgcagggaaccggcgcggagaaccgagcagagcggaggtgagtggagcaagcggcgccccggggacccccaccccccacccggcctggctgcccccgccccgacgtgcgctcctccaccctgcacccccaaagtcctgacaacgcacaccccacgaagccggcgcacgcgcccctacgacacccattcggtgctgctccgcacacccccgcacgccgcccgtgcacctcccgtgtctcctgccacttgcaccggctgcacactcgcgcgcatacaaaccacgcaccacagacccgggtgcctgtagtgcacacactagctgcccctgccccaccactcaccactgtccccaactcatgccaacccaccgagaccctgccacgccccagtacacacccaggcgcacacgcacgcttccaacacgtctctgccatacctgcaccaacatagctccccctaccatgcccccaccacctcgaactccccatctgcccattacagacaccccacccacgttgccagcccagagacactgcagtccacccatcctggagcgaggtcccgtcagaaacccacatcccagtggctgacgctccccacgtcccaggcacacacctccagcatctccaacgcgcactctcatccaccccagcacgcgcgcacacctgctggattcacgctctccagcatcctgccccgcccccatcacaaatagccttcgacaccccccagcacatctctgagtccctccctccctcacccccaacacctggcacgcgggctctagaggctgcagcatttggtggcatccctgccaggcacctctggctccccttcggcagaggctcagcagccttgggccccccaggtgcctccctaaacagaccttgagactccccagcgactagcttggcctcttccctaagaaataaagaaggcactttggggtccaaggtagggtacttagatgtggaagcaaggggccccggggaggggcggggaggcggcggagagagcccggcgctgaaatggaggcggcccaggtgggaccaaaggggcgccagctgcccggcaagcacgtagtaggtgggttccatgggggctggcgtccgcgcgcgctgtctgggtgcctgcctgcgtgtgtgttacggggagggctgtgtgtgcacgtgtgcttgtgcgtgtcggggtgggggaggagtgtgtgatcggcagaaggaaaagcaggagcagctccctcaggcaacaattggtttcattcattcatgccttctttgttaacgagcatttcttccgcgagcgccgggcgcgtgccaggccctgcactgggggctggggccagcctggggccgggcacacacccgttcctgccttggaggaactcccagtcccgcgaggagaccgaccaggaaaagcagaaagccatccccagcagaaagtggatttggtggaaaagacactggatttggcaggcacgctgtcgccgggacttgtgctcttggccatgtgacccggccgcgacagccgaaatcctgtcactcggcccggcgggaacggtgcatctcgtgggggaaggcggcgcggcgccgctctcgggaggctcccgggaccagagggcgcacgcggcgcgcgcgaggcctgcaggcggcggcgtccccgcggcctccagggggcgctggcccggcccggcggaggcccggggcgcccggcgggggcgggtgcgggggcgggggcgggggcggcaggcgcagcgcccaccctgcggcgggcagcgagcgcgcggcctggctcagcccgccggagggggccagacgaggcccgggcgcgcggcgcggcctcccccagcacagcgcacccgggagcggctgccggcggggcggcgcccagagccggcgctacagggggcctgagtgggggcggcccggcgagggtcgcgggtgagagggggattagggggttggctgcgctcagccctgcagtgcggaggtggcaacaggttcccatttgtcctgttgctggcgctgcgggcgctgtgggccccgagcactgagctctgactttggaaattgagcccctcatggcctcctcccaaatgctttctcccggtgcgaggacttggcagcagggctccgcagttaggtgcaggggagcccctcgccaagcgtcgggagacgtggacccttggatcctaggcttcccctcccttccccattgcggaggttgcctctccccgtcctcattccagcccagctcctctcacctccagggaaccctctccagagagcgccactgagcagctcaggagctccctctctagccgaactgagcccccacggcagggcgggccggggaagtggctgtccagctccctgctggtcacagccctgcgccacccccactctccacaacaagactggcacatggcagaacctccgtggtgccttcaacccctgcccactctgagctcccacccacagctgcagtgggcctggaggcagcccccaggctgggtgccggtgtccacctccaccactgtggagctaggctgtggacagaaaacagaagacaaagtccctgccccaggaacacactgagaaagggggaaagtgaccacactagggagcacagaggagggagactactggctccgagttgggaaggctgcctggaggagggggcctgaagaatgagcagaatctcagaatctgggcagggggcataggagggaggcctgggctggggcccttgcccactgggtgagagaaggaagggcacagtccagctgcccaaagcccttggatgcaggaattaggactcttgttagacgcagggacatggggggtgtggccggaaagcagcccagtgccagggtcctgggagtccccggctagcagcccactgcccgaaagggagggagagaggcaaactggaagccccttagaggtgacccacctagctttccgtcacctgccctcttacctaaccatgacctgagacattttctcctctaactccatggctcctgagaggagtctttagactcgtagtttgctttgcattttccacttgttagaaaaatgctttgtggtgcccatcctcgtgtgcataactttgctttcttttactttagttccttagattcccaaaagtggtcaaagggttgggattttttcctagctcttgatattgccagattaatttccaaaggggccgtaccaatatataaccctgcaacagttgaacagcacgctgatttcacagcaatcttgccagcactgcgtgttctcaaaaatgagaacatttctaatgcagtaggtgggaagtgttacctcgttggtcattgttacttgtttattggagtggctttccttccacgcctgaagttgaaccttcccccaaatatttgttaggccaccgcattccctccttcctgcagtatgcagtgttttcaggttctttgcccatttatctacaggggtcttaaccttttagttgggtatgagctttatcttatctggcgtacattttccttcaacactgttatttgcttttgttgagctttaagcagagaagggacttttagccagatcagcattgtggacacctccccctgaccctggtctcctgcctcagtgctcaccacacctgagaccttgtccagtgctcttgctgcctgtggatctgtcccgcctgttgtgcccatggaggaaaggatggaggccaccagccttggttgagtggatggcattctgacgttgggcagggctgggcagggcagggtggagggcaggtcgttgcaggcccggaggcagggagactgttgtgcaagacgtgacagtgacctggcctaaagctgatgaatttgagccctcggctagggcaagggacaggggagagaggcgtggatgtgagagatatttaggtagaaactagttctttccactttgattagccgaaggggggttaagggaaggaggcagaggggggagccacgggtgactcttaggatcagtaatgtgataagagcagagtgccccagtttagggctgggagctcagggttcctgggtgcttttggccagtcctgtgcgagtgaagcgggctggtattggtaggtatccaggagctacccctgcctgcctagccctgcagcagacctctgggccaaagctgcactaagtttctggtcctgcctcctcctcccctccgtgatttcggtggcatcccaagtttgcccaagctgctagctctgagcccattacagagatggggccactgagatccaggcaggggagaagatgctccagtatcaccctgtgagttgggctggaggcagcttctgcggcagaggggctgggctctggtcctcacccctccccctgcctcccgaggccaggctggcgccggccaggggagccgcagctggtcccctgctgggcccctgacctgcccttggcctctgccccgaccccgtcccgcctcggtggaagccccagctcagccgactcgcaggtcccacccgactgcttcggctagcacccgttggctcaccggcccgccgggcccgcccccggagccccgccccggcccgcccctcggagttgtaactccacgtccgaaggcagtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccaggtctctttccttttgttctctcctaggggtagggggagatgggggaccgggggccagaccacctctgagaggactcgctgaggcccagcacctcggcgcctcctctgttcccctggcccacctggccctgggggagatctaggcctcgaacggcactcctcgcacgcacacccccagccagagtcggaagctcgaacttggggagcgttcgcgagaagaccgagacaggagcagaaagggggtatggagggaggcggctgcgacctcagggtaccccaagatgagcctcgaaggggcggttagccgctcagccctcttctcgaggacccttccccgggccgagctgctgcctggggggtttcttggggcgccttgttgggagtcctcatggtgggggaccctgggctcccgccttcaggacgcggggccggcttcaagtctgagccccctcggccctccggtagctcacaccgcgccttctctctcttcgcagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggtaggtgccgcggggccctccttccagggggttcgggattcatttgaccttaggccagccccacttctttttttctaaagcgagttgaggcccccctcccctgatgacctgccaggctgctttgagaggagggaagcctgagtgtgaccgtggggaagttcttcaccctcggcagcccagtctctgagcctggaaaatggggagaattagcctgacctgagctagttctcaggatgctcaagaacgaattacaaagtgcgggctccccagggtctcggcaagggtatccccacctccccaacctgctcaggaatgagcaagggaggcaggggtcagacagcactggtgcaatcacggctcactgaagcctcctgggctcaagcgatcctcctgccttagcctcccgaacagcatataaagtgttcaggtgtccagcccggggaaatagtatctgtaaatagagatgctggcttcttgagccatattctcccccaagttcccccacatcttggggtcccacttcatccctgagagtcaggagatgcccaggcagagagctgacatctgagttcctccttttctttagctgatggccgcagtcctccctaaggctggcagtgcatctcggctctgttgagccctcacacctgcctcagcttgaccctaggggtgtaagatcctttccggtggctcagcgtgagcccagcttcttgcagcccgagctgactgagggtggctagggccccacgtgggtaccaggacacaccaagctgctgggttttgtgttccctttgggaacatttgcaaaccctccaagttgtccagggtcatctccccagccccagacagaggcacttggctgcccagaaggccaggtcagcaggccccatgccctctccccaacaggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattggtgagtccaccccacccacccttccctcctgtcctccccaaggcctgctctggcctcccccttgtgagtactcctcccaagccccgctgccattcccagagccaaaagcctaggtgacagttctaggggacaggcagagctagggcggcccccagaggccactagagaaacctgcaggtcgtggccatctggcccagggggcagggcggggcctttgagggcccttcggaaggcctcggcctcacacacgcctgccctccgggtctcccgggccctttcctgccccatctagatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccatgtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagagtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactga

SEQ ID NO: 5293 - DNA, 7845 bp, human
tagcttggcctcttccctaagaaataaagaaggcactttggggtccaaggtagggtacttagatgtggaagcaaggggccccggggaggggcggggaggcggcggagagagcccggcgctgaaatggaggcggcccaggtgggaccaaaggggcgccagctgcccggcaagcacgtagtaggtgggttccatgggggctggcgtccgcgcgcgctgtctgggtgcctgcctgcgtgtgtgttacggggagggctgtgtgtgcacgtgtgcttgtgcgtgtcggggtgggggaggagtgtgtgatcggcagaaggaaaagcaggagcagctccctcaggcaacaattggtttcattcattcatgccttctttgttaacgagcatttcttccgcgagcgccgggcgcgtgccaggccctgcactgggggctggggccagcctggggccgggcacacacccgttcctgccttggaggaactcccagtcccgcgaggagaccgaccaggaaaagcagaaagccatccccagcagaaagtggatttggtggaaaagacactggatttggcaggcacgctgtcgccgggacttgtgctcttggccatgtgacccggccgcgacagccgaaatcctgtcactcggcccggcgggaacggtgcatctcgtgggggaaggcggcgcggcgccgctctcgggaggctcccgggaccagagggcgcacgcggcgcgcgcgaggcctgcaggcggcggcgtccccgcggcctccagggggcgctggcccggcccggcggaggcccggggcgcccggcgggggcgggtgcgggggcgggggcgggggcggcaggcgcagcgcccaccctgcggcgggcagcgagcgcgcggcctggctcagcccgccggagggggccagacgaggcccgggcgcgcggcgcggcctcccccagcacagcgcacccgggagcggctgccggcggggcggcgcccagagccggcgctacagggggcctgagtgggggcggcccggcgagggtcgcgggtgagagggggattagggggttggctgcgctcagccctgcagtgcggaggtggcaacaggttcccatttgtcctgttgctggcgctgcgggcgctgtgggccccgagcactgagctctgactttggaaattgagcccctcatggcctcctcccaaatgctttctcccggtgcgaggacttggcagcagggctccgcagttaggtgcaggggagcccctcgccaagcgtcgggagacgtggacccttggatcctaggcttcccctcccttccccattgcggaggttgcctctccccgtcctcattccagcccagctcctctcacctccagggaaccctctccagagagcgccactgagcagctcaggagctccctctctagccgaactgagcccccacggcagggcgggccggggaagtggctgtccagctccctgctggtcacagccctgcgccacccccactctccacaacaagactggcacatggcagaacctccgtggtgccttcaacccctgcccactctgagctcccacccacagctgcagtgggcctggaggcagcccccaggctgggtgccggtgtccacctccaccactgtggagctaggctgtggacagaaaacagaagacaaagtccctgccccaggaacacactgagaaagggggaaagtgaccacactagggagcacagaggagggagactactggctccgagttgggaaggctgcctggaggagggggcctgaagaatgagcagaatctcagaatctgggcagggggcataggagggaggcctgggctggggcccttgcccactgggtgagagaaggaagggcacagtccagctgcccaaagcccttggatgcaggaattaggactcttgttagacgcagggacatggggggtgtggccggaaagcagcccagtgccagggtcctgggagtccccggctagcagcccactgcccgaaagggagggagagaggcaaactggaagccccttagaggtgacccacctagctttccgtcacctgccctcttacctaaccatgacctgagacattttctcctctaactccatggctcctgagaggagtctttagactcgtagtttgctttgcattttccacttgttagaaaaatgctttgtggtgcccatcctcgtgtgcataactttgctttcttttactttagttccttagattcccaaaagtggtcaaagggttgggattttttcctagctcttgatattgccagattaatttccaaaggggccgtaccaatatataaccctgcaacagttgaacagcacgctgatttcacagcaatcttgccagcactgcgtgttctcaaaaatgagaacatttctaatgcagtaggtgggaagtgttacctcgttggtcattgttacttgtttattggagtggctttccttccacgcctgaagttgaaccttcccccaaatatttgttaggccaccgcattccctccttcctgcagtatgcagtgttttcaggttctttgcccatttatctacaggggtcttaaccttttagttgggtatgagctttatcttatctggcgtacattttccttcaacactgttatttgcttttgttgagctttaagcagagaagggacttttagccagatcagcattgtggacacctccccctgaccctggtctcctgcctcagtgctcaccacacctgagaccttgtccagtgctcttgctgcctgtggatctgtcccgcctgttgtgcccatggaggaaaggatggaggccaccagccttggttgagtggatggcattctgacgttgggcagggctgggcagggcagggtggagggcaggtcgttgcaggcccggaggcagggagactgttgtgcaagacgtgacagtgacctggcctaaagctgatgaatttgagccctcggctagggcaagggacaggggagagaggcgtggatgtgagagatatttaggtagaaactagttctttccactttgattagccgaaggggggttaagggaaggaggcagaggggggagccacgggtgactcttaggatcagtaatgtgataagagcagagtgccccagtttagggctgggagctcagggttcctgggtgcttttggccagtcctgtgcgagtgaagcgggctggtattggtaggtatccaggagctacccctgcctgcctagccctgcagcagacctctgggccaaagctgcactaagtttctggtcctgcctcctcctcccctccgtgatttcggtggcatcccaagtttgcccaagctgctagctctgagcccattacagagatggggccactgagatccaggcaggggagaagatgctccagtatcaccctgtgagttgggctggaggcagcttctgcggcagaggggctgggctctggtcctcacccctccccctgcctcccgaggccaggctggcgccggccaggggagccgcagctggtcccctgctgggcccctgacctgcccttggcctctgccccgaccccgtcccgcctcggtggaagccccagctcagccgactcgcaggtcccacccgactgcttcggctagcacccgttggctcaccggcccgccgggcccgcccccggagccccgccccggcccgcccctcggagttgtaactccacgtccgaaggcagtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccaggtctctttccttttgttctctcctaggggtagggggagatgggggaccgggggccagaccacctctgagaggactcgctgaggcccagcacctcggcgcctcctctgttcccctggcccacctggccctgggggagatctaggcctcgaacggcactcctcgcacgcacacccccagccagagtcggaagctcgaacttggggagcgttcgcgagaagaccgagacaggagcagaaagggggtatggagggaggcggctgcgacctcagggtaccccaagatgagcctcgaaggggcggttagccgctcagccctcttctcgaggacccttccccgggccgagctgctgcctggggggtttcttggggcgccttgttgggagtcctcatggtgggggaccctgggctcccgccttcaggacgcggggccggcttcaagtctgagccccctcggccctccggtagctcacaccgcgccttctctctcttcgcagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggtaggtgccgcggggccctccttccagggggttcgggattcatttgaccttaggccagccccacttctttttttctaaagcgagttgaggcccccctcccctgatgacctgccaggctgctttgagaggagggaagcctgagtgtgaccgtggggaagttcttcaccctcggcagcccagtctctgagcctggaaaatggggagaattagcctgacctgagctagttctcaggatgctcaagaacgaattacaaagtgcgggctccccagggtctcggcaagggtatccccacctccccaacctgctcaggaatgagcaagggaggcaggggtcagacagcactggtgcaatcacggctcactgaagcctcctgggctcaagcgatcctcctgccttagcctcccgaacagcatataaagtgttcaggtgtccagcccggggaaatagtatctgtaaatagagatgctggcttcttgagccatattctcccccaagttcccccacatcttggggtcccacttcatccctgagagtcaggagatgcccaggcagagagctgacatctgagttcctccttttctttagctgatggccgcagtcctccctaaggctggcagtgcatctcggctctgttgagccctcacacctgcctcagcttgaccctaggggtgtaagatcctttccggtggctcagcgtgagcccagcttcttgcagcccgagctgactgagggtggctagggccccacgtgggtaccaggacacaccaagctgctgggttttgtgttccctttgggaacatttgcaaaccctccaagttgtccagggtcatctccccagccccagacagaggcacttggctgcccagaaggccaggtcagcaggccccatgccctctccccaacaggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattggtgagtccaccccacccacccttccctcctgtcctccccaaggcctgctctggcctcccccttgtgagtactcctcccaagccccgctgccattcccagagccaaaagcctaggtgacagttctaggggacaggcagagctagggcggcccccagaggccactagagaaacctgcaggtcgtggccatctggcccagggggcagggcggggcctttgagggcccttcggaaggcctcggcctcacacacgcctgccctccgggtctcccgggccctttcctgccccatctagatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccatgtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagagtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagata

SEQ ID NO: 5294 - DNA, 6250 bp, human
catatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggcgatgatggtcgacggcttcagccactgtccagtgaggtagtcatctgcagaaagaggcctgtgcctgggtgggacagcagatgggcctgagaactagcaacagggttgctgtctagccttctcccgaacccatcttgggcagatgtcttgtgtatccccaggagggggatggcccctcgctcccctccctactagtagcatcccactaaagccacccttccagatggacaatgtcctacttcccaccaatgcccggggctgaccaaaagcacaggcttccgtgcagaagagcctaggagtgcagggcaggggcggggagaggtgactactccacagcctctgcctctgcttcctggggctcagagctggaaggggagccagagagccttcagcttgctttgggggcccctgaggtgagcctgcccccttctaccgaaagggcatgttaggcaccaagtccccaagatgcgtgtgtcctgcaggtaaatcccaacagcattgcagccaaagacggccggatccgtgagggagaccgcatcatccaggtgagcacttgcaggctgcaggcctggcccaaggccccgctgtgcccgtcggcccagccacctctctttagccagtccctagctctctcccactaagagctaaccctgaggcccagcagcctgccgtgtcctaaacccgggctgagtctcatctctctcctgcccactcaccccagtggctcccgtgtgcctatgggatctgctggcatccagggcccctgctgctctgaaacctcctggcccctctccctctgccccactccatgctctcctgagcacacatttgctcttgcaagagtcaggccgccctctccctggtaccttccacttagttacatcctcccagagctcaagccccagcctagcccagccgagcccagagtgcttgggctccctgcacccgcccagggtccgccccagggccagccctagcatgcttgttgattgtatcctgcctgcctcagattaacggtgtagacgtccagaaccgggaagaggcggtggccatcctgagccaggaagagaacaccaacatctccctgctggtggcccgacctgagagtcaggtgtgtatgcctggcagggcgacccggggccacgacatcaggctttctgtcttggaagctgctggccgtgactagggcacagatgtgccaacgacctggagttgatggagggcgggtgggcaggggtctctcagggcccgtttcccctcctggcctctgaaggctgagggggctgggacgctgcccccaggttgctgagcttcaccgaaacaagccaagtgcggggtccagagcagacaagaagggtatatggggaggtccttgaagctgtggggacaccagggcctgtctccacagctggcgaaaaggtggaaggacagcgaccgggatgacttcctggatgactttggctctgagaatgagggggagctgcgtgctcgtaaactgaaatcaccccctgcccagcaggtgaggaaggaaaagggcgctggtggggagggcgaggaggagagaactgggtggaaggcgctgaggctgtgcagggtctcccaatgcttggcagggaaatgaaccaggcctgaagccccttccgatcctcctgtgacatcccgtgacatccctgtccgtgggacctaactgagcggtacttacctttctgctctagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggtt

SEQ ID NO: 5295 - DNA, 3260 bp, human
ggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggcgatgatggtcgacggcttcagccactgtccagtgaggtagtcatctgcagaaagaggcctgtgcctgggtgggacagcagatgggcctgagaactagcaacagggttgctgtctagccttctcccgaacccatcttgggcagatgtcttgtgtatccccaggagggggatggcccctcgctcccctccctactagtagcatcccactaaagccacccttccagatggacaatgtcctacttcccaccaatgcccggggctgaccaaaagcacaggcttccgtgcagaagagcctaggagtgcagggcaggggcggggagaggtgactactccacagcctctgcctctgcttcctggggctcagagctggaaggggagccagagagccttcagcttgctttgggggcccctgaggtgagcctgcccccttctaccgaaagggcatgttaggcaccaagtccccaagatgcgtgtgtcctgcaggtaaatcccaacagcattgcagccaaagacggccggatccgtgagggagaccgcatcatccaggtgagcacttgcaggctgcaggcctggcccaaggccccgctgtgcccgtcggcccagccacctctctttagccagtccctagctctctcccactaagagctaaccctgaggcccagcagcctgccgtgtcctaaacccgggctgagtctcatctctctcctgcccactcaccccagtggctcccgtgtgcctatgggatctgctggcatccagggcccctgctgctctgaaacctcctggcccctctccctctgccccactccatgctctcctgagcacacatttgctcttgcaagagtcaggccgccctctccctggtaccttccacttagttacatcctcccagagctcaagccccagcctagcccagccgagcccagagtgcttgggctccctgcacccgcccagggtccgccccagggccagccctagcatgcttgttgattgtatcctgcctgcctcagattaacggtgtagacgtccagaaccgggaagaggcggtggccatcctgagccaggaagagaacaccaacatctccctgctggtggcccgacctgagagtcaggtgtgtatgcctggcagggcgacccggggccacgacatcaggctttctgtcttggaagctgctggccgtgactagggcacagatgtgccaacgacctggagttgatggagggcgggtgggcaggggtctctcagggcccgtttcccctcctggcctctgaaggctgagggggctgggacgctgcccccaggttgctgagcttcaccgaaacaagccaagtgcggggtccagagcagacaagaagggtatatggggaggtccttgaagctgtggggacaccagggcctgtctccacagctggcgaaaaggtggaaggacagcgaccgggatgacttcctggatgactttggctctgagaatgagggggagctgcgtgctcgtaaactgaaatcaccccctgcccagcaggtgaggaaggaaaagggcgctggtggggagggcgaggaggagagaactgggtggaaggcgctgaggctgtgcagggtctcccaatgcttggcagggaaatgaaccaggcctgaagccccttccgatcctcctgtgacatcccgtgacatccctgtccgtgggacctaactgagcggtacttacctttctgctctagcccggaaacgaagaggagaag

SEQ ID NO: 5296 - DNA, 24983 bp, human; identical to SEQ ID NO: 4032

SEQ ID NO: 5297 - DNA, 28324 bp, human; identical to SEQ ID NO: 4034

SEQ ID NO: 5298 - DNA, 27071 bp, human; identical to SEQ ID NO: 4035

SEQ ID NO: 5299 - DNA, 24598 bp, human; identical to SEQ ID NO: 4036

SEQ ID NO: 5300 - DNA, 27728 bp, human; identical to SEQ ID NO: 4037

SEQ ID NO: 5301 - DNA, 24763 bp, human; identical to SEQ ID NO: 4038

SEQ ID NO: 5302 - DNA, 22343 bp, human; identical to SEQ ID NO: 4031

SEQ ID NO: 5303 - DNA, 24983 bp, human; identical to SEQ ID NO: 4032

SEQ ID NO: 5304 - DNA, 22354 bp, human; identical to SEQ ID NO: 4033

SEQ ID NO: 5305 - DNA, 28324 bp, human; identical to SEQ ID NO: 4034

SEQ ID NO: 5306 - DNA, 27071 bp, human; identical to SEQ ID NO: 4035

SEQ ID NO: 5307 - DNA, 24598 bp, human; identical to SEQ ID NO: 4036

SEQ ID NO: 5308 - DNA, 27728 bp, human; identical to SEQ ID NO: 4037

SEQ ID NO: 5309 - DNA, 24763 bp, human; identical to SEQ ID NO: 4038

SEQ ID NO: 5310 - DNA, 22343 bp, human; identical to SEQ ID NO: 4031

SEQ ID NO: 5311 - DNA, 24983 bp, human; identical to SEQ ID NO: 4032

SEQ ID NO: 5312 - DNA, 22354 bp, human; identical to SEQ ID NO: 4033

SEQ ID NO: 5313 - DNA, 28324 bp, human; identical to SEQ ID NO: 4034

SEQ ID NO: 5314 - DNA, 27071 bp, human; identical to SEQ ID NO: 4035

SEQ ID NO: 5315 - DNA, 24598 bp, human; identical to SEQ ID NO: 4036

SEQ ID NO: 5316 - DNA, 27728 bp, human; identical to SEQ ID NO: 4037

SEQ ID NO: 5317 - DNA, 24763 bp, human; identical to SEQ ID NO: 4038

SEQ ID NO: 5318 - DNA, 22343 bp, human; identical to SEQ ID NO: 4031

SEQ ID NO: 5319 - DNA, 24983 bp, human; identical to SEQ ID NO: 4032

SEQ ID NO: 5320 - DNA, 22354 bp, human; identical to SEQ ID NO: 4033

SEQ ID NO: 5321 - DNA, 28324 bp, human; identical to SEQ ID NO: 4034

SEQ ID NO: 5322 - DNA, 27071 bp, human; identical to SEQ ID NO: 4035

SEQ ID NO: 5323 - DNA, 24598 bp, human; identical to SEQ ID NO: 4036

SEQ ID NO: 5324 - DNA, 27728 bp, human; identical to SEQ ID NO: 4037

SEQ ID NO: 5325 - DNA, 24763 bp, human; identical to SEQ ID NO: 4038

SEQ ID NO: 5326 - DNA, 22343 bp, human; identical to SEQ ID NO: 4031

SEQ ID NO: 5327 - DNA, 24983 bp, human; identical to SEQ ID NO: 4032

SEQ ID NO: 5328 - DNA, 22354 bp, human; identical to SEQ ID NO: 4033

SEQ ID NO: 5329 - DNA, 28324 bp, human; identical to SEQ ID NO: 4034

SEQ ID NO: 5330 - DNA, 27071 bp, human; identical to SEQ ID NO: 4035

SEQ ID NO: 5331 - DNA, 24598 bp, human; identical to SEQ ID NO: 4036

SEQ ID NO: 5332 - DNA, 27728 bp, human; identical to SEQ ID NO: 4037

SEQ ID NO: 5333 - DNA, 24763 bp, human; identical to SEQ ID NO: 4038

SEQ ID NO: 5334 - DNA, 2045 bp, human; identical to SEQ ID NO: 4064

SEQ ID NO: 5335 - DNA, 1177 bp, human; identical to SEQ ID NO: 4065

SEQ ID NO: 5336 - DNA, 951 bp, human; identical to SEQ ID NO: 4066

SEQ ID NO: 5337 - DNA, 24200 bp, human; identical to SEQ ID NO: 4067

SEQ ID NO: 5338 - DNA, 14426 bp, human; identical to SEQ ID NO: 4068

SEQ ID NO: 5339 - DNA, 13299 bp, human; identical to SEQ ID NO: 4069

SEQ ID NO: 5340 - DNA, 24574 bp, human; identical to SEQ ID NO: 4070

SEQ ID NO: 5341 - DNA, 14426 bp, human; identical to SEQ ID NO: 4068

SEQ ID NO: 5342 - DNA, 14426 bp, human; identical to SEQ ID NO: 4068

SEQ ID NO: 5343 - DNA, 24631 bp, human; identical to SEQ ID NO: 4073

SEQ ID NO: 5344 - DNA, 14426 bp, human; identical to SEQ ID NO: 4068

SEQ ID NO: 5345 - DNA, 1605 bp, human; identical to SEQ ID NO: 4063

SEQ ID NO: 5346 - DNA, 765 bp, human
cgtaaaagttgggtggctgtgaccagaggcgcatctgaggcagagggcagtgtctgaaggcagagagagacacagcctggcgggggcctcagctgggagcagggaaccaagatttgcagggctcttgggggcccgaggaagccgtgcagagggtccctggctcctggcccagctgtggtcccaagtcctgccctgtctcctgaggctgttcctcccctagagctgccagccaagatcctgactgcggacaatcagacgtacatggctgtccagggcagcactgcctaccttctgtgcaaggccttcggagcgcctgtgcccagtgttcagtggtgagtgtctcgtcctggtagtggtgagtgtcgtgtcccagtggccagggagccagggagggcagggagcccaggccagccagtcagagccaggcccgccctgctccctccaggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaaggtcaggcaacccttgccacatggctggcagtgcctctgggagggagggtctgggcctctggaggacaacagagtgacttccccacgcacgcattaccctcagatgcaactcagatcactcaggggccccgcagcacaatcgagaagaaaggtt

SEQ ID NO: 5347 - DNA, 1072 bp, human
acttctgcctggctgccaatgaccaaaacaatgttaccatcatggctaacctgaaggttaaaggtcaggcaacccttgccacatggctggcagtgcctctgggagggagggtctgggcctctggaggacaacagagtgacttccccacgcacgcattaccctcagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtgaggacagtgacggtgaaagggggcagagtgggaaaagctggaagtccagacctcttggcctcgtccttgctttgatggggaaggctctgacaggagcgggggaaggagacaggagggagggatgggaggggagaagagcccagatggcaggaaagacagacacggctcctccgcaggtacttcatagaggatgggcgcctggtcatccacagcctggactacagcgaccagggcaactacagctgcgtggccagtaccgaactggatgtggtggagagtagggcacagctcttggtggtgggtaagtcctagggtggaagcctccactccagaaggccggggctcacatccctgggccctttcaagcaccgaccctccccaccctcagggagccctgggccggtgccacggctggtgctgtccgacctgcacctgctgacgcagagccaggtgcgcgtgtcctggagtcctgcagaagaccacaatgcccccattgagagtaagaggcttgagctcagtgccaccccaccgtcacttctgccagccctggcccctcctggggtcctccctcctcctggagccttcctggggggacacggtttggggggactcacggttcctcatgggaatctggagatgccagttggcctgggtaatcagggacccagactgtacccaacccctccacagcccttcccccaaagccacatgctgatcactccattgtcggttcatttcttggcagaa

SEQ ID NO: 5348 - DNA, 24200 bp, human; identical to SEQ ID NO: 4067

SEQ ID NO: 5349 - DNA, 14426 bp, human; identical to SEQ ID NO: 4068

SEQ ID NO: 5350 - DNA, 13299 bp, human; identical to SEQ ID NO: 4069

SEQ ID NO: 5351 - DNA, 24574 bp, human; identical to SEQ ID NO: 4070

SEQ ID NO: 5352 - DNA, 14426 bp, human; identical to SEQ ID NO: 4068

SEQ ID NO: 5353 - DNA, 14426 bp, human; identical to SEQ ID NO: 4068

SEQ ID NO: 5354 - DNA, 24631 bp, human; identical to SEQ ID NO: 4073

SEQ ID NO: 5355 - DNA, 14426 bp, human; identical to SEQ ID NO: 4068

SEQ ID NO: 5356 - DNA, 8298 bp, human; identical to SEQ ID NO: 4075

SEQ ID NO: 5357 - DNA, 2296 bp, human; identical to SEQ ID NO: 4076

SEQ ID NO: 5358 - DNA, 8317 bp, human; identical to SEQ ID NO: 4077

SEQ ID NO: 5359 - DNA, 24200 bp, human; identical to SEQ ID NO: 4067

SEQ ID NO: 5360 - DNA, 24574 bp, human; identical to SEQ ID NO: 4070

SEQ ID NO: 5361 - DNA, 13192 bp, human; identical to SEQ ID NO: 4080

SEQ ID NO: 5362 - DNA, 37001 bp, human; identical to SEQ ID NO: 4081

SEQ ID NO: 5363 - DNA, 13905 bp, human; identical to SEQ ID NO: 4082

SEQ ID NO: 5364 - DNA, 24631 bp, human; identical to SEQ ID NO: 4073

SEQ ID NO: 5365 - DNA, 37001 bp, human; identical to SEQ ID NO: 4081

SEQ ID NO: 5366 - DNA, 4810 bp, human
agcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggag

SEQ ID NO: 5367 - DNA, 5079 bp, human
cccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtgg

SEQ ID NO: 5368 - DNA, 4287 bp, human
acttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctca

SEQ ID NO: 5369 - DNA, 5089 bp, human
agcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcact

SEQ ID NO: 5370 - DNA, 3061 bp, human
agcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaag

SEQ ID NO: 5371 - DNA, 5981 bp, human
cgcgccgagggaggggccggctccagctccggggcagcgcccgccccgcccccaggcccgccccgcgctgaccggctccgcgcattggcccgccccgtgcgctggcctgtcccgcgcattggccaagcggccgggaggacgggcccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgtgtgtgagcgcgcgcacatttagagggtgtgtttctccaggtcctctggtggggatgtgagccttggccttttgacccagagcatcctgccaggcccgagtacaaggaaagagctttggaggtgggactccctagtctcatgaccttcagcagctgtggccccggggaaggaggccctggacttatgggagagaccctgccttggaggtctgcttggccacgctgaatgtgttttgtggcacaagccggggctgctcaggctcaaagctcaacagcagggctcccactcttggtggccttcagttctcttcccaccttcaccttcagactttctctccctaatcacacctgcttcgggctacagcagctccccagcatacccgtgggctccagatgtggacatccaactgctcattgggcttatctacaaatgtcctgtctgagtaatgacccagccagatgccccatcaacagtccttgagtcctccctcccctgccaccctaatggtcagtgagtccatgatacctcttgagtctactccctaacctgagtttgcatttgaaaataatttatttttagtacaattccccgcgtttccccattgacattttgtattagttggtgtatttgttattgttgatgcgccaatactgataagttattgtaaactac

SEQ ID NO: 5372 - DNA, 4709 bp, human
ggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggt

SEQ ID NO: 5373 - DNA, 3309 bp, human
cccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttggga

SEQ ID NO: 5374 - DNA, 5037 bp, human
ggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggga

SEQ ID NO: 5375 - DNA, 5127 bp, human
gcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgt

SEQ ID NO: 5376 - DNA, 1355 bp, human
agcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtc

SEQ ID NO: 5377 - DNA, 5091 bp, human
agcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgg

SEQ ID NO: 5378 - DNA, 976 bp, human
agctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaa

SEQ ID NO: 5379 - DNA, 21788 bp, human
gtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgtgtgtgagcgcgcgcacatttagagggtgtgtttctccaggtcctctggtggggatgtgagccttggccttttgacccagagcatcctgccaggcccgagtacaaggaaagagctttggaggtgggactccctagtctcatgaccttcagcagctgtggccccggggaaggaggccctggacttatgggagagaccctgccttggaggtctgcttggccacgctgaatgtgttttgtggcacaagccggggctgctcaggctcaaagctcaacagcagggctcccactcttggtggccttcagttctcttcccaccttcaccttcagactttctctccctaatcacacctgcttcgggctacagcagctccccagcatacccgtgggctccagatgtggacatccaactgctcattgggcttatctacaaatgtcctgtctgagtaatgacccagccagatgccccatcaacagtccttgagtcctccctcccctgccaccctaatggtcagtgagtccatgatacctcttgagtctactccctaacctgagtttgcatttgaaaataatttatttttagtacaattccccgcgtttccccattgacattttgtattagttggtgtatttgttattgttgatgcgccaatactgataagttattgtaaactacagcccatggtttacagtaggtttcctgtctgtgttgtacagtttctatggggttacacaaatgcataaagccatgtattccctcattaacaatttcatgcaaaatacaaaactgggcggctgttgggtgcggtggctcatgcctgtaatcacagcactttgggaggccaaggtgggcgggatcacttgagctcaggagttggagaccagcctgggcagcatggcgaaaccccatctttactaaaaatagaaaacttacccgggtgtggtggtgcatgcctgtaatcccagctactcgggaggctgaagcaggaggatcgcttgagcccgggaggtggaggttgctgtgggccctgatcatgccaccacactccagggacagagacccgtctcaaaaaaaaaaaatatatatatacatatatatatacatatacacatatatatcaaaatcctgtttttcatggagtcaccctaaccgtaacgctcgtttctgtgtctttcctcctttcccttccctcccctccggctgcaaagccatcatttactgtccctagtcctgggcgggccctgtattcctgagccctctctgtgtcctgctactgcaggtggcacactgctcctccgccgggttgaaaactcgccacacaggcctggagctcggttctctttggctggcgcctcgcacgtgaccagcaggcagccggcagctgtggaagcggagcccagagcgcggcagggcggggccggggccggaaaggcgcgtctgcgcacgcccacagctctccgcttcccggctcgggcgaggctgtgttgattggcttaagacgtgggcttccctttgtatgggccggaggcggagtcctgtcccgccccgcgcctggcggcagtgtcttccggttcgcaagcccgcggcgaggttcgttcccaggctctgattggtccggcggcactgggctcgcgcgcagggtgcgggggaagggcgggcttgcgcactgcgtcggccgcgccccggcaccggtggaagggaggtgtcccaggctcccacggcgcccgcggcgccctccttccgccccggccaggcccatgggacccggcccgccctctgccgtccgtccccggcgggcccgatgcctgtcggccgctgagcctccgtccccatgcgggcaggtccgcgccttctgcgggctgcctggcttttggatgctttgaaggggaacaatggagcgaaggatagacggagcagcagggggcagttgcgttcagggccttaaatgccaaacaagtgccctaaaagccagggcccaacactcaggccctaaagtacgggctgaatggggcatcctaggaatagctctggagtgaaaaaaggagtgaagagagcgtttgaaggcaccggctgaggcctttcctgcctgcctgagccctgtggctggctctgctgggtggagggacctttggggaccagtcagggctcggatggaggggcaagatgtgttggggccagctagtgagaggcggggctccctggttccccttggcctgaggcagcggtgggacgtgtgagtctcccgaccaggagcaggttggagtgtgggtgcggctgtacgcgctgtgggcaggggcgcaggctctctagtctcgctggaggactcgaacatcggtacttccgagaccagctgctggaagtccaggtcctgggtctggctagctcccaggccttgaagccccaggtcctgcagacacacacgacgacgtgttcgagaagggccttggtactgggagaagggggcggggagctgagggagtgtttttttccttctgggcaagagaattaattgctcacagttgaaaggcaggaagtacccgcacagcctcccctccccagatctgcaggtcaaggtcatgtgtgcccgcatttgcacagagcctgactctgacatccgtgcacacacacgcctagtacccctgcactagtgcccccacgcccgccttcggaacacacgcctggtgcccaagtgccttgcctctctccccacatctataccccagggatttccctcccaccaaattgaagccagttgtctgcttggcttgtcaaccgcctcccgcctcccgccttcccgatttcccggagaaaagctgctgccctgtggtagagggtggaggaaagccccaccacccctggatgaggggggccccaagacttgcccccagggtagctaagacctcactccgagggggctgcccccctcaggcctatgacgggcaggtgcagctgcaggggaagggaggcagagcagtctcttccggcagcaggaagtggtaaccgcctatggggaaattgtggggctgagcagaaggggaaccggagctgaactctcctcccctaccaagggggcctggagggaacggcagccagctgctgaggttctgctctctggtgctgaccttccttccccctcccctctgaacttcccaccccagctctcaaggctccctggggctccctgggcctctctgggggctgacttgggaagggaggaccccatcggatgtctgggggaaggaggcaacccagggggagtccagagcctggggcagcaatggtgttcatggccactggtacagtgggccagcggccccgctgtgaatggtacagtctggcagtggtgaccagggacagccttctggaggtggtgggatggcagcctgggatgccagcttacgttggggctctcacacctgctccggctgcttggcagcggggctttgggcacaaggcagcctaggtgcaggcccaatgggaggggacggcaaggccggggcacagtggggctggaaggggcgccctgcccccccaggagcccctcgcgggcagtgccagccctgggccgccccgccccaccgggagccgcgctgggggcggggctgggcggagcccgcgcagggtgctggccgcagcgcccccaagtcccggcgccgggcccgctcacggccgcgtgggagcagtggggttcgacggcgcggccgcgaggccgccatggccgctcacgggaagctgcggcgggagcgggggctgcaggctgagtatgagacgcaagtcaaaggtgagagggcgccgggcgctcccggcccgtttcctgcggagaacccaaggtcgtgagggagctccaagcgtccccgcgctggcccagggcccgatgctctccccagcgacctctggagcgggggtggaggagggagcctgagccccttgcctgcctcccgacgcccatttggcctcaaccgcctgccattttcccttccttctttcctgtcttccttcctttggtctctgtcctccttgggtctaccgcttctcacccaaggttcagtggagacactggtggccgctggtaaaagagagccagatgcacccaacgtgcccctcagaaggcagtattttagctacagtgaagtcaaccagcttgattgggctggggggtgagtaagggagtccgggtgagtggattggtggagatcacctggccgtaaccccactgcagtccctggagcttcagcaccttttgcctccctttagcactgagggggagcagaggcgagggccactgtctctgggtcaagctggcgcagtgagtcttggttgagagatttaacagggctggcttctcagccttctgaaattgaacctctgggttctgataaacacccatgtgcaaatcacatgcaaatcagctttgcaaattcttagccaatagcttgtgcccatcttattcagggcatggtaactcttgcaaaggaaagaggcagcagctcagtgccagcagctcgtccatatcactctcaatcactccattttaccaattacggaaacaagctcagagaggtgcagtgacttgcccgtggtcatacagcactgcaacttctaggacgtagaatgcaatgacccttgaagtgcctttgaacccagagatgtaggttctaacatcattattcagtgcaagcaatttataccaaagtatgctccagtcctcctttggaaaaggcagcctgtgtccagagccagcttgaggtgactacacagggtgagccagctttccaagcctcgccatcatcttgctcagatggaggtaatgatctccatcctgcttccccaaaatgccatgaagctgaaagacttggaaaacttcagtcagcaaatatgggtcagtgatttcacactgaaaagttggggtttcgagcacgactgtctaagggttcctcacttgctctgggtctgcatcccacaccctggaaaagcttcctaccattctacaaagtggggtcactgtcttgacaccctaaattctcaaaggtcagcatagcggtggttttggagaccatcttttcttctgttttgcttgtcagcagaagtgagaccaaatgccttgctcacaggaagtgctggtggggcccggggcccagctctgtaattcaggcagacatggattccagctctccttttgccagatgtttcctatacatctgtgctgtcccaggccctgggagtatactgctgtaccagagagaaccccgactccagcccctccagccctggctttttacccagagtaaaagcaatgattcaatgaggactcccctgatttcaaatggcgtcagtggccaccccgccctcacatggctcacgggtctagtgggggagacatagactttgcattatgataataagcactacaaagggaaggaaagtgcacggtgccaagaaggggtcggaagagggccagccctagtttagggggaggtcaggacagggtgtgctgacgagtttgtctgaactgagatccgaaagctctgccaggaaagccaccaatgcaatcgacttgcaattcacaagttgcctgctcaacaccagccggtgtgcatgcccggatctggactaggacatggcttccagtcagcttttgctgccggcagtgatgaagaaaggcagcggttccctctgctggttccttctgcactgttcagttgtcataagtccccagggattgtattcctctgggggaagcagggcagggcaggctccagagggccagtgaggcgagcagttgtctaacacctttcttggaatgaaatgaaatttacttttatcaaaaaatgttaaactgggccaggcgtggtggctcacgtctgtaatcccagcactttgggaggccgaggcgggcggatcacctgaggtcaggagttcaagacccagtctggccaacatgatgaaaccctgtctctactaaaaatacaaaaattagctgggtgtggtggtgcgcccctgtagtcccagctactcgggaggctgaggcgggagaatcgcttgaacccgggaggcggaggttgcagtgagccgagatcgcaccactgtactccagcctgggcaacatcctccgtctcaaaacaaaaaatcaaaacaaaacgttaaactgattcagtgaggactctcctgatttcaaatggcattagcgcccaccccacctggccttggagctgacgagttaaccacaggaggccagcctcggataggatgaagacactctccatctgtctcacttggcatcgtgggctctgccctgctctgtcgggaggtcccgtgccccaggcttccacttacccagcttgatctgccggtgggaagagctctcctgttcagtaattcaattggaagggtcaggctcctgggtccctcacctggctagtctggtgggggcagggagtggagggacagagggatgggtgacgcatgcagccagggctggggcacctggagtcaagggggctgagactaggaaggggacattctccaataggagatcaggggaggaggtagggatgctgggcaggcggaacccacagggtccccatgcaacagcccctgggaagtcactggcgggacagaaatccaatgggattgagctcttctcagcggagtcctccctcgctgctgctggtctgaatcctgccgtcttttgcctggactagcacagtagctgccacctgggctccacctggcagtgtgagggggccctgaaaacgaagctggaccacatcaccccactactgtggctcctctctcactcggagtccagctgggagctctgcccagaccccgggctctgtgccatctgtccctaccggtctctcggactccccctactgcccacgtacagccagctccagccttctgctccaacgatgcggcttgttcttgaccaccctcctttaaaaagaggtcctccctgtccccacccacccctggctctgatcttgctttgtgggttcatcttctccgcacccatcactcctgggcattctgatatgtgttcgtgccccattccaatcccagctccaagagggcagacacttggtcaaacctctttgcctttgtatttaaaacgtgcctgccacagaatgggtgcataatcaacattctgctgaatgaagacatcaattcatgtccctccctggggatgtggatggagatgagtaggtgggcagcctgctggccagaagctgagctagcatcttatttactcgggacgggcactcaggagatggcaaaagtgtcttccgcaggttgcttaaacttgctggacaggcacttctttgcttcaggcctgtgtgggggaagcagcgttgccaaatcaagccagtgatagggtgtcaaaaggccggcagtatggggccctgggtgtgactctctctgcagggtgggggaatgcacaggtggggcggggggtgattgggagtgggaagtggggtcagaagacgggggctagctccctgccccattctttcacttacaaggccggatcagctctccctggctcccagccctcactgtggactgtcctttcccctggggcctgagggcaggcttccccagccactgagactgcgagatcgctgcaggcttgccctgagcagcactgtgatctgtgtgttgtgtatccgtgtgtttgcaagggaggctgccacctcccggagcctgggtaccggcgggaaaggaagtcgcaggggaaaccattcagaggctttccaggaacgagggagagacaggaagccaaactgaaaggtgcctggctggcgctggggcggctctcccctctctctgggacacccttccccttccccctcaaccgggtggctctggccatctgttggcctcagcgcagaggtcggctggacagctgaggccagatctgcctgcaggggcctagcttctttcctcccctcttagctcttgccctcagcctaggctgggtccgaaggagccctcagagccgacgggactggggtctgtgtgcctctgcctctcccatcccacgctggcctggctgacccaggcagggcgtgctgaccaggcctgagccatggttccccccacagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggtaggtgatgtgctggcaggggggccacggcagggcccaagctccgctcccaggtctcagtgcccctctacccccaggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaaggtgaggctctcatcctgggccacgggaagtgttcgaggctttgggatcaggaggcactgtggctgggagggcactggaggccaggtggggagcaggcagagcgaacctgtgtgcccccccgatggggcttgatctgggcagagcttccagtgcctggcggggccgctctgggcagtgccgtgctcacccttgcctctgcctctagagcagggatctggagcagcagctgcaggatgagctcctggaggtggtctcagagctccagacggtgaggaaagggctggggaggggcctgccccaatggtccagggagaaatgccactcacagtggggaggaacaccgccagaccatcacatcaccccaagccaggctcagggagaagcacgcacctaggggcaaaggcctctctccctaggcacagggcgttaggctaagtgctcacatgggatcgcccagctctgaggtccaagttccagaggggcaggggtagagggctgggggctggcccagccgtggccttcaccagcaccaccttgctttgggtctccctgcaggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaaggtgggcctggagggcacctcagacgcaggcctatgggccatgggccctaactaggacctgctgtgctgagggggaagtcagggctgggtgcaggggagggcaggagtggcaggacagtgccatcaggttccagggattccatacggaaggctcccagggcctgagagagtggggaaaacagttgcctggccctggacagccccatgcagcctctccatgctcccagcggggcccctgcagctctgctgttctgccagccattccgtaaggtttcagaggggggcaagaagacacttagggtgggtgatggggtgacacgcacggagaaagggccttcgaggtgagcccagtacagagagtggggaggctgggaaatgcctggatggagccgccaggctgtgcgtggctgacagtcatggtctctgggactctgggagcagaggagggagtcgagcatctcaggtgttcttaggggaaatgacagagtttggctgtgttgggggaaggtctccctggctgctgtggttagcgtgccagctttagccaggtgcggtgactcacgcctgtaatcctagcattttgggaggctgaggtgggtggatcacgaagtcaggagttcaagatcagtgtggccaacatggtgaaaccccatctctactaaaaatacaaaaattagccgggcatgatggcgggtgcctgtcatcccagctacttgggaggctgaggcgggagaatcacttgaacacagcaggcggaggttgcagtgatctaagattgcaccactgtactccagcctgggcgacagagcgagactctgtctcaaaaaaaaaaaataaaaaaaaaatagagtgccagttttagaacccaggtgccagcaggttctgtttcatggctcttgatgatctatccctaccctttggggtactcgttccccctcagctctggcccccgcagaggcctgtggccgcttccagctgtgcacctgtgtgctggctccaagctgggtttctcgtgcaccctccatggtggggtgccatgtgcgcaccttccactcatcaggtatctgtgaatagttctgtgtcatcccccacttctgtggggaatgttgtggctcgaaccaaggcaagtggcgggtgaacagccggggaatcaagtcacctcctggcactgggctgagcacactgtggactgtggcgtggggaaggcagcaggacttctgggcttgaccagttcaggtgtagttgtccacagtgggaggggaggcgatgggcattacatgaaaggctagagataggggctggccacgtgcgtgaccctggcacgcttgcattgtcttgagtagcggcaggccaagttcatggagcacaaactcaagtgcacaaaggcgcgcaacgagtacctgcttagcctggctagtgtcaacgctgctgtcagtaactactacctgcatgacgtcttggacctcatggacgtgagtccttggtgggcaggtgggaaaaggtgcctggtgcctcggggctgggaagctgtggctccaggacctacccaagcatctccttgtttcctcctcagtgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtgagggtcaccccctgctgggcttggcattctctggccttcactgtaatggtgggcagtggagtggcatgacccacactttgctcaggaatccaagttctccatggtctcaggcagtgcggcagctagagaagtgtcccacttccatttgcagcctcactccaagggtgcacccccgcaatggccaaggagggcaagacactaactgttcaaaccgtgcagcaggcagccgtgtagctgcccatacattgttctaggctggtttctctgtgtttttaaatttcgtgacacaaacttggcagtaagatggaatggggcttctttatccttctccgtcgagctagtttttcctgcagcagtttatcctgatgggcattgtcaatgatctgggattacattgggcccctttcgggccgacttggaactttacgaagagtccggcatcaccagggcttccgatggcgtcacagctgctccctaacccacccctcccgttcccagctcccacccccagaaacagccacccacctcccggtgtcaagcagccattttccattggccaatgatgacccagtgccaccagcatctctcacagccaccacacgcttccctgcatcttgttctcccagtgggcttatcccagaatttttggctaaattaacattcaatgtttaaatcaccatgacaacaggtactgttggcagctgagccatgtactgtattaggatcacatgtccttccttggacaatttttccttttcttctggaatttataactctcttgcctcaggaatgctgcttgctagaacatgcccattgctaggagttgatcgctacctcgtcccagcactgtcctccacaccaggcacctgtgaggtcaaccttctcctctgcgccctcccccagagccttccagtctggagtgcttcacttctgcccagtgctctgtttccggattccacggcagcagctttcttagtttgatacccttattttggtgacaccttcaccaagggtttcctgactttgcacatctgaaaatgtctgtattctttgttttgttttgttgtgttttgtttttgaaacagggtctcactctgtcccctcggctggagtgcaggggtgtgatgtgatctcagctcactgcagatgcaaccttctggtcctcccatctcagcttcccaagtagctgggactacaggcctgcactacaacgccaggctaatttttctatattttgtagcaagggagtttcaccatgttgcccaggctggtctcaaactcctgggctcaagcaattggcctgcctcggcctcccaaagtgctgggattacaggtgtgccactgtgcccggccaaccctttattcttatttcatgaatacagtacttcttgaatctttctgaagcttttattttttttgagatggagtttcccccttgtcgcccaggctggagtgcagtggcacgatcttgacccactgcaaacttcgcctcctgggttcaagtgattctcctgcctcagcctcccgagtagctggaattacaggcacttgccaccacacctggctaattttttaattttttaaatttaatttattttatttatttattttttgagacagactctttctctgtcgcccaggctagagtgcagtggcgcaatgtcggctcactgcaacctctgcctcccaggttcaagcaattctcctgcctcagcctcctgagtagctgggactacaggtgcccgccaccacgcctggctgatttttgtattttaagtagagacagggtttcaccatattgtccaggctggtcttgaactcctgacctcaggtgatccgcctgcctcggcctcccaaagtgctgggattacaggtgtgggccaccgtgcccgacccttttatttttattttttagtagagacagggtttcaccatgttggccaggcttgtctcgaactcctgacttcaggtgatctgcttgcctcagcctcccaaagtgctgggattacaggcgtgagccaccatgcccggcctgaaatgttttttgttttctcctgttcctgcatttgctctattttcttgcttttgttcgtgagtccaaaatccctgctatatcctttccagagagcaaatagttagttttctgctgatcgtgtctgtttggtgattcttggccatcagttcatatttaagaagaggcctgaacacataccccacaaatgtgggtgtctgtggtgtttcctcctggcccggccagtttccccagtagaaactcttctgaccctgtctagggaggagagggggtgagagggctgggggctcactctgctgtgtggatttccttggaactacctggttttagttccacaccctccagccaaagcctagcaggaacagccctataatctccattgctggagggagccctgctccgtggggagcctggggcctctcagtgagagggtagtggaaaggccttagaggacttgggcttgccttaggggatctgggggagggcccaggtaagtggggcttggtcctggattggatgccttctggaagcagggtaattgtatgattggatgtcttgattaatcttatctagaaagagacagtgatggaggctgaagtgatgcaaggaagtgacagtcacttacattagccaggatggagggatgattttgtggctcggaagaagttcttgattttgtcctcactcatgcgtgatcgcagagtggtcttgtttctgtcttcgcccatcaaggtcacacagtggccttgcctgatgttgatgctctgggtcatttccggtgttcagcaggacagcactgaggccgggctgataggaccaggccagcttccgatggtggggctgctgtgttctctcatcttcctcatctgggaccagtgtccctgagtccaaaatccctgctatatcctttccagagagcaaattgttagttttctgctgatcgtgtgagtttagaggagggataaaatttcaatgttccccagagtatgcatacacttattttttctctagagagagggtctggctctgttgtccaggctggagtacagtggtgtgatcatagctcactgcagcctccaactcctgggctcaagccatcctcctgcctgagcctcctcctgagtagctgggactataggtgcatgccaccatgcgtggctaagatttgtactttaaaaacaattatttttaacctacttatttatttatttattttgagaccaggttatgagacagggtaatttttgtatttttggtagagtcagggttttaccatattgccaaggctggtctcaaactcctgggctcaagtgatccacccgcctcggcctcccaaagtgctgggattgcaggtgtgagccagtccagcctagatggacttttaaaaaaaggtgtggcagaatacacatagcataaaacataccacgttcaccatttgtaagtgtgcggcccaggggcagaagcacattcacggtgctgtgcagccatcaccaccatccagccgcagaacttgttcatcttcccaaactgaagctctggccccgttcaaccccaactccccaccccccagccctggcacccacccttccactgtccgtctctacagagttcacggctctcctttgaggcccctcacaggagtggaatcctacagtgcgggcctttctgtgactggctcctttcactgagtcccatgtcctcaagggtcagccatgttggagcccatctcaaaatggccttactttctactctgtgacttgcgccttcatgcagtcctgtacggcggggcttggtggagatggagagcagggcaagtgtttagccacagctgaatcctcactctcaattttaactgtaatgtcaattttctagatgtctacatgcttaaaagagtaattccttcctttctaaagcgttggctcccactctgcccatgaggcaagctgctctcatcttgccacagggaaatttatgtctgcccagttacagtgagcagtttttccgtccactcctttccctggaagaggtggggctgggctctccctgttctgtctcagaccccagtcttccttaccattctatttcattttattttattttgagatggcgtctcgctctgtcgcccaggctggagtgcaatggctccatcttggctcactgcaacctccgcctcccgggttcaagcgattcccctgcctcagcctcccaagtagctgggactacaggcgcatgccaccgtgcccagttaattttttgtatttttagcggagacagggtttcaccgtgttggccaggctggtctccaactcctgagttcagataatccatccgcctcagcctcccaaagtgcttggattagaggcgtgagccactgcgccgggccaccattctgttttaaatagagttttattaaggtacgattcatataccataaaattcagcactgtaaagtgtacaatttggtggttgtgcagccatcaccatgtaattccagaacatttttgtcacccctaaaggagccactactccccgttctcctctccagccccactggcaccccactgctccagctggcacccactctgcttcctgtctctatggatttgcctggctggacacttcacataagtggattcattccttctcgtggctgaatcctcttccattctgtgggtagaccgcgctgagtttagccatccgtcagttggatgagtggtgccgccacgaacctctgtggacaagtcttggtttggacacgtgtgttcactcctgccattcttcagctgagcgtctgggctggtggtcctgtgcccggccgccaggccacaaaagggtgcttgcttcccttatgccccggggatcttggcacctactgcccaagcccagcccttagccccctggccgccgccctctgcaggtggctgagatctgcgttgaaatggagctgcgggacgagattctgcccagagcccagaacatccagagccgcctggaccgacagaccattgagacagaggaggtctgggcagcccaccgggggttagagggagacgagggcctggagcctgtacagcctgctgttggaagtggctgccctgcctgcccccctccctttggccccttccttctgacttggacttcctgtctccctccctgtcccccacctcttaccaccctggtgtggtctcctctgcaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacggtggggagggctgggctggtgggcgggacccgtgggggcattgctggggcagagggaggggctcaagccagggctaacacttggggctcttcttggggctgcccagaagctccaggagtatctgagtggacggagcatcctcgccaagctgcaggccaagcacgagaagctgcaggaggcccttcagcgaggtgggcc

SEQ ID NO: 5380 - DNA, 14809 bp, human
gtgaccctcaggtgatgcgccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaagaggcaacatactgacacacccaagggaggcgggagggtggggaagacagcagcagagggcaagaaacttctagaacttcagggtcggcaaagcctgtagcagtcattttgtcaaactccatgatggggccacttggcttttggctgcacacctctgggggaagaggctgcattggcgcccagggccatctttccattcggagccgtcctgggagagagggctcaggcccaacagaaagctgaaagctctcatcagggcagcccgagtcctgccattgggagttgcccaatccgaaagttttgcacgcaggccctcaaagaagctgaggacaccagtgaccgccccactcctggccctctccccaggtccctcctccaaaccaaattcctttggtgccttcaagaacatcgtgcaggccgggcacagtggctcacgcctgtaatcccagcactttgggaggcagaggcgggcagatgacgaggtcaacagatagagatcatcctggccaacatactgaaacctcatgtctactaaaaatgcaaaaattagctgggcttggtggcgcatgcctgtagtcccagctactcaggaggctgaggcaggagaatcgcttgaacccgggaggtggaggttgcagtgagccgagatcacgccactatgctccagcctggccacagagtgagactcttgtctcaaaacaaaacaaaacaaaaaacaacaacatcgtgcaggctgtggtttccagaagccacgccagctccttgattgccaataaacatcccgctgtggggtggccaggaccgagtgccaattagtgacagagtgcccagaccaaaccggatgaggatcttgcagttgacctcaacatgactgtgcccagaatttccttggtggcaatgtcaacagtctcttcctagatgcccccagacttcatcaatgcatgatgcttcagtgcactcttttcaaatgtcggggtgggttttttttttttccacaaaacttcaagcatctactaaagtagagggaggagtgtaatgaactccggtacccatcactcagcttccacggtttcatctcatttcatctgtgacccctccactaccctttcttcctgattcttggaagcaaatccaagacatcacacccttccctctgtaaatctttactatgttcctctaggagaaaagggctcttctcaatacataaccacaagtcatcatcacaccgacaagtgtaacagtatttcctgaatagcttcaaatatcctagtagtgttcaaaaaatgtcatacgtattttcagtctgcttgaatcagggctcaaataaggtccacacattcagattgactgatatgccttttgactacctttgaatctagaggttccctttctatctccctgcaatttatttgtggaagcaagcaagtcgttcatgacgtagcctaacaggcccctctgacgttgttcattatgatttttctgtaaattggtagttgatctgaggatctggccagaggtaggttggatttgttggtgtgttttggcaaggagagtgtctcttttctggggtgttggcagctactgaaactcaatgcccagaccaattaaaccactggggatggaaaatgacggcattcggacaccttaccctgccttcacctattggtgaccaaaaccttaacatcttcacaggtcttcttaccctgagggtatatgccactaggttgtgtagtaaaccggtgtgtttccagtcccttagaatagtccctctctaagtgatatgccactcagtggatatgcatttagcttcatttcttttgttgctgattttcagagattgctctgtaaatttaaacttttattttactttattttattttttcgagacagtcttactctgtcgcccaggctggagtgcagtggcgcgatctcagctcactgcaacttccgcctcctcggttcgagcgattctcctgcctcagcctcccgaggagctgggactacaggtgcccgccaccacgcccagctaattttttttatttttagtagagacagggtttcaccatgttggccaggctggtctccaactgctgacctcaagtcgtccgcccacctcggcttcccaaagtgctgggattacaggtgtgagccaccgcccccggccacttaaattttgttttataattatgtaataaaacagttaaaagtctcaaattaaaatctagaaaagaaggtgtatttgaagaagtctggcttctctgcgccaccaccgaccgccccttccctacctgcctgtatttcctcgaatcactttgcctgggagttgactttgattctcttgctcattgcttcatgaaattcagttccagaactttcaggagggaggggtaggccatgacaccagctctagttacactggtggcagctcctgtcccctcccccactgctgctgggacctgttctctcctttgcccccttgtccctgcactgcccaatttggaccgcaagggttgccagggaagggcactggctgccttgttttcagaggtcgtagcacctagattgctccagccccttgcacttgcctgcaggccagagtgtcccaaaccctcccagtctcagctgctcttccccagttcacccaaggtacttcccagggaagagctgccgacagtttgggggttctctgttcttaggtccatcagcaaccccattgctcccctctgcttccttctgcacggagactgacgccatgcaggtcttcaattgtcaatggtctgtccctgctgctcatactgggggttcctggggagccagtgccaggtatcgggattgcagacattgtctgtgggtttccagaagctccttgtgttaggaacatatggggcccgtgcacagagggcagcagaggccttgtgggatccagctgtgctaggggtgagatttatctgtctctcctggccatagccaggaaatccccatttttcttaagctagcttgagttgggcttttctaacacacagctaaagaatctcttgataaaccttgggactctccatgaggccttatatggcagcaggtctgtggcttgcaatcccttcaagtaatctgccaaaaacaatgttatgacgaaggtccttccaacacaaaaggtgtagagccctagcaaactcctacagaagaaaaaggagaaataattcgtttgtagtcccagctacttgggaggccaaggtgggaggatcacttgaagtcaggagttcgagaccagcctaggcaacatagccagaccccatctctacagaaataaaaaaaattgccattgtggtaatgcacggcttgtagtcccagatactcgagaggctgaggcaggaggatcgcttgagcccaggaggatcgcttgagcccaggagttccacgttgcagtgagctatgattgtgccactgtactccagcctgggtgccagagccaggctctatctctatttggtgttgttgttgttgctgttgttgtttttgagacggagtcttgttctgtcaccccggctggagtgcagtggcgtgatctcagctcaccgcaacctctgcctcctgggttcaagtgattctcccgcctcagcctcctgagtagctgggactacaggcgcccaccaccatacctagctaatttttttttcttttgtatttttagtagagacggggtttcaccatggccaggctggttttgaactcctgacctcaagtgatccaccccctcggcctcccaaagtgctgggattacaggcgtgagccaccgctcccagccgactgtatctctaaatatataataatcataatcataatcaggacagccgtcatattggattagggcccaccctaatgacctcatttaaacttggtcatttctgtaaagaccctatctccgaaaacggtcacattctgaggtattggggttaggactccaacatatgaatttgggtggggacacaattcaactcataacacattcattgattaatttcctcattcatttattttctgagcatctattgtgtgctggacactctgtgaggatgaatgagtcaaagtctctggtgagaaagacaagacttgtacttgtgtctcagtactggctgctataagaaattaccaggctgtggccgggcgcagtggctcacgcctgtaatcccagcactttgggaggccgaggcaggcggatcacgaggtcaggagattgagatcatcctagctaacatggtgaagccccgtctctactaaaaatagaaaaaattagccaggcgtggtggcgggcgcctgtagtcccagctactcaggaggctgaagcgggagaatggcgtgaacctgggaggcggagcttgcagtgagccgagatcgtgccactgcactccagcctgggtgacagagcaagactccgtctcaaaaaaaaagaaaaaaaaaagaaaagaaaaataaattaccaggctgtgcatggtggctcatgcctgcaatcccagtactttgggaggacaaggcaggaggatctcttgaggtcaggagtttgagaccagcctggtcaacatggtgaaaccccatgtctactaaaagcacaaaaattagctgggtgtggtggtgggtgcctgtaaatcccagctactactccggagctgaggcaggagaattgcttgaacccaggaggcggaggttgcagtgacccgagatcacatcactgcactccagcctgggtgacagagcaagactttgtcccaaaaaaaaaaaaaagaaaagaaagaaaggaaaagaataaaagagaaattaccatagattgggtggcttttaaatgataaatttatttctcacagctctggaggctggaagtcagggtgctagcgtggtgggctctggcgaggaccctcttcctgactgcagattgccaacaactcattgtatcctcacatggaagaaagagagctagagagcactctagggactctttttcttgtttgttttaattaaaaaaaaattttttttacatgggcatgccatgttgcccaggttggatttgaactcctgggctcaagcaaccctccagcctcagcctcccaaagtgctgggattacaggcatgagccaccattcccagctaatttgggctgttcccaaaggctcaagtgatcctcccacgttggcctcctgagtagctggggctacaggcgtgagccaccatgcccagcttctaggacctcttttataagggcactaatcccattcatgagggccccactcactctgcacacatgacctaaatgacctgccaaaggccccacctcctaataccatcaccttgggggttgggatttcaacacagaaatttatggggggcacgtacattcagatcatcatgaacagtaactcctatgtgtgacagaaggtgacagaggtgggtagtggtcttcccctcaagggggtgagttgccactagctggggaatcttctggaaggcaaatgcatatgagctgggctttacaggaggcaagcgtttctctatggaagggcagaggactgtgggaggtaggaggtggggctggggcaaagggaagaggggagcagggaagtggggtgactgcacactgggagtggggaatcagatggaggagacgatgaggagttctgttaagttcaagatgccagtgccagtgaccagcgggcgatggtctctggcttgagggacaggatggaggggagactgtctgaggatggacaaagctggagggaaacagccaattgcaaaggcaggagggcggaagggggaggggagaggtgggatcagcactggtatagacaggcggtgctgcagcccagctcctctctctcctctgcctcctgccctcaggccccttcgaaggcccgaattaccacatcgctcccagatgggtgtaccacctcaccagtgtctggatgatctttgtggtcactgcatccgtcttcacaaatgggcttgtgctggcggccaccatgaagttcaagaagctgcgccacccgctgaactggatcctggtgaacctggcggtcgctgacctagcagagaccgtcatcgccagcactatcagcattgtgaaccaggtctctggctacttcgtgctgggccaccctatgtgtgtcctggagggctacaccgtctccctgtgtggtaagccagtcggggcccaggctcggcggaaaccactcattcaccctgcaagctcctccagccacctcatgatgatcggggcccagctgctcctgtaggcctgtctccctccacatctgcgcctcacatccatatactgaagggttctggaggcttccatctgaacactcacattaaattcagctcccttgagtcaaacataccctgagttcctactcttgagtcaggctctgcccggggacagccagtttggagctgtggggctggtgtgggaggagacagatacagagctagacaaccccagaacagtaggggggcggggactctgggcaccctggacagaactcccctgcaattagggatgcctgctctttcagctcgccagcatctgcttttcccggaggagacacaattcccagatcctctccccatccccatcactaatatctctgtgggccactattccgctcaggtcaggagacagtggccgagaggtactagcgtgccaggctctgtgctaaggagggggccctatagccagacggcaaccacacagtaccatcatcagtcctctcagacaagaaggggcctggggcaggtggtggaggagcggctgggagcagtttgtggttcgagtggatagagtaccaccaagcagccgtggctgctggacacgaggtgggcaggcccaggtctcagaggcctcagacgtcatgcccaggagctgggactttctttcaggaggaggagaccccacatccagcagcagcagctcctgctcttgcctccccaccactcttagcagcctccccaaccccaccccgttaactgcctcaaattgtacccacgatggcccagaccagagagggtgcttgtccaagtcccggcactaccccgatagtgtagaaggggagccaagggaaggtcaggcagagaaggtccatccccaggtccgagtgctctctgcagcaggcatggcctcggtggtcacacgacccttcccgagtgccccccctgcatctccgcccacgtctgtctccgtttctgccatggtctcccgctcacccttgcctctgctcatggtctgttcttgggtcagtcaggtgccaagcagccagcacttccccaccacttttggtccacggatgcccttggccatctgggaagcctgtggaccccatctcaggagaatttttgcaaacgcataaaatgagacccataggattacaaaggcagcaaattatactgaaatacagttatcaaagtattaaacattcatcagtaacatagtctttagttaaaagcatttactggccaggctcatacctgtaatcccagcactttgggaggctgaggtgggaggactgcttgcctccaagagtttgagaccagcctgggcaacatagtgagacctcttctctacaacaaataaaaacagctgggcgtggtggcacaccagtagtcccagctactcaggaggctcaggcgggaggatcgcttgagctctggaggtcaaggctgcagtgagctatgatggcaccactgcactcagcctgggcaacagagtgagattctgtctcaaaaagtaaataaaaataaaagcatgtgttaaacgtattagtgacaccactcagtattaaggtattaaataacaggatcccgcctgacaaccactgttatttcagagtagtgatgaacataagtggtattcgaactctctgccacctctatgaattgacaggaaaacatctgtgacctctcttgctgaccgagtcacgggtactgctaatactgccacgttcataatggaaggaaatgcccagtgtctgttcgaggttggtggaaagaaagatgtcgttttttccacctcagtccgtggagccctgaattctgtgtgcagacgtttggggtctaagcaggacagtgggaagctttgcttcccacctttgctttggctcaaagccctcatctgtctgctctccccatagggatcacaggtctctggtctctggccatcatttcctgggagaggtggctggtggtgtgcaagccctttggcaatgtgagatttgatgccaagctggccatcgtgggcattgccttctcctggatctggtctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccagctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatgatctttgcgtactgcgtctgctggggaccctacaccttcttcgcatgctttgctgctgccaaccctggttacgccttccaccctttgatggctgccctgccggcctactttgccaaaagtgccactatctacaaccccgttatctatgtctttatgaaccggcaggtaagcaacaccatcagcagatcccactcaaaataccgtgtgccctagaagggtgcagtgatggccccacctggaatcatgtctctgataagaagcccgcggagcatctgggggaccctccagggaaatgaccgggaaaggctcagcgtgtgacccagccccagccagagctccagctggcccttagcagaaggcttaggtgtgccctctggaatcctttatagtctcggcctgagggtggcatttcccaaagcgtctgtgtgccgtgcgctcttcccttccggtggccctagaactatggctgccgagcttcaggggctctcctggcgttcagacgctctaggagttggtgagccctaggtacatccaccctaggtgtgcccctcttctgttcagactcgacccttctcaaccttcatctctccattttcaaaccgtaacctctggaatttgtcttcctataagaacaaaagccggccctccttggctacactgaccaagagttcaagagctttcacgagtttgtgggttagttcaggggggacgtgctgtggtcctgcccagaggcagcctccttagctggcatattgggcctcagcagcaagctgctcacacacctaaatccccccacctcctgcaggttacaggcttcattaaagcgcagctgtgatgtgacttgatggtggccagaaaggtgtgcagaggcctcccatttcaccaggcccagtccatcccttccactgggctcttccttgcttctccatcttagagccactcaatggctccagcccctttggctcagctttgactcacacaagccaagtctgcagagttcattaagggttcattctctctggtaacttttaaatagtaagtaggaccaggcctgcagtggatttccgggaactcgctgtagcacactgatgcccagagtgtagttctatccctgacccctgtttcctgactttcatgaggatcttttttaggtttctggaatcctaaactatcttgccaagtactgtctttactggattatttccattctcctttccagaactccccctggacagggggagacagatgtctgcacttctggacctcaccaggcctcgaactttgcttttaccctttccacataattatcctgtcctgccacattctgagagaattttctggaacgcagttccatgaagacagcaaattttgctcaggacagagtctggcacacagtgggtgctcaagcagcagctgctgaatggattcctcagccctatctcccagctcttcagccgagctgattctgctgtttgtcccgtttcttatgttattaatttcaaccattatattttttatttttgagagttttgatgatagagggagttagagctagtcaagagtaggcctgaaatatttagaaaatgcctttggtctgggtcctcaaagcattgtggttacttcagggatgacacaggacatgatttgagacattcatatggcccagatctctttggggtgaagcagcaaagacagacccctcctggtaccggaagacgcttggctggagagatgaggtaggggctagattgtcattacctaggcctcaccttgccccagatccatggactggaaaaaacatgacaaccacatgccttttcattaatattcctccgagccgctcaccagacagtctggggacaggtcaccactgccccttagctgtcactgtggatgagtgtcatggggctgccgtcacaaactaccacaaactcagtggcttcaaaccacagaaatggattctctcagggttctggaaatcttgagtctgaaatcagggtgttggcaaatggaaaggttccctatggaggccgggagggagaagcagctgcagggctgccggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaa

SEQ ID NO: 5381 - DNA, 12124 bp, human
tccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaagaggcaacatactgacacacccaagggaggcgggagggtggggaagacagcagcagagggcaagaaacttctagaacttcagggtcggcaaagcctgtagcagtcattttgtcaaactccatgatggggccacttggcttttggctgcacacctctgggggaagaggctgcattggcgcccagggccatctttccattcggagccgtcctgggagagagggctcaggcccaacagaaagctgaaagctctcatcagggcagcccgagtcctgccattgggagttgcccaatccgaaagttttgcacgcaggccctcaaagaagctgaggacaccagtgaccgccccactcctggccctctccccaggtccctcctccaaaccaaattcctttggtgccttcaagaacatcgtgcaggccgggcacagtggctcacgcctgtaatcccagcactttgggaggcagaggcgggcagatgacgaggtcaacagatagagatcatcctggccaacatactgaaacctcatgtctactaaaaatgcaaaaattagctgggcttggtggcgcatgcctgtagtcccagctactcaggaggctgaggcaggagaatcgcttgaacccgggaggtggaggttgcagtgagccgagatcacgccactatgctccagcctggccacagagtgagactcttgtctcaaaacaaaacaaaacaaaaaacaacaacatcgtgcaggctgtggtttccagaagccacgccagctccttgattgccaataaacatcccgctgtggggtggccaggaccgagtgccaattagtgacagagtgcccagaccaaaccggatgaggatcttgcagttgacctcaacatgactgtgcccagaatttccttggtggcaatgtcaacagtctcttcctagatgcccccagacttcatcaatgcatgatgcttcagtgcactcttttcaaatgtcggggtgggttttttttttttccacaaaacttcaagcatctactaaagtagagggaggagtgtaatgaactccggtacccatcactcagcttccacggtttcatctcatttcatctgtgacccctccactaccctttcttcctgattcttggaagcaaatccaagacatcacacccttccctctgtaaatctttactatgttcctctaggagaaaagggctcttctcaatacataaccacaagtcatcatcacaccgacaagtgtaacagtatttcctgaatagcttcaaatatcctagtagtgttcaaaaaatgtcatacgtattttcagtctgcttgaatcagggctcaaataaggtccacacattcagattgactgatatgccttttgactacctttgaatctagaggttccctttctatctccctgcaatttatttgtggaagcaagcaagtcgttcatgacgtagcctaacaggcccctctgacgttgttcattatgatttttctgtaaattggtagttgatctgaggatctggccagaggtaggttggatttgttggtgtgttttggcaaggagagtgtctcttttctggggtgttggcagctactgaaactcaatgcccagaccaattaaaccactggggatggaaaatgacggcattcggacaccttaccctgccttcacctattggtgaccaaaaccttaacatcttcacaggtcttcttaccctgagggtatatgccactaggttgtgtagtaaaccggtgtgtttccagtcccttagaatagtccctctctaagtgatatgccactcagtggatatgcatttagcttcatttcttttgttgctgattttcagagattgctctgtaaatttaaacttttattttactttattttattttttcgagacagtcttactctgtcgcccaggctggagtgcagtggcgcgatctcagctcactgcaacttccgcctcctcggttcgagcgattctcctgcctcagcctcccgaggagctgggactacaggtgcccgccaccacgcccagctaattttttttatttttagtagagacagggtttcaccatgttggccaggctggtctccaactgctgacctcaagtcgtccgcccacctcggcttcccaaagtgctgggattacaggtgtgagccaccgcccccggccacttaaattttgttttataattatgtaataaaacagttaaaagtctcaaattaaaatctagaaaagaaggtgtatttgaagaagtctggcttctctgcgccaccaccgaccgccccttccctacctgcctgtatttcctcgaatcactttgcctgggagttgactttgattctcttgctcattgcttcatgaaattcagttccagaactttcaggagggaggggtaggccatgacaccagctctagttacactggtggcagctcctgtcccctcccccactgctgctgggacctgttctctcctttgcccccttgtccctgcactgcccaatttggaccgcaagggttgccagggaagggcactggctgccttgttttcagaggtcgtagcacctagattgctccagccccttgcacttgcctgcaggccagagtgtcccaaaccctcccagtctcagctgctcttccccagttcacccaaggtacttcccagggaagagctgccgacagtttgggggttctctgttcttaggtccatcagcaaccccattgctcccctctgcttccttctgcacggagactgacgccatgcaggtcttcaattgtcaatggtctgtccctgctgctcatactgggggttcctggggagccagtgccaggtatcgggattgcagacattgtctgtgggtttccagaagctccttgtgttaggaacatatggggcccgtgcacagagggcagcagaggccttgtgggatccagctgtgctaggggtgagatttatctgtctctcctggccatagccaggaaatccccatttttcttaagctagcttgagttgggcttttctaacacacagctaaagaatctcttgataaaccttgggactctccatgaggccttatatggcagcaggtctgtggcttgcaatcccttcaagtaatctgccaaaaacaatgttatgacgaaggtccttccaacacaaaaggtgtagagccctagcaaactcctacagaagaaaaaggagaaataattcgtttgtagtcccagctacttgggaggccaaggtgggaggatcacttgaagtcaggagttcgagaccagcctaggcaacatagccagaccccatctctacagaaataaaaaaaattgccattgtggtaatgcacggcttgtagtcccagatactcgagaggctgaggcaggaggatcgcttgagcccaggaggatcgcttgagcccaggagttccacgttgcagtgagctatgattgtgccactgtactccagcctgggtgccagagccaggctctatctctatttggtgttgttgttgttgctgttgttgtttttgagacggagtcttgttctgtcaccccggctggagtgcagtggcgtgatctcagctcaccgcaacctctgcctcctgggttcaagtgattctcccgcctcagcctcctgagtagctgggactacaggcgcccaccaccatacctagctaatttttttttcttttgtatttttagtagagacggggtttcaccatggccaggctggttttgaactcctgacctcaagtgatccaccccctcggcctcccaaagtgctgggattacaggcgtgagccaccgctcccagccgactgtatctctaaatatataataatcataatcataatcaggacagccgtcatattggattagggcccaccctaatgacctcatttaaacttggtcatttctgtaaagaccctatctccgaaaacggtcacattctgaggtattggggttaggactccaacatatgaatttgggtggggacacaattcaactcataacacattcattgattaatttcctcattcatttattttctgagcatctattgtgtgctggacactctgtgaggatgaatgagtcaaagtctctggtgagaaagacaagacttgtacttgtgtctcagtactggctgctataagaaattaccaggctgtggccgggcgcagtggctcacgcctgtaatcccagcactttgggaggccgaggcaggcggatcacgaggtcaggagattgagatcatcctagctaacatggtgaagccccgtctctactaaaaatagaaaaaattagccaggcgtggtggcgggcgcctgtagtcccagctactcaggaggctgaagcgggagaatggcgtgaacctgggaggcggagcttgcagtgagccgagatcgtgccactgcactccagcctgggtgacagagcaagactccgtctcaaaaaaaaagaaaaaaaaaagaaaagaaaaataaattaccaggctgtgcatggtggctcatgcctgcaatcccagtactttgggaggacaaggcaggaggatctcttgaggtcaggagtttgagaccagcctggtcaacatggtgaaaccccatgtctactaaaagcacaaaaattagctgggtgtggtggtgggtgcctgtaaatcccagctactactccggagctgaggcaggagaattgcttgaacccaggaggcggaggttgcagtgacccgagatcacatcactgcactccagcctgggtgacagagcaagactttgtcccaaaaaaaaaaaaaagaaaagaaagaaaggaaaagaataaaagagaaattaccatagattgggtggcttttaaatgataaatttatttctcacagctctggaggctggaagtcagggtgctagcgtggtgggctctggcgaggaccctcttcctgactgcagattgccaacaactcattgtatcctcacatggaagaaagagagctagagagcactctagggactctttttcttgtttgttttaattaaaaaaaaattttttttacatgggcatgccatgttgcccaggttggatttgaactcctgggctcaagcaaccctccagcctcagcctcccaaagtgctgggattacaggcatgagccaccattcccagctaatttgggctgttcccaaaggctcaagtgatcctcccacgttggcctcctgagtagctggggctacaggcgtgagccaccatgcccagcttctaggacctcttttataagggcactaatcccattcatgagggccccactcactctgcacacatgacctaaatgacctgccaaaggccccacctcctaataccatcaccttgggggttgggatttcaacacagaaatttatggggggcacgtacattcagatcatcatgaacagtaactcctatgtgtgacagaaggtgacagaggtgggtagtggtcttcccctcaagggggtgagttgccactagctggggaatcttctggaaggcaaatgcatatgagctgggctttacaggaggcaagcgtttctctatggaagggcagaggactgtgggaggtaggaggtggggctggggcaaagggaagaggggagcagggaagtggggtgactgcacactgggagtggggaatcagatggaggagacgatgaggagttctgttaagttcaagatgccagtgccagtgaccagcgggcgatggtctctggcttgagggacaggatggaggggagactgtctgaggatggacaaagctggagggaaacagccaattgcaaaggcaggagggcggaagggggaggggagaggtgggatcagcactggtatagacaggcggtgctgcagcccagctcctctctctcctctgcctcctgccctcaggccccttcgaaggcccgaattaccacatcgctcccagatgggtgtaccacctcaccagtgtctggatgatctttgtggtcactgcatccgtcttcacaaatgggcttgtgctggcggccaccatgaagttcaagaagctgcgccacccgctgaactggatcctggtgaacctggcggtcgctgacctagcagagaccgtcatcgccagcactatcagcattgtgaaccaggtctctggctacttcgtgctgggccaccctatgtgtgtcctggagggctacaccgtctccctgtgtggtaagccagtcggggcccaggctcggcggaaaccactcattcaccctgcaagctcctccagccacctcatgatgatcggggcccagctgctcctgtaggcctgtctccctccacatctgcgcctcacatccatatactgaagggttctggaggcttccatctgaacactcacattaaattcagctcccttgagtcaaacataccctgagttcctactcttgagtcaggctctgcccggggacagccagtttggagctgtggggctggtgtgggaggagacagatacagagctagacaaccccagaacagtaggggggcggggactctgggcaccctggacagaactcccctgcaattagggatgcctgctctttcagctcgccagcatctgcttttcccggaggagacacaattcccagatcctctccccatccccatcactaatatctctgtgggccactattccgctcaggtcaggagacagtggccgagaggtactagcgtgccaggctctgtgctaaggagggggccctatagccagacggcaaccacacagtaccatcatcagtcctctcagacaagaaggggcctggggcaggtggtggaggagcggctgggagcagtttgtggttcgagtggatagagtaccaccaagcagccgtggctgctggacacgaggtgggcaggcccaggtctcagaggcctcagacgtcatgcccaggagctgggactttctttcaggaggaggagaccccacatccagcagcagcagctcctgctcttgcctccccaccactcttagcagcctccccaaccccaccccgttaactgcctcaaattgtacccacgatggcccagaccagagagggtgcttgtccaagtcccggcactaccccgatagtgtagaaggggagccaagggaaggtcaggcagagaaggtccatccccaggtccgagtgctctctgcagcaggcatggcctcggtggtcacacgacccttcccgagtgccccccctgcatctccgcccacgtctgtctccgtttctgccatggtctcccgctcacccttgcctctgctcatggtctgttcttgggtcagtcaggtgccaagcagccagcacttccccaccacttttggtccacggatgcccttggccatctgggaagcctgtggaccccatctcaggagaatttttgcaaacgcataaaatgagacccataggattacaaaggcagcaaattatactgaaatacagttatcaaagtattaaacattcatcagtaacatagtctttagttaaaagcatttactggccaggctcatacctgtaatcccagcactttgggaggctgaggtgggaggactgcttgcctccaagagtttgagaccagcctgggcaacatagtgagacctcttctctacaacaaataaaaacagctgggcgtggtggcacaccagtagtcccagctactcaggaggctcaggcgggaggatcgcttgagctctggaggtcaaggctgcagtgagctatgatggcaccactgcactcagcctgggcaacagagtgagattctgtctcaaaaagtaaataaaaataaaagcatgtgttaaacgtattagtgacaccactcagtattaaggtattaaataacaggatcccgcctgacaaccactgttatttcagagtagtgatgaacataagtggtattcgaactctctgccacctctatgaattgacaggaaaacatctgtgacctctcttgctgaccgagtcacgggtactgctaatactgccacgttcataatggaaggaaatgcccagtgtctgttcgaggttggtggaaagaaagatgtcgttttttccacctcagtccgtggagccctgaattctgtgtgcagacgtttggggtctaagcaggacagtgggaagctttgcttcccacctttgctttggctcaaagccctcatctgtctgctctccccatagggatcacaggtctctggtctctggccatcatttcctgggagaggtggctggtggtgtgcaagccctttggcaatgtgagatttgatgccaagctggccatcgtgggcattgccttctcctggatctggtctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccagctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatgatctttgcgtactgcgtctgctggggacc

SEQ ID NO: 5382 - DNA, 20952 bp, human; identical to SEQ ID NO: 4086

SEQ ID NO: 5383 - DNA, 14809 bp, human; identical to SEQ ID NO: 5380

SEQ ID NO: 5384 - DNA, 6083 bp, human
tcacaggtctctggtctctggccatcatttcctgggagaggtggctggtggtgtgcaagccctttggcaatgtgagatttgatgccaagctggccatcgtgggcattgccttctcctggatctggtctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccagctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatgatctttgcgtactgcgtctgctggggaccctacaccttcttcgcatgctttgctgctgccaaccctggttacgccttccaccctttgatggctgccctgccggcctactttgccaaaagtgccactatctacaaccccgttatctatgtctttatgaaccggcaggtaagcaacaccatcagcagatcccactcaaaataccgtgtgccctagaagggtgcagtgatggccccacctggaatcatgtctctgataagaagcccgcggagcatctgggggaccctccagggaaatgaccgggaaaggctcagcgtgtgacccagccccagccagagctccagctggcccttagcagaaggcttaggtgtgccctctggaatcctttatagtctcggcctgagggtggcatttcccaaagcgtctgtgtgccgtgcgctcttcccttccggtggccctagaactatggctgccgagcttcaggggctctcctggcgttcagacgctctaggagttggtgagccctaggtacatccaccctaggtgtgcccctcttctgttcagactcgacccttctcaaccttcatctctccattttcaaaccgtaacctctggaatttgtcttcctataagaacaaaagccggccctccttggctacactgaccaagagttcaagagctttcacgagtttgtgggttagttcaggggggacgtgctgtggtcctgcccagaggcagcctccttagctggcatattgggcctcagcagcaagctgctcacacacctaaatccccccacctcctgcaggttacaggcttcattaaagcgcagctgtgatgtgacttgatggtggccagaaaggtgtgcagaggcctcccatttcaccaggcccagtccatcccttccactgggctcttccttgcttctccatcttagagccactcaatggctccagcccctttggctcagctttgactcacacaagccaagtctgcagagttcattaagggttcattctctctggtaacttttaaatagtaagtaggaccaggcctgcagtggatttccgggaactcgctgtagcacactgatgcccagagtgtagttctatccctgacccctgtttcctgactttcatgaggatcttttttaggtttctggaatcctaaactatcttgccaagtactgtctttactggattatttccattctcctttccagaactccccctggacagggggagacagatgtctgcacttctggacctcaccaggcctcgaactttgcttttaccctttccacataattatcctgtcctgccacattctgagagaattttctggaacgcagttccatgaagacagcaaattttgctcaggacagagtctggcacacagtgggtgctcaagcagcagctgctgaatggattcctcagccctatctcccagctcttcagccgagctgattctgctgtttgtcccgtttcttatgttattaatttcaaccattatattttttatttttgagagttttgatgatagagggagttagagctagtcaagagtaggcctgaaatatttagaaaatgcctttggtctgggtcctcaaagcattgtggttacttcagggatgacacaggacatgatttgagacattcatatggcccagatctctttggggtgaagcagcaaagacagacccctcctggtaccggaagacgcttggctggagagatgaggtaggggctagattgtcattacctaggcctcaccttgccccagatccatggactggaaaaaacatgacaaccacatgccttttcattaatattcctccgagccgctcaccagacagtctggggacaggtcaccactgccccttagctgtcactgtggatgagtgtcatggggctgccgtcacaaactaccacaaactcagtggcttcaaaccacagaaatggattctctcagggttctggaaatcttgagtctgaaatcagggtgttggcaaatggaaaggttccctatggaggccgggagggagaagcagctgcagggctgccggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgc

SEQ ID NO: 5385 - DNA, 20952 bp, human; identical to SEQ ID NO: 4086

SEQ ID NO: 5386 - DNA, 10845 bp, human; identical to SEQ ID NO: 4088

SEQ ID NO: 5387 - DNA, 13526 bp, human; identical to SEQ ID NO: 4089

SEQ ID NO: 5388 - DNA, 6081 bp, human; identical to SEQ ID NO: 4087

SEQ ID NO: 5389 - DNA, 10845 bp, human; identical to SEQ ID NO: 4088

SEQ ID NO: 5390 - DNA, 13526 bp, human; identical to SEQ ID NO: 4089

SEQ ID NO: 5391 - DNA, 6081 bp, human; identical to SEQ ID NO: 4087

SEQ ID NO: 5392 - DNA, 13526 bp, human; identical to SEQ ID NO: 4089

SEQ ID NO: 5393 - DNA, 20943 bp, human
ttattctctcagtgtatcgaagatatcagtcaactatcttctggattgcattgatgctattgagaaggcagcctgcagtctaaaagtcatggttttaaaggtaatcagctttttttcctctggctgcttttaacatcttgtgtcggccgcgggcggtggctcatgcttgtaatcccagcactttgggaggcccaggtgggcggatcatttgaggtcaggagttccagaccagcctggccaacatggtgaaacactgtctctactaaaaatacaaaaattagctgggcatggtggcgggcgcctgtattaccagctacttgggaggctgacgcaggagaatcgcttgaacccgggaggcagaggttgcagtgagccgagatcacgccactgtactccagcctgggcgacaagagcgaaacactgtttcaaaaaaaaaaaaaaaaaaaaaaaatctcgtgtctaggtgtggacctatttctgtcttccctgcttaggatttattgggcttcttgaatttgtgaatttgtgtctttcttcagttctggaaagttcttagggagttatctcttaaaatgttgctgctgtggccggtcgtagtggctcatgcctgtaatcccagcactttgggaggccgaggtgggtgggtcacctgatgttgagagttcgagaacagtcttgccaacatgatgaaaccccatctctactaaaaatacaaaagaattagctagctgtgatggcacgcgcctgtagtcccagctactcgggaggctgaggcacgagaagtgcttgaacccgggcagcagaggtcggccgtgagccgagattgtgccacggcactccgcctaggcaacagagtgtgactccatttcaatttaaaaaaaaaaaagaaaaatatgtatatattgctgctgcttcattctgtctgtcttctctctctggtgtgacaattggatttttgttagacctactcatgctaccttccatgtcttctatttttcaagttttctatttttttgtgcctctgtgctgcattctggatacttttttttctttctttcttttctctttctctctctctctctctctctctctctctctttctttcttgggatggagttttgctcttgttgcccaggttggagtgcagtggcgtgatctcggctcactgcaacctctgcctcctgggttcaagccattctcctgcctcagcctcccaagtagctgggattacaggtgcccaccaccatgcccagttaattttttgtattttttagtagagacagggtttcaccatgttggtcaggttagcctcaaactcctgacgtcaggtgatccacccgccttggcctcccaaaatgctgggattacaggcgtgtgagccaccgcgcccggcctggatactttctttagctcctctgtacaatttaccaacagtctctccagccatatcaaatctgccattaaatccatcaattgaacatattattatttattatttatttattttttgagacggagtctcactctaccacccaggctggagtgcagtggcacgatctcagctcactgcaacttctgcaccccgggttcaagcggttctcctgcctcagcctcccgagtagctgggactacaggcgtgtgccaccacgcctggctaattttgtatttctagtagagatggggtttctctgtgttggtcaggctggtcttgaactcccgacctcaggtgatccgcccgcctcggcctcccaaagtgctggaagtacaggtgtgaaccactgtgccaggcatttttttttttttttttgtattttgtatagacggggtttcaccatgttggccagactggtcttgacctcctgacctccgcccgcctcggcctcccaaagtgctgggattacaggcatgagccaccacacctggcctatattgaacatttaaatagtttgaaaactgtgaaatctggcatatgtatataaaggtgcagaaaacattgatgtatgttttaagaagtaacgataaggtgaacacacatttaaccactactcaggccaggcaccccagcctccacagtcaccccagtcataatccccttctcccgctctagtgggaaccaccatcctggggtttctgttgccaacatccatgctgctctttagctttcctgcctgtgtagtcatccctacacaatattgtttagttttgcctgctcttggaatttatgtaaatggaaccatatatagtatggattttctgtctggtttcttttgttcaacattatgcttgtgaaatgcattcatgtttttcaaggctgtagttcattctcattgctgtacagtagtatgttgttgcatatattacagtttacttacactttctgggcaggtggtttgttgctagttgttggatattgagaacatcagtgtacttgcctcctgggaatatcgcctatgaatgcagttgctggatcatttggtaggtatatcttcaactttgtgatactgtcaagtggttttctaaggtggctgtagtacaaatttgcttcccgccagtaatgattgagagttcctgttgcgctatatccttgccaactcttattgttgttagtctgtctgagtttgaccaatctactgggtacatagtggtatcactttgcattttaaaaattgaggtataggccagatgcagtggctcacaccggtaatcccagcactctttgggaggccgaggcgggaggatcacttgaggtcaggagttggaaaccagcctggtcaacatggtgaaaccctgtctctactaataatacacgaattagctgggtgtggtgatgcacacctgtaatcccagctactcgggaggctgagccatgagaattgcttaaacccgggaggcgaaggttgtagtgagccgagattgcaccactgcactccagcctgggtgacagagtgagactccgtctcaaaaaacaaaaaagtagaaacggaacagaggctgcacctgagctgccccccacctccctctcctagctccttgctctggtgggctgggttccagctatgctgctcttgccatctttattttagaggtaagaaaactgagcctcagagcagtttattaacttgctcaaggtctcagagtggtagagccaggatttgaactgggctcttcgtcaaaggcaatgttaatcccctcaccatgtgagagactcattcttttgtgttacagtagaattttctgccgtagactgtcagctgtatgagatcaaggaatgtatctggcttctgtaccacgtggtaggcactcagagaaagtatgtgttgaatgaatgattggatgaatgaatgaacctgttaggaggcaaatctctctgcctaacccttcctgtctccctgggagtagcaatacagcaagctgtaagagttgacggaaataagcttattccatactttacaagaacagttctttataaatgagacccacaattggtaatttttggaagagaaaataggagtgcagtgcaaaaacaggcagatgtagaagggagtctggccacctgtgggtcttagtgaggcacacatgtagagcaaggagtcagacgctgaaaaggaggggagaggggccctgaagatgagcatcacctcctcagtctgtgtcgggcccatcttgaatgcacaaatcttgcgtgtgtaagtatccatgcatatgtggaagtgttttatggagtcataacgtgtccaattctcccacactttgcggctcacagagcaccgtattgtgatttcttgtttcccaacgtaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggtgaggccttggctctggggactggaagcagaggaggaaccgctcccaggagccacctatgggagggtgaaagggagccaggacaggagcctggagagccagggtgaggggccagttggaagagcaggtccatgcttcttttagcgactgggccctgcagtggggcgagccagccctctccctgcagtcccacacctgccttgacccttgctagcgaaaatgctccagcttggcagcccctgccgggtggttgcagcggcatagcggctggccctgaccctgtggtggcaggggacaacatgggggtggcaagagtccggtagacacctggcactagttagggaggtggcgtcctttggtcccagtcggctgggaaggtgggagtcaggaccggagtcgcctcgccagctctggtctcttcacatgtgctcctagctgagctggggcacaggccgggtctcagatacttatttcaaaaatgactgccttctggtgaatgctttctccgcaccgtgcagtagctcgattttctttttcttttttttcttttgagatggagtctcactctgtcgccagactggagtgcagtggcacgatctcggcccactgcaacctccacctcccgggttcaagcgattctcctgcctcagcctcccgagtagctgggaatacaggcgtgcaccagcacatccggctattttttgtatttttagtacaggcggggtttcaccatgttgaccaggatggtctcaatctattgacctcgtgatccgcctgcctcagcctcccagagtgccgggattactggtgtgagccacctcaccctgccctagctcgattttctttccctctaagataaggctagggcctaccaattggaggaaaaaaaaaaaaaaaaaaaaaaaggcaaacccaatctctcaacggattctctccattcctattgggaccgttctctgggtttccatgggccctcagggggtgccacattctgtccccctcgctgcagtctgtggctaattaacgccagtccctccagcgtcctggctagggaggcagcgattcccttaggtgagccaagattctcagcatttgcatgaaaagaagaactccgcagtccttttagtgcctgatgcaggggaagcggcgtgtgggaatcatcctctttagtttccccagggaaatcttgccagcgtttacatggcctaagaatctgttaaaggacaatcaaagaatattacagggcaaccactgtcaatgagatgactagtcagagtcacaggcgtctcttgcagattattttcataggacatggcaaccaaatctaaaatcttgggagcatcaaagacccttttgtgaaaatcacacttacccggtcagctttctattaagcaacagcagaacttggtggcagttacaaacttccccgtatgtttccaagccacaggggccaatgagaatgctgtgctcaggtaaactcttaacccctgtcaaatccgagtctttcgccccctcttgatacagcggtgactaccggggagcagggcaatacctctgtctctccccctctcagacttttgctgcaaattctagaagcctgcacttctgacccggtaccccccattggactgtgacatgggatgtctggttgtttgctgcagcagcgagcctacccttactaatgttcatcgtgagcagaaaagcaggtctacagggcccaagcaggtctacaggaggagaaagggctgctgatgatttttcactgttgtcacgggctcgtaactgagctggggcaccaggttaagcagccttgttctttggccctcagacgcctactttatggttggggaagcagagtctcacagaggcacaagcaggctacgtggctgctaagtgcggacctgagagcatttcaccacaccctggctgtgtggctaagttagatgcaggggacacaggagttcatggcattttaaaaacatatacttccgtaaaatcttcttcaaaacttttacatgatctggacacagaagtgtttcaaccagccaggctccctgtgactgttgcgtcccctctggtgcatcacaaactgagaatccatactgcaagtcctgtgctgtttatcacagttaaatccgtttgctttcaggagggctgttgtggtttttatcattatggtttctttttaatttggtctcggcatgtctctactgagagtggccatagccgagatacccagtttctaggagatccctgacccgtgggaaagttaggttcggatgtgtgtgtcaggggagccacagtgaggaggcagacgaaaatgcatgaaacagcagaaatgggctgggcgtgggggctcacgcctgtaatcctagcactttgggaggttgaggtgggcagactgcttgagctcaggagtttgagaccagcctgggcaacatagtgagacccggtatctacaaaaacatcaaaaaattagctgggcgtgatggcgcgtgcctgtagtcacagctactcaggaggctgagcgggagcggggatcccttgagcccgggaggttgaggctgcagtgagtcatgattgcaccactgcactccattctgggtgacagagcaagaccctgtgtcaaaaaaaaaaaaaaaaaaaaagaaatgtatgactcagatcgaagagatgttaggtgtgctgatgggaggcagaggggaagtctggaggcagcagggagctgattgagctcatcagctgtgcaacagcgaagcccagaacggaagggcggggaagcttccggggctgtgcctgtattaaggtcacagggtgtgaagtgatcccacaggctttcctgcgggggttgtggattggctggtttaaagaaaacatgcacgaggaggaaactgatttacatgactctggtgttgagcattaggtcttatcgtggtcagcagccgtgggatgtgttgggttttgggtcagtgaggcgaggaccacgtgggctatgtcgcaaacaatcacatgacagggagggaggggtgttatctagggcaaaggtgacagggtacaactgctaaagttggatgctgaggcagcaactgtattaaacgcatttatgacaagggcttacttaaaaaaattgatgtagaattcacataatttcacgtaatgtgaaattaaccatttggaagcatgtaattcagtgcattaagtacatctgcagtgtggttcaaccatcacctctgtccggttgtctaacattctcatcaccccagaaggagacctccagactcactacacggtcactcctagcctcggctccaggcgttccctaatctgctttctgtctccgtgggtttgcctcttctggacttttcatataaatgggaccatacgatatgtgggcttttgtgtctagctcctttcactgttttcaaggttcactaatgttgtagcacgtatcagtacttcattctcttgacggctgactaatattccagtgcatgggtagaccacattttgtttatctgtccatcagtggatggagatttgagttgtttccaccttttggctattgtgagaagccctgcgctgaacactcagatacatgccagttgtttgaacaccagttttcaattctttggggtctataatcaggagtagaattgctggaccccgtggtgactccaggtgtagcgtttagaggagtcttcccacagcagccgcgcagctccatcttcccaccagcaatgcagaaggcttccagttgcctcacatccttgccaacatttgttgttatcctttttttttttttccaacagatgtaactgtgaagtggtatctcattatgagggctggctttcttttttatttttcctgagtctttggataggcaaaagttctttctttctttctttctttctttcttctttttctttttctctctttctttccatctctctctctctttctttctttttctttctctctttctctttcttcctttctctctgtctctctctctctctctctatctctctttctttctttctttttcttcagggtctctgttgcccaggctgcatgcagtcatagttcactacagccttgaactcccgggctcaagcgatcttcctgcctcagcctcccgagtagctgggagtacaaagcatgtgccaccatgcctggctaactttttaaaaattattattatttgtagagatgggatcttgctatgttgcccaggctggtcttgaacacctggccacggcctccccaagtactggggttacagatgtgagccactgtgcctggacagttcttactttttaatgcattttttaattgattgtggtaaaaaaaaaaaaaaacccacaatatattctttttgattctgcgacgtgcagggtctctatcacagcaacaattagactcaggaggcttggggctggccctggggtctcctccttcatgaggtctgggtttgtaggtccttgcagaggacgttcctgggtcctggaaggactgtgactgcttccgctggagttgcttgaggcccctggtaactctcctctctgtgtgctgaggagaagcacgggcgtcgcgaacttgatgattctggatggaagggtctttgccaagcttccctttctttcttgtggaaataggaggagcttcagatctccgagaagatgcacagtgagcggcctacctcctcagcacaagccagtctcctgggggaccagaaggccccggtccctcagtttcttcgtgggtcaggaggaaagaaggcttgagaaactcagaaaatgttcattggtagaagagatggcaccccaggaaggcatggggagccttcaagtaaaagtctcgactggccaggtctcatctgggcaccttgcatgcagagttgcaggaggccccctctagcctcctaatgagccagggggctctgggagggtcttgggggtccttccccatctcttacaggatgcgcagctgacttctgcttgatggtgaaaggcagtcaggtttcagtcttggccccgtagacagggcatggacaagtcctggagttgggggtatggtgccagcaaaaccatctttactctctggggtccatagccagtcccagcctgcccagccccaccctcctccttcacctttgtagcccgagtggtcaatgcctggggtagatgggttgctgggacatctttgttctttgttggatgagtaaaatggtcctgggagaaaacccgactgtgaggagcacattgcttcttttttttgtcttttttatgagatggagtctcactctgtcccccaggctggagtgcagtggcacgatctcggcccactgcaacctccacctcccgggttcaagcgattctcctgcctcagcctcccgagtagctgggattacaggcacacgccagcatgcctggctactttttgtatttttcagtagagatggggtttcgccatgttgaccaggggtctcgaactcctgacctgaagcgatccacccgcctcggcctcccaaagtgctggagttacaggtgtgagccaccacacctggctggaggacattgcttcttgccccatttctagttccctagacctgccttggcatcaactcattgaaggctccacttggtgacaaggaaccggcttatttggaaacagggtcgttgcggacgtgatgagttagatctggatgaggtcattctgcagaggggtgggccctaatgcagtgtgacctgtgtcctgacagaaaggggagacggagacacggacacacccagagggagagcgccgtgtggagacagaggctgaggccgacctgccgtggcagaagccaaggaagcccgcaggtgggcagcagagcagaagctgggacagaggccccgagtggaggcgccttctcggtcctcggcaggagcccgcccagcctgggccttcctctcggactgctggacccccagccaggagagaggccatctctgctgggaaagccactcaaagtttgtaacgctttgtgatggcagccagaggaaactcccacactcagcttgtcctttaggctctgctctgatgtcctctcctcaaagggacttcccaggctaccacgttcaaatggcctcttcttttattcttttggaagcggggttttttgaagtaaagtttttgtttttttgttttttttagatggagttttgctcttgttgcccagaccggagtgcaatggcgcaatctcggctcactgcaacctccgcctcctgagttcaagcgattctcctgcgtcagcctcccgagtagctgggattacaggcaggcaccaccacgcctggctaattttgtaattttagtagagatggggtttctccatgttggtcaggctggtctcgaactcctgtcctcaggcgatccacctgcctcggcctcccaaagtgctgggattacaggagtgagccaccgcgcctggcctttttgaggtaaattttatgcagtgaaattgcatttaagtttaggcatacagtttaacgagttttgacaaaggtttacacctgggcagctaaaatcccaataaagagctttgccaccaccccagaaagtaccctcataccctcttccagtgaatgcccgtctcccataattggccactgttccggtttctgtcactctagcttcatctccttttgaacttcacgtaagtggaatcgcacggcacgcagtgctttgtgtctggcggctttcgctccgtggaattgttttgagatccacccaagctgtgtgaagtgagtagctcatggcttcgtattgcttggcagccttccattgcatggagacgccgcaggttgcttatgccctggtccgctgccagttggggcgactgaataaagctgctatgaacgttctcgcacaagtctttctgtgaacatatgctttcatatatggaattgctagataacagggaagtgttatgtgtcttagtcccactttctgttgctgtaacagagtaccgcaggctgggtggtttataaagaaaggaagttcaatgtcaaggcgctggcagctggtgaggacctttgtacggcatcatcctatggcggaaggcagaagggcaagagggcgtgagagagcgagcgggggccaaactttcatgataacaatattaatattaatcgcctcttaccagtcccaccccttaacaccatcacatggccattaaatttcaacacgagttttgggggggacatgtaccccatagcagtatgcttaactttttaagaaagaggaaggccgggcgcggtggctcacccctgtaatcccagcactttgggaggctgaggcaggcggatcacctgaggtcgggagttcgagaccagcctgaacaacatggagtaaaccctgtctctactaaaaatacaaaattagcccggcgtggtggcacatgcctgtaatcccagctactcgggaggctgacgcaggagaatcgcttgaactcaggaggcggaggttgcggtgagccgagatcgtgccattgcactccagcctgggcaacgagtgaaactccatctcaaaaaaaaaaaaaagaggaactgttttccgacatggctataccattttacagtcccgctaggagtgtataagagttccagttgccaacgtttggcaagatcagtcttttaaatgtcagcctcttaagttcagccacaacttggtgaaattagactccaaaatttcatcaccctagcccatgttctctcgaccttggcactgtcgacattttggaccgaatgattctctgttgtgcggggctgtcctgtacattctaggatgatgagcagcatccctggtctccacttacttgatgccagtggtgccgtgaattaattgatgctgccgtgacaaattgcccccaacttcatggcttaaaataatagaaagttattctctcgcagtcctggaggctagaaggccgaaatccgtttcactgggctgaaatcaggcgaggaggacacacactcattggaggctctaggggacaaactgatctttgcctcttccagtttctggtggctgccaaattccttaattttgtggccacatcattcctgtcctgaaggccagcatcttcaaacctgtgttctgtcttcacatgacattctcgtctgtgtgtgtctaatgtccttctgcctctctctcatacatgtgattgcatttagggccaccaggataatctaggataatctttgcatctcaatacccttaaactcaccacttctggaaagcccccttttttggtcatagaaggtaacattcacagtttccaaggattatgacacagatatcttttgcggaggggctttttgtttttttcttttttagacagagtctctctctgtcacccaggctggagtgcagtggcacgatcttggctcactgcaacctccgcctcctgggttcaagcaattctcctgcctcagcctcccaagtagctgggactacaagcgcgtgccaccacacccagctaatttttttgtatttttcatagagacggggtttcaccctgttgctcagggtgttcttgaactcctgagcccaggtaatctgcccaccacagcctcacaaagtgctggggttacagatgtgagccaccgtgcccagcctaggggggcaattttagcctaccgtgccccacctatttgtaacaaccagaaatgtctgtccagagattgccaaatgtcccttgtttggggaggggggggccggcaaattgcccctggttgagaaccagtatcctagcccatgagactagtgggtgtgtgaccctgcctctgacgattaatgatgctgaaccccttttcatgtgcttatcagccaataagtctttggcttgttttcaacttggattgtctttttattgttgagttgtcagagctctttatatactccggaccagtctttgtcactcccctactttttcctttctcgcagcactcaccgcctaaactgctctcccttgtgtaggtattcatttgtgttgtattgttctcgtcaaaatatcagcacattcaggtcggccactgtgtctgagtgactgcccaaagacatgttggcacatgatggctgttctgtgagtacctgtttcatggatcagtctggatgctgcttttcctcccttcctgaagggacccagctcgccctctgggctgcctccctcctccatgtatgtcagaactctatctgctgtgtcttgggaacatcagggcagggccaggagggctgattctggatttaggcctggcccagcctcctctctgcaaggtatttactgaatgaccttggacgaggtgcttcaagtttgcaatcctcagtttccacatctgtaacatggaggtaaaaatgatcccactattgttggaactgttgtgagaattaattaatacttgtgtgtaagccccaagtagatgctgatggaactgaatttacaattcctttctgcttcctatgtgcaaactaagtccttgaaagatcgtaaagaaaaatggggccagatgtggtggcttatggctgtaatcccagtgctttgggaggtcgaggcaggaggattgcttcagcccaggagtctgagaccagcttgggtaacaaagtgagaccatatctctgcaaaaaattttaaaagtgttaaccggacttggtggcacatgcctgtagtccctgctacatgggaggctgagacaggaggatcgcttgagcccgagagttttatgttgcagtgaactatgattgtgccactgtgctccagcctgggtgatagaggacagagtgagaacttgtctcaaaaaaaaaaacagaaagagagagagagagagaggagagagagagagaggagagagagagagagagagagagagagagggagagagagagagagagagagagagagagagagagagaaagaaaaagagaaagaaagaaagaaagaaagaaagaaagaaagaaagttgttaatggcttttttttttttttgaggtggtgtcttgctctgctgcccaggctggagggagtgcagtggcttgatctcagctcactgcaacctctgcgtcccggattcaagtgattctcctgtctcagcctcctgagtagctgagattacaggcatgcaccaccacgcccagctaatttttgcatattttagtagagacggggtttcaccatgttggccaggatggtctcgatctcctgacctcgtgatccgcccgcctcggcctcccaaagtgctgggattacaggcatgactgcagccggccaatgtcttggaactattaatagccatggtggttgcacaacaccacatgtgctaaatgccgctgaattgttcaccttaaaataattcattttatgttacatgaaatttacctcaataaaaattgaataaaaaagaagctactcaggtgccgagtaggcaaaactttcactcttgctttgtatttctggctgtatccacaagtgggcagtcgtgaaattttcttatagcctcctgtcatattgaaaacgcccggaagtgaatatgccaggtctccatgtttttctttccctcctggacacgaggtccttgggggcatccagaccctagctcctctgtcccaagactgttctggtatgtttcgctttcagacgaggcttggagataacaggctatggttcctagaggcttcagtgttgctctgtgacctctcagccccagggatccagcctcgggctgactttcctcaaggtatctgcttagggctttgttgcaggctggggtcgtgttaacttccattttttccccgacttctcctccatgtcacagcatcctgcatcttgggatctctgaggaggtctgacctaaggtctgatctgctctctgaactggttcctctcatccctattgcgttgaagcaaagcacagacattatatcagttcatctgtaaatatttcagtgtgaacctgaaatatggatcattttgttaacatagcctaaataccataccaaaaatgttttaaaacaagtccacaatgttaaatatgcagtcactgtcaccttattgcctcacacatgccatcattcctttttatttctgaaggaattcttttttttttttttgtgagacagagcctcaccctgtcacccaggttggagtgcaatggtgagatctcggctcgctgcaacctctgcctcccaggttcaagcgattcccctgcctcagcctcctcagtagctgggattacaggcatgtgccaccacgcccggctagtttttgtatttttagtagagacggggtttcaccatgttggccaggctggtcttgaactcctgacctcgtgatctgcctgcctcggcctcccaaagtgctgggattacaggcgtgagccaccacacccggccctgaaggatattttttgctggacatagaattctaagttggcacttaatttttggaaataataagcattttgaacaaatcattcccttctgacttccatggtttctgttgaaaaggcagctgccagtcttcttgttgctcctcggatcacagttttgttttcctcaggctccttttaagatcttttgtttttctttgttgtttagtggttttgctatgatgatgtttggcgtgattttctttctctcttcttttttgtgccgctgactctccccttggtgtgattttctttgcattcatcctgcttgggcttcgcattgctacttgggtttatggcttgatgtcttttgtcagttttggacgttttcagccattatattttcaaatagtgactctgccctagtctctcatttttccccttctaaggccccagttacatgtatgttcaacctttccactgtatccctacatcctctgggttcctgtgtgagccgtcctggcgaatttcctcctgctttcgcttctgttttgttggctcttcccccagctccccagggccccttgctttggcacatttgctcagagtgagctcatccatcctggccacatgcaccgattgcacctgggctattgacccctcctacagctgtttctccgtctcagacttttcctccaagttgtgggccatgattaggctctagctcaatttgccaaaagcaaattctcagaaatgaccaagaatatactctttctggctgggcccaatggctcacacctgtaatcccagcactttgggaggccgaggcaggcgggtcacctgaggtcaggagttggagaccagcctggccaacatggtgaaaccctgtctctactaaaaatacaaaaaattagcccggcatgatggcgcatacctgtagtcccagctactcaggaggccgaggcaggaaaatcacttgaacccgggaggcggaggttgcagcaagccaagatcgtgccactgcactccagcctgggcaaatagaaggagatccgtctcaaaaaaaaaaaacaacaacactattttgaaaaaaacaataaagtttagaacactttgtgttggagagggtggtcttaacaccttcggtctgtcttgagggtgtctgggttgactggtcatcgttttgtgttcataagagcattctccagagttgtccatttgcttctgtgactgtaggaggtggagagaggggggtccttgaccaaggaagagaagggagcgcggctgccagagggccaggagatgggggccagagagaaggggagactgagagaatatccttatgaaaatattgtttactgacatctgaagagactcttcaagaatgcactgaagaatatcttcatgtatctttaccaatacattgatgaagattgacttcatattcctgaggacagttaaaatcttgaatgttctcacagctagatcattcatgtaaatggaaagacagtaatgaggaatctattttcggggtgaccatcctgccgacccactccccctctctgtgagcagtggcctagtccatgttgtccaccgactctcttcttaacagggacctggggcagagacaaatggaatattccttgaaatgctgcgaggaaccagcttttgacaaattggctttcaacaaatgagctgtcagcttattcagtgcccgggggatttctccgtgtgggtgttggtcaagtccttggagtgggaccgaatagaagtcgtcactgttttccccgtctctgtcagcaccaccgtttagacctcctgcacctgaggcctgccgccaccctcctgggcctcctggggcggcagccctgccagtctatgggttccatcacgctctggtgccttctctcttctacgtaagcggtggtgccagagccccctcactggccccctggcctctgtccttctggcccgttctttgtggtgccaaaaggggaacttcatagaagtttttaaattatgaagtatttcaagcaaagggaaaatgtaaggataacataattaacagccccagctttctgaaatcttaacatttgccatattcacttcaaatcttatttttttaggaaataaaactttaaaatattctgttgaagccctcattacccctttccagcaccatctcccttccttgctattctggccttgctatactggcctcaccattctcatttgggtgcttatcttttccatgcatggttttatacttttactacttatataattatatacacaacaggtagtgattgttttcttttagagatagggtctcactctgctgcccaggctggagtgcagtggcgtgatggcagctcactgcagcctcgaactcccggactcaagaggtcctcctgcctcagcctccagagtagctgagactacaggcgcgtgccaccacacccagataattaaaaattttttttgtagagacagggtctcactgtgttgcccaggctggtgttgaattcctcctggcctcaaacaatccccttgccttggcctcccaaagcgctgggattgcaactgtgaaccactgcgcctggcctgcttgtggttttttaacagctctattgagatataatttacatattataaaatgcaccattttaactacatttcaatggtttttagtaaatttactgagttgcgcaactattgccatgattcacttttctctttttgtttaaataacggctctattgagatataattcacatcccataaaattcaccaatttaaagtgtacaattcactggtttttcgtatagtcacagagttgttcaaccatcaccactatctaattccacaatattctcttttttttttttttgagacggagtctcgctctgtcgcccaggctggagtgcagtggtgtgaactctgctcaccgcaagctccgcctcccgggttcacgccattctcctgcctcagcctcccgagtagctgggactacaggcgtccgccaccacgcccggctaatttttttttgtatttttagtacagacggggtttcaccgtgtcagccaggatggtctcgatctcctgacctcatgatccgcccgccttggcctcccaaagtgctgggattacaggcgtgagccaccgtgcccggtcctacaatattttcaccagccccaaagcaaccctgtactcattagcagccactgcccatcccccacccccagcccctggcacccactaatctgctttctgtctctatggatttgcctattctggacatttcgtaactaatggaattgtactggaatctgtggtcttttgtggcttttcaatccttatagtcaccatgtttctatagagtaactgcaggctaaactgcaggctagacttcgtgctcaacactggtcctgggggatttgcggaactgaagagcacacacagatagttcacactgtcatttctacaacttctagtctgtggctatttttgtaaagctgttacaaaagagtaactacatataaaatatatatgaatattggtgtgcgtgtggctggtgtgtgtttggggtgttcccaggcagacctggagtgggaggcaggctttccctagagcctggggagcggggaggaaggcagaagctgaacccgaatctagtctaggtcaggaccgctcgctgttggcatgagctctggatgaggtactgaaggaatctcactttctcttttgctcccaaggcaagcattgatggaagaacaggtgaatggtcgcctgcagggacagctgaatgagatttacaacctcaaacacaatctggcctgcagcgaagagagaatggcctatctatcctatgagagagccaaggaaatatgggtgagaacctcctgggggagccttgcaagaagactggagggatgagcgaatctattctgatacccccaaaccaaagcaagacacgggtcctcgagctgccccctcctgagggttcgatggccacacacatttgtttcagagctagcagcatctgatctttacactcacgctccgcttcccaccatctggcttagctgcttttgccactctggtgctgcagtgctcacccgtgagcctctgactcgggagatctggggtggagctgcttctgctgcggctgcaggtgtagggagcgccctctcagaacccctccttagacctggcttccctctcctcacttttccattcccatagcgcccacccccgtccctgggtagctgtgtcttgaccaggtcctcagcttcgggagacagtggatgggggagtgcagccgggtcagatgaagctttccctgttgctggagagcctgcgccctcccctctgccctgaatgtgctctaggctctctgcttccctcctcgaatacccactccacagtgctttctgctcacccctaagaactcaataaacgaccacaactctgtgctgacttctggtgcgtgcattttcgtctcctgcaggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcac

SEQ ID NO: 5394 - DNA, 20943 bp, human; identical to SEQ ID NO: 5393

SEQ ID NO: 5395 - DNA, 20943 bp, human; identical to SEQ ID NO: 5393

SEQ ID NO: 5396 - DNA, 10854 bp, human
acagggctttccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaaggaggcaacatactgacacacccaagggaggcgggagggtggggaagacagcagcagagggcaagaaacttctagaacttcagggtcggcaaagcctgtagcagtcattttgtcaaactccatgatggggccacttggcttttggctgcacacctctgggggaagaggctgcattggcgcccagggccatctttccattcggagccgtcctgggagagagggctcaggcccaacagaaagctgaaagctctcatcagggcagcccgagtcctgccattgggagttgcccaatccgaaagttttgcacgcaggccctcaaagaagctgaggacaccagtgaccgccccactcctggccctctccccaggtccctcctccaaaccaaattcctttggtgccttcaagaacatcgtgcaggccgggcacagtggctcacgcctgtaatcccagcactttgggaggcagaggcgggcagatgacgaggtcaacagatagagatcatcctggccaacatactgaaacctcatgtctactaaaaatgcaaaaattagctgggcttggtggcgcatgcctgtagtcccagctactcaggaggctgaggcaggagaatcgcttgaacccgggaggtggaggttgcagtgagccgagatcacgccactatgctccagcctggccacagagtgagactcttgtctcaaaacaaaacaaaacaaaaaacaacaacatcgtgcaggctgtggtttccagaagccacgccagctccttgattgccaataaacatcccgctgtggggtggccaggaccgagtgccaattagtgacagagtgcccagaccaaaccggatgaggatcttgcagttgacctcaacatgactgtgcccagaatttccttggtggcaatgtcaacagtctcttcctagatgcccccagacttcatcaatgcatgatgcttcagtgcactcttttcaaatgtcggggtgggtttttttttttttccacaaaacttcaagcatctactaaagtagagggaggagtgtaatgaactccggtacccatcactcagcttccacggtttcatctcatttcatctgtgacccctccactaccctttcttcctgattcttggaagcaaatccaagacatcacacccttccctctgtaaatctttactatgttcctctaggagaaaagggctcttctcaatacataaccacaagtcatcatcacaccgacaagtgtaacaatatttcctgaatagcttcaaatatcctagtagtgttcaaaaaatgtcatacgtattttcagtctgcttgaatcagggctcaaataaggtccacacattcagattgactgatatgccttttgactacctttgaatctagaggttccctttctatctccctgcaatttatttgtggaagcaagcaagtcgttcatgacgtagcctaacaggcccctctgacgttgttcattatgatttttctgtaaattggtagttgatctgaggatctggccagaggcaggttggatttgttggtgtgttttggcaaggagagtgtctcttttctggggtgttggcagctactgaaactcaatgcccagaccaattaaaccactggggatggaaaatgacggcattcggacaccttaccctgccttcacctattggtgaccaaaaccttaacatcttcacaggtcttcttaccctgagggtatatgccactaggttgtgtagtaaaccggtgtgtttccagtcccttagaatagtccctctctaagtgatatgccactcagtggatatgcatttagcttcatttcttttgttgctgattttcagagattgctctgtaaatttaaacttttattttactttattttattttttcgagacagtcttactctgtcgcccaggctggagtgcagtggcgcgatctcagctcactgcaacttccgcctcctcggttcgagcgattctcctgcctcagcctcccgaggagctgggactacaggtgcccgccaccacgcccagctaattttttttatttttagtagagacagggtttcaccatgttggccaggctggtctccaactgctgacctcaagtcgtccgcccacctcggcttcccaaagtgctgggattacaggtgtgagccaccgcccccggccacttaaattttgttttataattatgtaataaaacagttaaaagtctcaaattaaaatctagaaaagaaggtgtatttgaagaagtctggcttctctgcgccaccaccgaccgccccttccctacctgcctgtatttcctcgaatcactttgcctgggagctgactttgattctcttgctcattgcttcatgaaattcagttccagaactttcaggagggaggggtaggccatgacaccagctctagttacactggtggcagctcctgtcccctcccccactgctgctgggacctgttctctcctttgcccccttgtccctgcactgcccaatttggaccgcaagggttgccagggaagggcactggctgccttgttttcagaggtcgtagcacctagattgctccagccccttgcacttgcctgcaggccagagtgtcccaaaccctcccagtctcagctgctcttccccagttcacccaaggtacttcccagggaagagctgccgacagtttgggggttctctgttcttaggtccatcagcaaccccattgctcccctctgcttccttctgcacggagactgacgccatgcaggtcttcaattgtcaatggtctgtccctgctgctcatactgggggttcctggggagccagtgccaggtatcgggattgcagacattgtctgtgggtttccagaagctccttgtgttaggaacatatggggcccgtgcacagagggcagcagaggccttgtgggatccagctgtgctaggggtgagatttatctgtctctcctggccatagccaggaaatccccatttttcttaagctagcttgagttgggcttttctaacacacagctaaagaatctcttgataaaccttgggactctccatgaggccttatatggcagcaggtctgtggcttgcaatcccttcaagtaatctgccaaaaacaatgttatgacgaaggtccttccaacacaaaaggtgtagagccctagcaaactcctacagaagaaaaaggagaaataattcgtttgtagtcccagctacttgggaggccaaggtgggaggatcacttgaagtcaggagttcgagaccagcctaggcaacatagccagaccccatctctacagaaataaaaaaaattgccattgtggtaatgcacggcttgtagtcccaggtactcgagaggctgaggcaggaggatcgcttgagcccaggaggatcgcttgagcccaggagttccacgttgcagtgagctatgattgtgccactgtactccagcctgggtgacagagcaagactttgtcccaaaaaaaaaaaaaaaagaaaagaaagaaaggaaaagaataaaagagaaattaccatagattgggtggcttttaaatgataaatgtatttctcacagctctggaggctggaagtcagggtgctagcgtggtgggctctggcgaggaccctcttcctgactgcagattgccaacaactcattgtatcctcacatggaagaaagagagctagagagcactctagggactctttttcttgtttgttttaattaaaaaaaaattttttttacatgggcatgccatgttgcccaggttggatttgaactcctgggctcaagcaaccctccagcctcagcctcccaaagtgctgggattacaggcatgagccaccattcccagctaatttgggctgttcccaaaggctcaagtgatcctcccacgttggcctcctgagtagctggggctacaggcgtgagccaccatgcccagcttctaggacctcttttataagggcactaatcccattcatgagggccccactcactctgcacacatgacctaaatgacctgccaaaggccccacctcctaataccatcaccttgggggttgggatttcaacacagaaatttatggggggcacgtacattcagatcatcatgaacagtaactcctatgtgtgacagaaggtgacagaggtgggtagtggtcttcccctcaagggggtgagttgccactagctggggaatcttctggaaggcaaatgcatatgagctgggctttacaggaggcaagcgtttctctatggaagggcagaggactgtgggaggtaggaggtggggctggggcaaagggaagaggggagcagggaagtggggtgactgcacactgggagtggggaatcagatggaggagacgatgaggagttctgttaagttcaagatgccagtgccagtgaccagcgggcgatggtctctggcttgagggacaggatggaggggagactgtctgaggatggacaaagctggagggaaacagccaattgcaaaggcaggagggcggaagggggaggggagaggtgggatcagcactggtatagacaggcggtgctgcagcccagctcctctctctcctctgcctcctgccctcaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtggtaagccagtcggggcccaggctcagcggaaaccactcattcaccctgcaagcccctccggccacctcatgatgatcggggcccagctgctcctgtaggcctgtctccctccacatctgcgcctcacatccatatactgaagggttctggaggcttccatctgaacactcacattaaattcagctcccttgagtcaaacataccctgagttcctactcttgagtcaggctctgcccggggacagccagtttggagctgtggggctggtgtgggaggagacagatacagagctagacaaccccagaacagtaggggggcggggactctgggcaccctggacagaactcccctgcaattagggatgcctgctctttcagctcgccagcatctgcttttcccggaggagacacaattcccagatcctctccccatccccatcactaatatctctgtgggccactattccgctcaggtcaggagacagtggccgagaggtactagcgtgccaggctctgtgctaaggagggggccctatagccagacggcaaccacacagtaccatcatcagtcctctcagacaagaaggggcctggggcaggtggtggaggagcggctgggagcagtttgtggttcgagtggatagagtaccaccaagcagccgtggctgctggacacgaggtgggcaggcccaggtctcagaggcctcagacgtcatgcccaggagctgggactttctttcaggaggaggagaccccacatccagcagcagcagctcctgctcttgcctccccaccactcttagcagcctccccaaccccaccccgttaactgcctcaaattgtacccacgatggcccagaccagagagggtgcttgtccaagtcccggcactaccccgatagtgtagaaggggagccaagggaaggtcaggcagagaaggtccatccccaggtccgagtgctctctgcagcaggcatggcctcggtggtcacacgacccttcccgagtgcccccctgcatctccgcccacgtctgtctccgtttctgccatggtctcccgctcacccttgcctctgctcatggtctgttcttgggtcagtcaggtgccaagcagccagcacttccccaccacttttggtccacggatgcccttggccatctgggaagcctgtggaccccatctcaggagaatttttgcaaacgcataaaatgagacccataggattacaaaggcagcaaattatactgaaatacagttatcaaagtattaaacattcatcagtaacatagtctttagttaaaagcatttactggccaggctcatacctgtaatcccagcactttgggaggctgaggtgggaggactgcttgcctccaagagtttgagaccagcctgggcaacatagtgagacctcttctctacaacaaataaaaacagctgggcgtggtggcacaccagtagtcccagctactcaggaggctcaggcgggaggatcgcttgagctctggaggtcaaggctgcagtgagctatgatggcaccactgcactcagcctgggcaacagagtgagattctgtctcaaaaagtaaataaaaataaaagcatgtgttaaacgtattagtgacaccactcagtattaaggtattaagtaacaggatcccgcctgacaaccactgttatttcagagtagtgatgaacataagtggtattcgaactctctgccacctctatgaattgacaggaaaacatctgtgacctctcttgctgaccgagtcacgggtactgctaatactgccacgttcataatggaaggaaatttccagtgtctgttcgaggttggtggaaagaaagatgtcgttttttccacctcagtccgtggagccctgaattctgtgtgcagacgtttggggtctaagcaggacagtgggaagctttgcttcccacctttgctttggctcaaagccctcatctgtctgctctccccatagggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccggctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatggtcctggcattctgcttctgctggggacc

SEQ ID NO: 5397 - DNA, 13530 bp, human
gtgaccctcaggtgacgcaccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaaggaggcaacatactgacacacccaagggaggcgggagggtggggaagacagcagcagagggcaagaaacttctagaacttcagggtcggcaaagcctgtagcagtcattttgtcaaactccatgatggggccacttggcttttggctgcacacctctgggggaagaggctgcattggcgcccagggccatctttccattcggagccgtcctgggagagagggctcaggcccaacagaaagctgaaagctctcatcagggcagcccgagtcctgccattgggagttgcccaatccgaaagttttgcacgcaggccctcaaagaagctgaggacaccagtgaccgccccactcctggccctctccccaggtccctcctccaaaccaaattcctttggtgccttcaagaacatcgtgcaggccgggcacagtggctcacgcctgtaatcccagcactttgggaggcagaggcgggcagatgacgaggtcaacagatagagatcatcctggccaacatactgaaacctcatgtctactaaaaatgcaaaaattagctgggcttggtggcgcatgcctgtagtcccagctactcaggaggctgaggcaggagaatcgcttgaacccgggaggtggaggttgcagtgagccgagatcacgccactatgctccagcctggccacagagtgagactcttgtctcaaaacaaaacaaaacaaaaaacaacaacatcgtgcaggctgtggtttccagaagccacgccagctccttgattgccaataaacatcccgctgtggggtggccaggaccgagtgccaattagtgacagagtgcccagaccaaaccggatgaggatcttgcagttgacctcaacatgactgtgcccagaatttccttggtggcaatgtcaacagtctcttcctagatgcccccagacttcatcaatgcatgatgcttcagtgcactcttttcaaatgtcggggtgggtttttttttttttccacaaaacttcaagcatctactaaagtagagggaggagtgtaatgaactccggtacccatcactcagcttccacggtttcatctcatttcatctgtgacccctccactaccctttcttcctgattcttggaagcaaatccaagacatcacacccttccctctgtaaatctttactatgttcctctaggagaaaagggctcttctcaatacataaccacaagtcatcatcacaccgacaagtgtaacaatatttcctgaatagcttcaaatatcctagtagtgttcaaaaaatgtcatacgtattttcagtctgcttgaatcagggctcaaataaggtccacacattcagattgactgatatgccttttgactacctttgaatctagaggttccctttctatctccctgcaatttatttgtggaagcaagcaagtcgttcatgacgtagcctaacaggcccctctgacgttgttcattatgatttttctgtaaattggtagttgatctgaggatctggccagaggcaggttggatttgttggtgtgttttggcaaggagagtgtctcttttctggggtgttggcagctactgaaactcaatgcccagaccaattaaaccactggggatggaaaatgacggcattcggacaccttaccctgccttcacctattggtgaccaaaaccttaacatcttcacaggtcttcttaccctgagggtatatgccactaggttgtgtagtaaaccggtgtgtttccagtcccttagaatagtccctctctaagtgatatgccactcagtggatatgcatttagcttcatttcttttgttgctgattttcagagattgctctgtaaatttaaacttttattttactttattttattttttcgagacagtcttactctgtcgcccaggctggagtgcagtggcgcgatctcagctcactgcaacttccgcctcctcggttcgagcgattctcctgcctcagcctcccgaggagctgggactacaggtgcccgccaccacgcccagctaattttttttatttttagtagagacagggtttcaccatgttggccaggctggtctccaactgctgacctcaagtcgtccgcccacctcggcttcccaaagtgctgggattacaggtgtgagccaccgcccccggccacttaaattttgttttataattatgtaataaaacagttaaaagtctcaaattaaaatctagaaaagaaggtgtatttgaagaagtctggcttctctgcgccaccaccgaccgccccttccctacctgcctgtatttcctcgaatcactttgcctgggagctgactttgattctcttgctcattgcttcatgaaattcagttccagaactttcaggagggaggggtaggccatgacaccagctctagttacactggtggcagctcctgtcccctcccccactgctgctgggacctgttctctcctttgcccccttgtccctgcactgcccaatttggaccgcaagggttgccagggaagggcactggctgccttgttttcagaggtcgtagcacctagattgctccagccccttgcacttgcctgcaggccagagtgtcccaaaccctcccagtctcagctgctcttccccagttcacccaaggtacttcccagggaagagctgccgacagtttgggggttctctgttcttaggtccatcagcaaccccattgctcccctctgcttccttctgcacggagactgacgccatgcaggtcttcaattgtcaatggtctgtccctgctgctcatactgggggttcctggggagccagtgccaggtatcgggattgcagacattgtctgtgggtttccagaagctccttgtgttaggaacatatggggcccgtgcacagagggcagcagaggccttgtgggatccagctgtgctaggggtgagatttatctgtctctcctggccatagccaggaaatccccatttttcttaagctagcttgagttgggcttttctaacacacagctaaagaatctcttgataaaccttgggactctccatgaggccttatatggcagcaggtctgtggcttgcaatcccttcaagtaatctgccaaaaacaatgttatgacgaaggtccttccaacacaaaaggtgtagagccctagcaaactcctacagaagaaaaaggagaaataattcgtttgtagtcccagctacttgggaggccaaggtgggaggatcacttgaagtcaggagttcgagaccagcctaggcaacatagccagaccccatctctacagaaataaaaaaaattgccattgtggtaatgcacggcttgtagtcccaggtactcgagaggctgaggcaggaggatcgcttgagcccaggaggatcgcttgagcccaggagttccacgttgcagtgagctatgattgtgccactgtactccagcctgggtgacagagcaagactttgtcccaaaaaaaaaaaaaaaagaaaagaaagaaaggaaaagaataaaagagaaattaccatagattgggtggcttttaaatgataaatgtatttctcacagctctggaggctggaagtcagggtgctagcgtggtgggctctggcgaggaccctcttcctgactgcagattgccaacaactcattgtatcctcacatggaagaaagagagctagagagcactctagggactctttttcttgtttgttttaattaaaaaaaaattttttttacatgggcatgccatgttgcccaggttggatttgaactcctgggctcaagcaaccctccagcctcagcctcccaaagtgctgggattacaggcatgagccaccattcccagctaatttgggctgttcccaaaggctcaagtgatcctcccacgttggcctcctgagtagctggggctacaggcgtgagccaccatgcccagcttctaggacctcttttataagggcactaatcccattcatgagggccccactcactctgcacacatgacctaaatgacctgccaaaggccccacctcctaataccatcaccttgggggttgggatttcaacacagaaatttatggggggcacgtacattcagatcatcatgaacagtaactcctatgtgtgacagaaggtgacagaggtgggtagtggtcttcccctcaagggggtgagttgccactagctggggaatcttctggaaggcaaatgcatatgagctgggctttacaggaggcaagcgtttctctatggaagggcagaggactgtgggaggtaggaggtggggctggggcaaagggaagaggggagcagggaagtggggtgactgcacactgggagtggggaatcagatggaggagacgatgaggagttctgttaagttcaagatgccagtgccagtgaccagcgggcgatggtctctggcttgagggacaggatggaggggagactgtctgaggatggacaaagctggagggaaacagccaattgcaaaggcaggagggcggaagggggaggggagaggtgggatcagcactggtatagacaggcggtgctgcagcccagctcctctctctcctctgcctcctgccctcaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtggtaagccagtcggggcccaggctcagcggaaaccactcattcaccctgcaagcccctccggccacctcatgatgatcggggcccagctgctcctgtaggcctgtctccctccacatctgcgcctcacatccatatactgaagggttctggaggcttccatctgaacactcacattaaattcagctcccttgagtcaaacataccctgagttcctactcttgagtcaggctctgcccggggacagccagtttggagctgtggggctggtgtgggaggagacagatacagagctagacaaccccagaacagtaggggggcggggactctgggcaccctggacagaactcccctgcaattagggatgcctgctctttcagctcgccagcatctgcttttcccggaggagacacaattcccagatcctctccccatccccatcactaatatctctgtgggccactattccgctcaggtcaggagacagtggccgagaggtactagcgtgccaggctctgtgctaaggagggggccctatagccagacggcaaccacacagtaccatcatcagtcctctcagacaagaaggggcctggggcaggtggtggaggagcggctgggagcagtttgtggttcgagtggatagagtaccaccaagcagccgtggctgctggacacgaggtgggcaggcccaggtctcagaggcctcagacgtcatgcccaggagctgggactttctttcaggaggaggagaccccacatccagcagcagcagctcctgctcttgcctccccaccactcttagcagcctccccaaccccaccccgttaactgcctcaaattgtacccacgatggcccagaccagagagggtgcttgtccaagtcccggcactaccccgatagtgtagaaggggagccaagggaaggtcaggcagagaaggtccatccccaggtccgagtgctctctgcagcaggcatggcctcggtggtcacacgacccttcccgagtgcccccctgcatctccgcccacgtctgtctccgtttctgccatggtctcccgctcacccttgcctctgctcatggtctgttcttgggtcagtcaggtgccaagcagccagcacttccccaccacttttggtccacggatgcccttggccatctgggaagcctgtggaccccatctcaggagaatttttgcaaacgcataaaatgagacccataggattacaaaggcagcaaattatactgaaatacagttatcaaagtattaaacattcatcagtaacatagtctttagttaaaagcatttactggccaggctcatacctgtaatcccagcactttgggaggctgaggtgggaggactgcttgcctccaagagtttgagaccagcctgggcaacatagtgagacctcttctctacaacaaataaaaacagctgggcgtggtggcacaccagtagtcccagctactcaggaggctcaggcgggaggatcgcttgagctctggaggtcaaggctgcagtgagctatgatggcaccactgcactcagcctgggcaacagagtgagattctgtctcaaaaagtaaataaaaataaaagcatgtgttaaacgtattagtgacaccactcagtattaaggtattaagtaacaggatcccgcctgacaaccactgttatttcagagtagtgatgaacataagtggtattcgaactctctgccacctctatgaattgacaggaaaacatctgtgacctctcttgctgaccgagtcacgggtactgctaatactgccacgttcataatggaaggaaatttccagtgtctgttcgaggttggtggaaagaaagatgtcgttttttccacctcagtccgtggagccctgaattctgtgtgcagacgtttggggtctaagcaggacagtgggaagctttgcttcccacctttgctttggctcaaagccctcatctgtctgctctccccatagggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccggctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatggtcctggcattctgcttctgctggggaccctacgccttcttcgcatgctttgctgctgccaaccctggctaccccttccaccctttgatggctgccctgccggccttctttgccaaaagtgccactatctacaaccccgttatctatgtctttatgaaccggcaggtaagcaacaccatcagcagatcccactcaaaataccgtgtgccctagaagggtgcagcgatggccccacctggaatcatgtctctgataagaagcccgcggagcatctgggggaccctccagggaaatgaccgggaaaggctcagcgtgtgacccagccccagccagagctccggctggcccttagcagaaggcttaggtgtgccctctggaatcctttatagtctcggcctgagggtggcatttcccaaagcgtctgtgtgccgtgcgctcttcccttccggtggccctagaactatggctgccgagcttcaggggctctcctggcgttcagacgctctaggagttggtgagccctaggtacatccaccctaggtgtgcccctcttctgttcagactcgacccttctcaaccttcatctctccattttcaaaccgtaacctctggaatttgtcttcctataagaacaaaagccggccctccttggctacactgaccaagagttcaagagctttcacgagtttgtgggttagttcaggggggacgtgctgtggtcctgcccagaggcagcctccttagctggcatattgggcctcagcagcaagctgctcacacacctaaatccccccacctcctgcaggttacaggcttcattaaagcgcagctgtgatgtgacttgatggtggccagaaaggtgtgcagaggcctcccatttcaccaggcccagtccatcccttccactgggctcttccttgcttctccatcttagagccactcaatggctccagcccctttggctcagctttgactcacacaagccaagtctgcagagttcattaagggttcattctctctggtaacttttaaatagtaagtaggaccaggcctgcagtggatttccgggaactcgctgtagcacactgatgcccagagtgtagttctatccctgacccctgtttcctgactttcatgaggatcttttttaggtttctggaatcctaaactatcttgccaagtactgtctttactggattatttccattctcctttccagaactccccctggacagggggagacagatgtctgcacttctggacctcaccaggcctcgaactttgcttttaccctttccacataattatcctgtcctgccacattctgagagaattttctggaacgcagttccatgaagacagcaaattttgctcaggacagagtctggcacacagtgggtgctcaagcagcagctgctgaatggattcctcagccctatctcccagctcttcagccgagctgattctgctgtttgtcccgtttcttatgttattaatttcaaccattatattttttatttttgagagttttgatgatagagggagttagagctagtcaagagtaggcctgaaatatttagaaaatgcctttggtctgggtcctcaaagcattgtggttacttcagggatgacacaggacatgatttgagacattcatatggcccagatctctttggggtgaagcagcaaagacagacccctcctggtaccggaagacgcttggctggagagatgaggtaggggctagattgtcattacctaggcctcaccttgccccagatccatggactggaaaaaacatgacaaccacatgccttttcattaatattcctccgagccgctcaccagacagtctggggacaggtcaccactgccccttagctgtcactgtggatgagtgtcatggggctgccgtcacaaactaccacaaactcagtggcttcaaaccacagaaatggattctctcagggttctggaaatcttgagtctgaaatcagggtgttggcaaatggaaaggttccctatggaggccgggagggagaagcagctgcagggctgccggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaa

SEQ ID NO: 5398 - DNA, 6081 bp, human
acaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccggctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatggtcctggcattctgcttctgctggggaccctacgccttcttcgcatgctttgctgctgccaaccctggctaccccttccaccctttgatggctgccctgccggccttctttgccaaaagtgccactatctacaaccccgttatctatgtctttatgaaccggcaggtaagcaacaccatcagcagatcccactcaaaataccgtgtgccctagaagggtgcagcgatggccccacctggaatcatgtctctgataagaagcccgcggagcatctgggggaccctccagggaaatgaccgggaaaggctcagcgtgtgacccagccccagccagagctccggctggcccttagcagaaggcttaggtgtgccctctggaatcctttatagtctcggcctgagggtggcatttcccaaagcgtctgtgtgccgtgcgctcttcccttccggtggccctagaactatggctgccgagcttcaggggctctcctggcgttcagacgctctaggagttggtgagccctaggtacatccaccctaggtgtgcccctcttctgttcagactcgacccttctcaaccttcatctctccattttcaaaccgtaacctctggaatttgtcttcctataagaacaaaagccggccctccttggctacactgaccaagagttcaagagctttcacgagtttgtgggttagttcaggggggacgtgctgtggtcctgcccagaggcagcctccttagctggcatattgggcctcagcagcaagctgctcacacacctaaatccccccacctcctgcaggttacaggcttcattaaagcgcagctgtgatgtgacttgatggtggccagaaaggtgtgcagaggcctcccatttcaccaggcccagtccatcccttccactgggctcttccttgcttctccatcttagagccactcaatggctccagcccctttggctcagctttgactcacacaagccaagtctgcagagttcattaagggttcattctctctggtaacttttaaatagtaagtaggaccaggcctgcagtggatttccgggaactcgctgtagcacactgatgcccagagtgtagttctatccctgacccctgtttcctgactttcatgaggatcttttttaggtttctggaatcctaaactatcttgccaagtactgtctttactggattatttccattctcctttccagaactccccctggacagggggagacagatgtctgcacttctggacctcaccaggcctcgaactttgcttttaccctttccacataattatcctgtcctgccacattctgagagaattttctggaacgcagttccatgaagacagcaaattttgctcaggacagagtctggcacacagtgggtgctcaagcagcagctgctgaatggattcctcagccctatctcccagctcttcagccgagctgattctgctgtttgtcccgtttcttatgttattaatttcaaccattatattttttatttttgagagttttgatgatagagggagttagagctagtcaagagtaggcctgaaatatttagaaaatgcctttggtctgggtcctcaaagcattgtggttacttcagggatgacacaggacatgatttgagacattcatatggcccagatctctttggggtgaagcagcaaagacagacccctcctggtaccggaagacgcttggctggagagatgaggtaggggctagattgtcattacctaggcctcaccttgccccagatccatggactggaaaaaacatgacaaccacatgccttttcattaatattcctccgagccgctcaccagacagtctggggacaggtcaccactgccccttagctgtcactgtggatgagtgtcatggggctgccgtcacaaactaccacaaactcagtggcttcaaaccacagaaatggattctctcagggttctggaaatcttgagtctgaaatcagggtgttggcaaatggaaaggttccctatggaggccgggagggagaagcagctgcagggctgccggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgc

SEQ ID NO: 5399 - DNA, 24530 bp, human
gtgtctgaaatgccccatgtccggtggtgccagcactagcccccatgtcggtctcagagaaccttctccccacctctgaggtgacctaccgacccagaactcgcatggctcccaacggcgccagctccacagcgccgtgcccaagtccagacattccggatcccaagtgctgtctcttggttcaaaaatgccgaatttctacgtgagctcaagtcaggccgcctggtcgcgccacaggctgaatgcccttgggttcccatgttctgctgggttaaagggaatgtgtgtttacattttttttttttttgagacggagtctcgccctgtcgcccaagctggagtgcagtggctcgaacttagctcgttgcaacctctgcctcctggcttcaagcgattctcctgcctcagcctcctgaatagctgggattacaggcatccgccaccacacctggctaattttttgtatttttagtagagacgggttttcaccatgttggccaggttggtctcgaactcctgacctcaggtgatctgcccacctcggcctcccaaagtgttgggattacaggtgtgagccaccatgccaggcggtggtgggcacctgtaatcccagctaatgggaatctgaggcaggagaatcacttgaatccgggaagcgaggttgcagtgagctgagatggcgccactgtactccagcctgggcgacagagcaagactccgtctaaaaaaaaaaaaaaagtggctgggcacagtggcacacgctcctgtaatcccagcactttgggaggccaaggtgggtggatcacctgaggtcaggagttcctgaccagcctaacatggagacaccccgtttctactaaatacaaaaaaattagctgggtgtagtggcacatacctgtactcccagctacttgggaggctgagacaggagaatcgcttgtacctgggaggtcgaggttgcggtgagccaagatcgagccattgcactccagcctgggcaacaagagcaaaactctgtctcaagaaaaaaaatttaacaggccacctaattgcgattaaaaaaaaaccaaaaccctgaatctgtttagattcccacttgcagggtatgtgacatcaccttctgccacattctcgccagccctggacattgttaggctttttaatttttggcgttctggtggatgagaaaatagtatttaattgttgcttttcgcttactattcccggatcaccttgcaattacatgttttattatacgtttactgtcttttgtttttcgtcgtctgagatgtccgtggctaccctttaatgtctttatattgggttatttgctcttagtttactgatttgcagttctttatatattgtgttgattagccctttatctatcagatatgtttcaagcctttttttttcttgtttgcttttatttatttattttttgagatggggtctcagtctgccaccctggctggagggcagtggtgcgatcatggcagcctcgacatccccgggatcaagcgatcctcccgtctcagcgtcctgggtagctgggactacaggtgtgcaccaccactccaggataattgttgtattaattttttttttaatagagacggggtttcgccatgttgcccaggctggtcttgacctcctgagctcaagagatccacccaccttggcttccaaagtgctgggattacaggcatgagccagcacacccagcccttgtttttttttctccccctttctttctttcttttttgtttttgttttgattaatcaagtcccatttttttctcctcttggttatttggatgttatgtacatatgtagcttcttttctagtgattacttttttttttttttttgagacaatctcactcttgtcagtcaggctggagtgcagtggcgcagtctcggctcactgcaacctccgtctccccggctcaagcaattctcctgcctcagcctccccagtagctgggattacaggtgtgtgccaccatgcccggctaatttttgtatttttagtagggacagtgtttcgcagtgttgaccatgatggtctcaaactcctgacctcaagtgatccacccgccttggcttcccaaagtgctgggattacagctgtgagccaccacgcccggcccggccccccccccccgctcttttttttttgagacaaggtctcactctgtcacccaggttggagggcagtagcacagtcacaggtcactgcagcctctacttgctgggcacaagtaatcctcctgcctcagcatcctgagtagctgggaccacaggtgcacaccactgccctggcaagacttgctttttaaacagttgttgaattcttacatttgtcagtggtgtactgaactccttcatgtctaaaaatgtctttagtctaaccccacagttgacagttggggtgtagaattttaggctgggaaatcatttttccctcagaatttcgaaagcagcacttcattgtctttttttttttttttttttttttttttttgggacagagtcttgctctgtcgcccaggctggagtacaggggagtgatcctcggctcactgcaacctcttgggttcaagcgattctcttgcctcagcctcccgagtagctgggattacaggcgcccaccacaatgctggctaatttttgtatttttaagtagagacagagtttcctcatgttggccagcctggtctcaaactcttgacttcaagtgatccgcctgcctgggcttcccagagtgctgagattacaggtgtgagccaccgtgcccggccagcacttcattgtcttctagttccccatgctgttgctgaagtctgaagccattctgacttctgattctttgaatgtgacctatttttttctctctgacagttattctctcagtgtatcgaagatatcagtcaactatcttctggattgcattgatgctattgagaaggcagcctgcagtctaaaagtcatggttttaaaggtaatcagctttttttcctctggctgcttttaacatcttgtgtcggccgcggcggtggctcatgcttgtaatcccagcactttgggaggcccaggtgggcggaatcatttgaggtcaggagttccagaccagcctggccaacatggtgaaacactgtctctactaaaaatacaaaaattagctgggcatggtggcgggcgcctgtagtaccagctacttgggaggctgacgcaggagaatcgcttgaacccgggaggcagaggttgcagtgagccgagatcacgccactgtactccagcctgggcgacaagagcgaaacactgtttcaaaaaaaaaaaaaaaaaaaaaatctcgtgtctaggtgtggacctatttctgtcttccctgcttaggatttattgggcttcttgaatttgtgaatttgtgtctttcttcagttctggaaagttcttagggagttatctcttaaaatgttgctgctgtggccggtcgtagtgctcatgcctgtaatcccagcactttgggaggccgaggtgggtgggtcacctgatgttgagagttcgagaacagtcttgccaacatgatgaaaccccatctctactaaaaatacaaaagaattagctagctgtgatggcacgcgcctgtagtcccagctactcgggaggctgaggcacgagaagtgcttgaacccgggcagcagaggtcggccgtgagccgagattgtgccacggcactccgcctaggcaacagagtgtgactccatttcaatttaaaaaaaaaagaagaaaaatatgtatatattgctgctgcttcattctgtctgtcttctctctctggtgtgacaattggatttttgttagacctactcatgctaccttccatgtcttctatttttcaagttttctatttttttgtgcctctgtgctgcattctggatacttttttttctttctttcttttctctttctctctctctctctctctctctctctctctttctttcttgggatggagttttgctcttgttgcccaggttggagtgcagtggcgtgatctcggctcactgcaacctctgcctcctgggttcaagccattctcctgcctcagcctcccaagtagctgggattacaggtgcccaccaccatgcccagttaattttttgtattttttagtagagacagggtttcaccatgttggtcaggttagcctcaaactcctgacgtcaggtgatccacccgccttggcctcccaaaatgctgggattacaggcgtgtgagccaccgcgcccggcctggatactttctttagctcctctgtacaatttaccaacagtctctccagccatatcaaatctgccattaaatccatcaattgaacatattattatttattatttatttattttttgagacggagtctcactctaccacccaggctggagtgcagtggcacgatctcagctcactgcaacttctgcaccccgggttcaagcggttctcctgcctcagcctcccgagtagctgggactacaggcgtgtgcaccacgctggctaattttgtatttctagtagagatggggtttctctgtgttggtcaggctggtcttgaactccccgacctcaggtgatcccgcccgcctcggcctcccaaagtgctggaaagtacaggtgtgaaccactgtgccaggcatttttttttttttttttgtattttgtatagacggggtttcaccatgttggccagactggtcttgacctcctgacctccgcccgcctcggcctcccaaagtgctgggattacaggcatgagcaccacacctggcctatattgaacatttaaatagtttgaaaactgtgaaatctggcatatgtatataaaggtgcagaaaacattgatgtatgttttaagaagtaacgataaggtgaacacacatttaaccactactcaggccaggcaccccagcctccacagtcaccccagtcataatccccttctcccgctctagtgggaaccaccatcctggggtttctgttgccaacatccatgctgctctttagctttcctgcctgtgtagtcatccctacacaatattgtttagttttgcctgctcttggaatttatgtaaatggaaccatatatagtatggattttctgtctggtttcttttgttcaacattatgcttgtgaaatgcattcatgtttttcaaggctgtagttcattctcattgctgtacagtagtatgttgttgcatatattacagtttacttacactttctgggcaggtggtttgttgctagttgttggatattgagaacatcagtgtacttgcctcctgggaatatcgcctatgaatgcagttgctggatcatttggtaggtatatcttcaactttgtgatactgtcaagtggttttctaaggtggctgtagtacaaatttgcttcccgccagtaatgattgagagttcctgttgcgctatatccttgccaactcttattgttgttagtctgtctgagtttgaccaatctactgggtacatagtggtatcactttgcattttaaaaattgaggtataggccagatgcagtggctcacaccggtaatcccagcactctttgggaggccgaggcgggaggatcacttgaggtcaggagttggaaaccagcctggtcaacatggtgaaaccctgtctctactaataatacacgaattagctgggtgtggtgatgcacacctgtaatcccagctactcgggaggctgagccatgagaattgcttaaacccgggaggcgaaggttgtagtgagccgagattgcaccactgcactccagcctgggtgacagagtgagactccgtctcaaaaaacaaaaaagtagaaacggaacagaggctgcacctgagctgccccccacctccctctcctagctccttgctctggtgggctgggttccagctatgctgctcttgccatctttattttagaggtaagaaaactgagcctcagagcagtttattaacttgctcaaggtctcagagtggtagagccaggatttgaactgggctcttcgtcaaaggcaatgttaatcccctcaccatgtgagagactcattcttttgtgttacagtagaattttctgccgtagactgtcagctgtatgagatcaaggaatgtatctggcttctgtaccacgtggtaggcactcagagaaagtatgtgttgaatgaatgattggatgaatgaatgaacctgttaggaggcaaatctctctgcctaacccttcctgtctccctgggagtagcaatacagcaagctgtaagagttgacggaaataagcttattccatactttacaagaacagttctttataaatgagacccacaattggtaatttttggaagagaaaataggagtgcagtgcaaaaacaggcagatgtagaagggagtctggccacctgtgggtcttagtgaggcacacatgtagagcaaggagtcagacgctgaaaaggaggggagaggggccctgaagatgagcatcacctcctcagtctgtgtcgggcccatcttgaatgcacaaatcttgcgtgtgtaagtatccatgcatatgtggaagtgttttatggagtcataacgtgtccaattctcccacactttgcggctcacagagcaccgtattgtgatttcttgtttcccaacgtaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggtgaggccttggctctggggactggaagcagaggaggaaccgctcccaggagccacctatgggagggtgaaagggagccaggacaggagcctggagagccagggtgaggggccagttggaagagcaggtccatgcttcttttagcgactgggccctgcagtggggcgagccagccctctccctgcagtcccacacctgccttgacccttgctagcgaaaatgctccagcttggcagcccctgccgggtggttgcagcggcatagcggctggccctgaccctgtggtggcaggggacaacatgggggtggcaagagtccggtagacacctggcactagttagggaggtggcgtcctttggtcccagtcggctgggaaggtgggagtcaggaccggagtcgcctcgccagctctggtctcttcacatgtgctcctagctgagctggggcacaggccgggtctcagatacttatttcaaaaatgactgccttctggtgaatgctttctccgcaccgtgcagtagctcgattttctttttcttttttttcttttgagatggagtctcactctgtcgccagactggagtgcagtggcacgatctcggcccactgcaacctccacctcccgggttcaagcgattctcctgcctcagcctcccgagtagctgggaatacaggcgtgcaccagcacatccggctattttttgtatttttagtacaggcggggtttcaccatgttgaccaggatggtctcaatctattgacctcgtgatccgcctgcctcagcctcccagagtgccgggattactggtgtgagccacctcaccctgccctagctcgattttctttccctctaagataaggctagggcctaccaattggaggaaaaaaaaaaaaaaaaaaaaaaaggcaaacccaatctctcaacggattctctccattcctattgggaccgttctctgggtttccatgggccctcagggggtgccacattctgtccccctcgctgcagtctgtggctaattaacgccagtccctccagcgtcctggctagggaggcagcgattcccttaggtgagccaagattctcagcatttgcatgaaaagaagaactccgcagtccttttagtgcctgatgcaggggaagcggcgtgtgggaatcatcctctttagtttccccagggaaatcttgccagcgtttacatggcctaagaatctgttaaaggacaatcaaagaatattacagggcaaccactgtcaatgagatgactagtcagagtcacaggcgtctcttgcagattattttcataggacatggcaaccaaatctaaaatcttgggagcatcaaagacccttttgtgaaaatcacacttacccggtcagctttctattaagcaacagcagaacttggtggcagttacaaacttccccgtatgtttccaagccacaggggccaatgagaatgctgtgctcaggtaaactcttaacccctctcaaatccgagtctttcgcccgctcttgatacagcggtgactaccggggagcagggcaatacctctgtctctccccctctcagacttttgctgcaaattctagaagcctgcacttctgacccggtaccccccattggactgtgacatgggatgtctggttgtttgctgcagcagcgagcctacccttactaatgttcatcgtgagcagaaaagcaggtctacagggcccaagcaggtctacaggaggagaaagggctgctgatgatttttcactgttgtcacgggctcgtaactgagctggggcaccaggttaagcagccttgttctttggccctcagacgcctactttatggttggggaagcagagtctcacggaggcacaagcaggctacgtggctgctaagtgcggacctgagagcatttcaccacaccctggctgtgtggctaagttagatgcaggggacacaggagttcatggcattttaaaaacatatacttccgtaaaatcttcttcaaaacttttacatgatctggacacagaagtgtttcaaccagccaggctccctgtgactgttgcgtcccctctggtgcatcacaaactgagaatccatactgcaagtcctgtgctgtttatcacagttaaatccgtttgctttcaggagggctgttgtggtttttatcattatggtttctttttaatttggtctcggcatgtctctactgagagtggccatagccgagatacccagtttctaggagatccctgacccgtgggaaagttaggttcggatgtgtgtgtcaggggagccacagtgaggaggcagacgaaaatgcatgaaacagcagaaatgggctgggcgtgggggctcacgcctgtaatcctagcactttgggaggttgaggtgggcagactgcttgagctcaggagtttgagaccagcctgggcaacatagtgagacccggtatctacaaaaacatcaaaaaattagctgggcgtgatggcgcgtgcctgtagtcacagctactcaggaggctgagcgggagcggggatcccttgagcccgggaggttgaggctgcagtgagtcatgattgcaccactgcactccattctgggtgacagagcaagaccctgtgtcaaaaaaaaaaaaaaaaaaagaaatgtatgactcagatcgaagagatgttaggtgtgctgatgggaggcagaggggaagtctggaggcagcagggagctgattgagctcatcagctgtgcaacagcgaagcccagaacggaagggcggggaagcttccggggctgtgcctgtattaaggtcacagggtgtgaagtgatcccacaggctttcctgcgggggttgtggattggctggtttaaagaaaacatgcacgaggaggaaactgatttacatgactctggtgttgagcattaggtcttatcgtggtcagcagccgtgggatgtgttgggttttgggtcagtgaggcgaggaccacgtgggctatgtcgcaaacaatcacatgacagggagggaggggtgttatctagggcaaaggtgacagggtacaactgctaaagttggatgctgaggcagcaactgtattaaacgcatttatgacaagggcttacttaaaaaaattgatgtagaattcacataatttcacgtaatgtgaaattaaccatttggaagcatgtaattcagtgcattaagtacatctgcagtgtggttcaaccatcacctctgtccggttgtctaacattctcatcaccccagaaggagacctccagactcactacacggtcactcctagcctcggctccaggcgttccctaatctgctttctgtctccgtgggtttgcctcttctggacttttcatataaatgggaccatacgatatgtgggcttttgtgtctagctcctttcactgttttcaaggttcactaatgttgtagcacgtatcagtacttcattctcttgacggctgactaatattccagtgcatgggtagaccacattttgtttatctgtccatcagtggatggagatttgagttgtttccaccttttggctattgtgagaagccctgcgctgaacactcagatacatgccagttgtttgaacaccagttttcaattctttggggtctataatcaggagtagaattgctggaccccgtggtgactccaggtgtagcgtttagaggagtcttcccacagcagccgcgcagctccatcttcccaccagcaatgcagaaggcttccagttgcctcacatccttgccaacatttgttgttatcctttttttttttttccaacagatgtaactgtgaagtggtatctcattatgagggctggctttcttttttatttttcctgagtctttggataggcaaaagttctttctttctttctttctttctttcttctttttctttttctctctttctttccatctctctctctctctttctttctttttctttctctctttctctttcttcctttctctctgtctctctctctctctctctatctctctttctttctttctttttcttcagggtctctgttgcccaggctgcatgcagtcatagttcactacagccttgaactcctgggctcaagcgatcttcctgcctcagcctcccgagtagctgggagtacaaagcatgtgccaccatgcctggctaactttttaaaaattattattatttgtagagatgggatcttgctatgttgcccaggctggtcttgaacacctggccacggcctccccaagtactggggttacagatgtgagccactgtgcctggacagttcttactttttaatgcattttttaattgattgtggtaaaaacaaaaaacccacaatatattctttttgattctgcgaagtgcagggtctctatcacagcaacaattagactcaggaggcttggggctggccctggggtctcctccttcatgaggtctgggtttgtaggtccttgcagaggacgttcctgggtcctggaaggactgtgactgcttccgctggagttgcttgaggcccctggtaactctcctctctgtgtgctgaggagaagcacgggcgtcgcgaacttgatgattctggatggaagggtctttgccaagcttccctttctttcttgtggaaataggaggagcttcagatctccgagaagatgcacagtgagcggccgacctcctcagcacaagccagtctcctgggggaccagaaggccccggtccctcagtttcttcgtgggtcaggaggaaagaaggcttgagaaactcagaaaacgttcattggtagaagagatggcacccaaggaaggcatggggagccttcaagtaaaagtctcgactggccaggtctcatctgggcaccttgcatgcagagttgcaggaggccccctctagcctcctaatgagccagggggctctgggagggtcttgggggtccttccccatctcttacaggatgcgcagctgacttctgcttgatggtgaaaggcagtcaggtttcagtcttggccccgtagacagggcatggacaagtcctggagttgggggtatggtgccagcaaaaccatctttactctctggggtccatagccagtcccagcctgcccagccccaccctcctccttcacctttgtagcccgagtggtcaatgcctggggtagatgggttgctgggacatctttgttctttgttggatgagtaaaatggtcctgggagaaaacccgactgtgaggagcacattgcttcttttttttgtcttttttatgagatggagtctcactctgtcccccaggctggagtgcagtggcacgatctcggcccactgcaacctccacctccccggttcaagcgattctcctgcctcagcctcccgagtagctgggattacaggcacacgccagcatgcctggctactttttgtatttttcagtagagatggggtttcgccatgttgaccaggggtctcgaactcctgacctgaagcgatccacccacctcggcctcccaaagtgctggagttacaggtgtgagccaccacacctggctggaggacattgcttcttgccccatttctagttccctagacctgccttggcatcaactcattgaaggctccacttggtgacaaggaaccggcttatttggaaacagggtcgttgcggacgtgatgagttagatctggatgaggtcattctgcagaggggtgggccctaatgcagtgtgacctgtgtcctgacagaaaggggagacggagacacggacacacccagagggagagcgccgtgtggagacagaggctgaggccgacctgccgtggcagaagccaaggaagcccgcaggtgggcagcagagcagaagctgggacagaggccccgagtggaggcgccttctcggtcctcggcaggagcccgcccagcctgggccttcctctcggactgctggacccccagccaggagagaggccatctctgctgggaaagccactcaaagtttgtaacgctttgtgatggcagccagaggaaactcccacactcagcttgtcctttaggctctgctctgatgtcctctcctcaaagggacttcccaggctaccacgttcaaatggcctcttcttttattcttttggaagcggggttttttgaagtaaagtttttgtttttttgttttttttagatggagttttgctcttgttgcccagaccggagtgcaatggcgcaatctcggctcactgcaacctccgcctcctgagttcaagcgattctcctgcgtcagcctcccgagtagctgggattacaggcaggcaccaccacgcctggctaattttgtaattttagtagagatggggtttctccatgttggtcaggctggtctcgaactcctgtcctcaggcgatccacctgcctcggcctcccaaagtgctgggattacaggagtgagccaccgcgcctggcctttttgaggtaaattttatgcagtgaaattgcatttaagtttaggcatacagtttaacgagttttgacaaaggtttacacctgggcagctaaaatcccaataaagagctttgccaccaccccagaaagtaccctcataccctcttccagtgaatgcccgtctcccataattggccactgttccggtttctgtcactctagcttcatctccttttgaacttcacgtaagtggaatcgcacggcacgcagtgctttgtgtctggcggctttcgctccgtggaattgttttgagatccacccaagctgtgtgaagtgagtagctcatggcttcgtattgcttggcagccttccattgcatggagacgccgcaggttgcttatgccctggtccgctgccagttggggcgactgaataaagctgctatgaacgttctcgcacaagtctttctgtgaacatatgctttcatatatggaattgctagataacagggaagtgttatgtgtcttagtcccactttctgttgctgtaacagagtaccgcaggctgggtggtttataaagaaaggaagttcaatgtcaaggcgctggcagctggtgaggacctttgtacggcatcatcctatggcggaaggcagaagggcaagagggcgtgagagagcgagcgggggccaaactttcatgataacaatattaatattaatcgcctcttaccagtcccaccccttaacaccatcacatggccattaaatttcaacacgagttttgggggggacatgtacaccatagcagtatgcttaactttttaagaaagaggaaggccgggcgcggtggctcacccctgtaatcccagcactttgggaggctgaggcaggcggatcacctgaggtcgggagttcgagaccagcctgaacaacatggagtaaaccctgtctctactaaaaatacaaaattagcccggcgtggtggcacatgcctgtaatcccagctactcgggaggctgacgcaggagaatcgcttgaactcaggaggcggaggttgcggtgagccgagatcgtgccattgcactccagcctgggcaacgagtgaaactccatctcaaaaaaaaaaaaaagaggaactgttttccgacatggctataccattttacagtcccgctaggagtgtataagagttccagttgccaacgtttggcaagatcagtcttttaaatgtcagcctcttaagttcagccacaacttggtgaaattagactccaaaatttcatcaccctagcccatgttctctcgaccttggcactgtcgacattttggaccaaatgattctctgttgtgcggggctgtcctgtacattctaggatgatgagcagcatccctggtctccacttacttgatgccagtggtgccgtgaattaattgatgctgccgtgacaaattgcccccaacttcatggcttaaaataatagaaagttattctctcgcagtcctggaggctagaaggccgaaatccgtttcactgggctgaaatcaggcgaggaggacacacactcattggaggctctaggggacaaactgatctttgcctcttccagtttctggtggctgccaaattccttaattttgtggccacatcattcctgtcctgaaggccagcatcttcaaacctgtgttctgtcttcacatgacattctcgtctgtgtgtgtctaatgtccttctgcctctctctcatacatgtgattgcatttagggccaccaggataatctaggataatctttgcatctcaatacccttaaactcaccacttctggaaagcccccttttttggtcatagaaggtaacattcacagtttccaaggattatgacacagatatcttttgcggaggggctttttgtttttttcttttttagacagagtctctctctgtcacccaggctggagtgcagtggcacgatcttggctcactgcaacctccgcctcctgggttcaagcaattctcctgcctcagcctcccaagtagctgggactacaagcgcgtgccaccacacccagctaatttttttgtatttttcatagagacggggtttcaccctgttgctcagggtgttcttgaactcctgagcccaggtaatctgcccaccacagcctcacaaagtgctggggttacagatgtgagccaccgtgcccagcctaggggggcaattttagcctaccgtgccccacctatttgtaacaaccagaaatgtctgtccagagattgccaaatgtcccttgtttggggaggggggggccggcaaattgcccctggttgagaaccagtatcctagcccatgagactagtgggtgtgtgaccctgcctctgacaattaatgatgctgaaccccttttcatgtgcttatcagccaataagtctttggcttgttttcaacttggattgtctttttattgttgagttgtcagagctctttatatactccggaccagtctttgtcactcccctactttttcctttctcgcagcactcaccgcctaaactgctctcccttgtgtaggtattcatttgtgttgtattgttctcgtcaaaatatcagcacattcaggtcggccactgtgtctgagtgactgcccaaagacatgttggcacatgatggctgttctgtgagtacctgtttcatggatcagtctggatgctgcttttcctcccttcctgaagggacccagctcgccctctgggctgcctccctcctccatgtatgtcagaactctatctgctgtgtcttgggaacatcagggcagggccaggagggctgattctggatttaggcctggcccagcctcctctctgcaaggtatttactgaatgaccttggacgaggtgcttcaagtttgcaatcctcagtttccacatctgtaacatggaggtaaaaatgatcccactattgttggaactgttgtgagaattaattaatacttgtgtgtaagccccaagtagatgctgatggaactgaatttacaattcctttctgcttcctatgtgcaaactaagtccttgaaagatcgtaaagaaaaatggggccagatgtggtggcttatggctgtaatcccagtgctttgggaggtcgaggcaggaggattgcttcagcccaggagtctgagaccagcttgggtaacaaagtgagaccatatctctgcaaaaaattttaaaagtattaaccggacttggtggcacatgcctgtagtccctgctacatgggaggctgagacaggaggatcgcttgagcccgagagttttatgttgcagtgaactatgattgtgccactgtgctccagcctgggtgatagaggacagagtgagaacttgtctcaaaaaaaaaacagaaagagagagagagagagaggagagagagagagaggagagagagagagagagagagggagagagagagagagagagagagagaaagaaagagaaagaaagaaagaaagaaagaaagaaagaaagttgttaatggcttttttttttttttgaggtggtgtcttgctctgctgcccaggctggagggagtgcagtggcttgatctcagctcactgcaacctctgcgtcccggattcaagtgattctcctgtctcagcctcctgagtagctgagattacaggcatgcaccaccacgcccagctaatttttgcatattttagtagagacggggtttcatcatgttggccaggctggtctccaactcctaatctcaaatgatccacctgccttggcctcccaaagtgctgtgattacaggcgtgagccaccactcccggccaatgactcttgataaattcatcaatggagcaccctaggttgatgagctcagggatttggccaagatctcgacctgaccctgccttcctcttctttccctgagtcaatgcctcctgggtttgtcattcctgctgccctctcctctccacagcattacagtgctccactaccccttactctggttgtctgtcactttctagcagcttctctaggaccgtctccacatacctgatggtcttgtccatctctcattcataaattgctggtagaggttcagagataagaagctactcaagtcagaaagcagattggtggttaccagggactggggtgatggggaatggggagtgactgctaaatagtattttttcgaggcagtgatgaaaatgttttggaacaattttttttttttttttgagacggagtctcgttctgtcacccaggctggagtgcagtggcgtgatctcggctcactgcaagctccgcctcccgggttcacgccattctcctgcctcagcctcccgagtagctgggactacaggcgcgcaccaccacgcccggctaatttttgtatttttagtagagacggggtttcaccgtgttggccaggatggtctcgatctcctgacctcgtgatccgcccgcctcggcctcccaaagtgctgggattacaggcatgactgcagccggccaatgtcttggaactattaatagccatggtggttgcacaacaccacatgtgctaaatgccactgaattgttcaccttaaaataattcattttatgttacatgaaatttacctcaataaaaattgaataaaaaagaagctactcaggtgccgagtaggcaaaactttcactcttgctttgtatttctggctgtatccacaagtgggcagtcgtgaaattttcttatagcctcctgtcatattgaaaacgcccggaagtgaatatgccaggtctccatgtttttctttcccttctggacacgaggtccttgggggcatccagaccctagctcctctgtcccaagactgttctggtatgtttcgctttcagacgaggcttggagataacaggctatggttcctagaggcttcagtgttgctctgtgacctctcagccccagggatccagtctcgggctgactttcctcaaggtatctgcttagggctttgttgcaggctggggtcgtgttaacttgaaggcacaagaacttccattttttccccgacttctcctccatgtcacagcatcctgcatcttgggatctctgaggaggtctgacctaaggtctgatctgctctctgaactggttcctctcatccctattgcgttgaagcaaagcacagacattatatcagttcatctgtaaatatttcagtgtgaacctgaaatatggatcattttgttaacatagcctaaataccataccaaaaatgttttaaaacaagtccacaatgttaaatatgcagtcactgtcaccttattgcctcacacatgccatcattcctttttatttctgaaggaattcttttttttttttttttttgtgagacagagcctcaccctgtcacccaggttggagtgcaatggtgagatctcggctcgctgcaacctctgcctcccaggttcaagcgattcccctgcctcagcctcctcagtagctgggattacaggcatgtgccaccacgcccggctagtttttgtatttttagtagagacggggtttcaccatgttggccaggccggtcttgaactcctgacctcgtgatccgcctgcctcggcctcccaaagtgctgggattacaggcgtgagccaccacacccggccctgaaggatattttttgctggacatagaattctaagttggcacttaatttttggaaataataagcattttgaacaaatcattcccttctgacttccatggtttctgttgaaaaggcagctgccagtcttcttgttgctcctcggatcacagttttgttttcctcaggctccttttaagatcttttgtttttctttgttgtttagtggttttgctatgatgatgtttggcgtgattttctttctctcttcttttttgtgccgctgactctccccttggtgtgattttctttgcattcatcctgcttgggcttcgcattgctacttggggttatggcttgatgtcttttgtcagttttggacgttttcagccattatattttcaaatagtgactctgccctagtctctcatttttccccttctaaggccccagttacatgtatgttcaacctttccactgtatccctacatcctctgggttcctgtgtgagccgtcctggcgaatttcctcctgctttcgcttctgttttgttggctcttcccccagctccccagggccccttgctttggcacatttgctcagagtgagctcatccatcctggccacatgcaccgattgcacctgggctattgacccctcctacagctgtttctccgtctcagacttttcctccaagttgtgggccatgattaggctctagctcaatttgccaaaagcaaattctcagaaatgaccaagaatatactctttccggctgggcccaatggctcacacctgtaatcccagcactttgggaggccgaggcaggcgggtcacctgaggtcaggagttggagaccagcctggccaacatggtgaaaccctgtctctactaaaaatacaaaaaattagcccggcatgatggcgcatacctgtagtcccagctactcaggaggccgaggcaggaaaatcacttgaacccgggaggcggaggttgcagcaagccaagatcgtgccactgcactccagcctgggcaaacagaaggagatccgtctcaaaaaaaaaaaacaacaacactattttgaaaaaaacaataaagtttagaacactttgtgttggagagggtggtcttaacaccttcggtctgtcttgagggtgtctgggttgactggtcatcgttttgtgttcataagagcattctccagagttgtccatttgcttttgtgactgtaggaggtggagagaggggggtccttgaccaaggaagagaagggagcgcggctgccagagggccaggagatgggggccagagagaaggggagactgagagaatatccttatgaaaatattgtttactgacatctgaatagactcttcaagaatgcactgaagaatatcttcatgtatctttaccaatacattgatgaagattgacttcatattcctgaggacagttaaaatcttgaatgttctcacagctagatcattcatgtaaatggaaagacagtaatgaggaatctattttcggggtgaccatcctgccgacccactccccctctctgtgagcagtggcctagtccatgttgtccaccgactctcttcttaacagggacctggggcagagacaaatggaatattccttgaaatgctgcgaggaaccagcttttgacaaattggctttcaacaaatgagctgtcagcttattcagtgcccgggggatttctccgtgtgggtgttggtcaagtccttggagtgggaccgaatagaagtcgtcactgttttccccgtctctgtcagcaccaccgtttagacctcctgcacctgaggcctgccgccaccctcctgggcctcctggggcggcagccctgccagtctatgggttccatcacgctctggtgccttctctcttctacgtaagcggtggtgccagagccccctcactggccccctggcctctgtccttctggcccgttctttgtggtgccaaaaggggaacttcatagaagtttttaaattatgaagtatttcaagcaaagggaaaatgtaaggataacataattaacagccccagctttctgaaatcttaacatttgccatattcacttcaaatcttatttttttaggaaataaaactttaaaatattctgttgaagccctcattacccctttccagcaccatctcccttccttgctattctggccttgctatactggcctcaccattctcatttgggtgcttatcttttccatgcatggttttatacttttactacttatataattatatacacaacaggtagtgattgttttcttttagagatagggtctcactctgctgcccaggctggagtgcagtggcgtgatggcagctcactgcagcctcgaactcccggactcaagaggtcctcctgcctcagcctccagagtagctgagactacaggcgcgtgccaccacacccagataattaaaaattttttttgtagagacagggtctcactgtgttgcccaggctggtgttgaattcctcctggcctcaaacaatccccttgccttggcctcccaaagcgctgggattgcaactgtgaaccactgcgcctggcctgcttgtggttttttaacagctctattgagatataatttacatattataaaatgcaccattttaactacatttcaatggtttttagtaaatttactgagttgcgcaactattgccatgattcacttttctctttttgtttaaataacggctctattgagatataattcacatcccataaaattcaccaatttaaagtgtacaattcactggtttttcgtatagtcacagagttgttcaaccatcaccactatctaattccacaatattctcttttttttttttttgagacggagtctcgctctgtcgcccaggctggagtgcagtggtgtgaactctgctcaccgcaagctccgcctcccgggttcacgccattctcctgcctcagcctcccgagtagctgggactacaggcgtccgccaccacgcccggctaatttttttttgtatttttagtacagacggggtttcaccgtgtcagccaggatggtctcgatctcctgacctcatgatccgcccgccttggcctcccaaagtgctgggattacaggcgtgagccaccgtgcccggtcctacaatattttcaccagccccaaagcaaccctgtactcattagcagccactgcccatcccccacccccagcccctggcacccactaatctgctttctgtctctatggatttgcctattctggacatttcgtaactaatggaattgtactggaatctgtggtcttttgtggcttttcaatccttatagtcaccatgtttctatagagtaactgcaggctaaactgcaggctagacttcgtgctcaacactggtcctgggggatttgcggaactgaagagcacacacagatagttcacactgtcatttctacaacttctagtctgtggctatttttgtaaagctgttacaaaagagtaactacatataaaatatatatgaatattggtgtgcgtgtggctggtgtgtgtttggggtgttcccaggcagacctggagtgggaggcaggctttccctagagcctggggagcggggaggaaggcagaagctgaacccgaatctagtctaggtcaggaccgctcgctgttggcatgagctctggatgaggtactgaaggaatctcactttctcttttgctcccaaggcaagcattgatggaagaacaggtgaatggtcgcctgcagggacagctgaatgagatttacaacctcaaacacaatctggcctgcagcgaagagagaatggcctatctatcctatgagagagccaaggaaatatgggtgagaacctcctgggggagccttgcaagaagactggagggatgagcgaatctattctgatacccccaaaccaaagcaagacacgggtcctcgagctgccccctcctgagggttcgatggccacacacatttgtttcagagctagcagcatctgatctttacactcacgctccgcttcccaccatctggcttagctgcttttgccactctggtgctgcagtgctcacccgtgagcctctgactcgggagatctggggtggagctgcttctgctgcggctgcaggtgtagggagcgccctctcagaacccctccttagacctggcttccctctcctcacttttccattcccatagcgcccacccccgtccctgggtagctgtgtcttgaccaggtcctcagcttcgggagacagtggatgggggagtgcagccgggtcagatgaagctttccctgttgctggagagcctgcgccctcccctctgccctgaatgtgctctaggctctctgcttccctcctcgaatacccactccacagtgctttctgctcacccctaagaactcaataaacgaccacaactctgtgctgacttctggtgcgtgcattttcgtctcctgcaggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctc

SEQ ID NO: 5400 - DNA, 24634 bp, human
gaggcaagccccgtgtgattgttgaggaggagttagcccattgccagcctgtgacgtgactgactcgaatgaaccctggtaactagggaatgtgctcgccctgtgtctgaaatgccccatgtccggtggtgccagcactagcccccatgtcggtctcagagaaccttctccccacctctgaggtgacctaccgacccagaactcgcatggctcccaacggcgccagctccacagcgccgtgcccaagtccagacattccggatcccaagtgctgtctcttggttcaaaaatgccgaatttctacgtgagctcaagtcaggccgcctggtcgcgccacaggctgaatgcccttgggttcccatgttctgctgggttaaagggaatgtgtgtttacattttttttttttttgagacggagtctcgccctgtcgcccaagctggagtgcagtggctcgaacttagctcgttgcaacctctgcctcctggcttcaagcgattctcctgcctcagcctcctgaatagctgggattacaggcatccgccaccacacctggctaattttttgtatttttagtagagacgggttttcaccatgttggccaggttggtctcgaactcctgacctcaggtgatctgcccacctcggcctcccaaagtgttgggattacaggtgtgagccaccatgccaggcggtggtgggcacctgtaatcccagctaatgggaatctgaggcaggagaatcacttgaatccgggaagcgaggttgcagtgagctgagatggcgccactgtactccagcctgggcgacagagcaagactccgtctaaaaaaaaaaaaaaagtggctgggcacagtggcacacgctcctgtaatcccagcactttgggaggccaaggtgggtggatcacctgaggtcaggagttcctgaccagcctaacatggagacaccccgtttctactaaatacaaaaaaattagctgggtgtagtggcacatacctgtactcccagctacttgggaggctgagacaggagaatcgcttgtacctgggaggtcgaggttgcggtgagccaagatcgagccattgcactccagcctgggcaacaagagcaaaactctgtctcaagaaaaaaaatttaacaggccacctaattgcgattaaaaaaaaaccaaaaccctgaatctgtttagattcccacttgcagggtatgtgacatcaccttctgccacattctcgccagccctggacattgttaggctttttaatttttggcgttctggtggatgagaaaatagtatttaattgttgcttttcgcttactattcccggatcaccttgcaattacatgttttattatacgtttactgtcttttgtttttcgtcgtctgagatgtccgtggctaccctttaatgtctttatattgggttatttgctcttagtttactgatttgcagttctttatatattgtgttgattagccctttatctatcagatatgtttcaagcctttttttttcttgtttgcttttatttatttattttttgagatggggtctcagtctgccaccctggctggagggcagtggtgcgatcatggcagcctcgacatccccgggatcaagcgatcctcccgtctcagcgtcctgggtagctgggactacaggtgtgcaccaccactccaggataattgttgtattaattttttttttaatagagacggggtttcgccatgttgcccaggctggtcttgacctcctgagctcaagagatccacccaccttggcttccaaagtgctgggattacaggcatgagccagcacacccagcccttgtttttttttctccccctttctttctttcttttttgtttttgttttgattaatcaagtcccatttttttctcctcttggttatttggatgttatgtacatatgtagcttcttttctagtgattacttttttttttttttttgagacaatctcactcttgtcagtcaggctggagtgcagtggcgcagtctcggctcactgcaacctccgtctccccggctcaagcaattctcctgcctcagcctccccagtagctgggattacaggtgtgtgccaccatgcccggctaatttttgtatttttagtagggacagtgtttcgcagtgttgaccatgatggtctcaaactcctgacctcaagtgatccacccgccttggcttcccaaagtgctgggattacagctgtgagccaccacgcccggcccggccccccccccccgctcttttttttttgagacaaggtctcactctgtcacccaggttggagggcagtagcacagtcacaggtcactgcagcctctacttgctgggcacaagtaatcctcctgcctcagcatcctgagtagctgggaccacaggtgcacaccactgccctggcaagacttgctttttaaacagttgttgaattcttacatttgtcagtggtgtactgaactccttcatgtctaaaaatgtctttagtctaaccccacagttgacagttggggtgtagaattttaggctgggaaatcatttttccctcagaatttcgaaagcagcacttcattgtctttttttttttttttttttttttttttttgggacagagtcttgctctgtcgcccaggctggagtacaggggagtgatcctcggctcactgcaacctcttgggttcaagcgattctcttgcctcagcctcccgagtagctgggattacaggcgcccaccacaatgctggctaatttttgtatttttaagtagagacagagtttcctcatgttggccagcctggtctcaaactcttgacttcaagtgatccgcctgcctgggcttcccagagtgctgagattacaggtgtgagccaccgtgcccggccagcacttcattgtcttctagttccccatgctgttgctgaagtctgaagccattctgacttctgattctttgaatgtgacctatttttttctctctgacagttattctctcagtgtatcgaagatatcagtcaactatcttctggattgcattgatgctattgagaaggcagcctgcagtctaaaagtcatggttttaaaggtaatcagctttttttcctctggctgcttttaacatcttgtgtcggccgcggcggtggctcatgcttgtaatcccagcactttgggaggcccaggtgggcggaatcatttgaggtcaggagttccagaccagcctggccaacatggtgaaacactgtctctactaaaaatacaaaaattagctgggcatggtggcgggcgcctgtagtaccagctacttgggaggctgacgcaggagaatcgcttgaacccgggaggcagaggttgcagtgagccgagatcacgccactgtactccagcctgggcgacaagagcgaaacactgtttcaaaaaaaaaaaaaaaaaaaaaatctcgtgtctaggtgtggacctatttctgtcttccctgcttaggatttattgggcttcttgaatttgtgaatttgtgtctttcttcagttctggaaagttcttagggagttatctcttaaaatgttgctgctgtggccggtcgtagtgctcatgcctgtaatcccagcactttgggaggccgaggtgggtgggtcacctgatgttgagagttcgagaacagtcttgccaacatgatgaaaccccatctctactaaaaatacaaaagaattagctagctgtgatggcacgcgcctgtagtcccagctactcgggaggctgaggcacgagaagtgcttgaacccgggcagcagaggtcggccgtgagccgagattgtgccacggcactccgcctaggcaacagagtgtgactccatttcaatttaaaaaaaaaagaagaaaaatatgtatatattgctgctgcttcattctgtctgtcttctctctctggtgtgacaattggatttttgttagacctactcatgctaccttccatgtcttctatttttcaagttttctatttttttgtgcctctgtgctgcattctggatacttttttttctttctttcttttctctttctctctctctctctctctctctctctctctttctttcttgggatggagttttgctcttgttgcccaggttggagtgcagtggcgtgatctcggctcactgcaacctctgcctcctgggttcaagccattctcctgcctcagcctcccaagtagctgggattacaggtgcccaccaccatgcccagttaattttttgtattttttagtagagacagggtttcaccatgttggtcaggttagcctcaaactcctgacgtcaggtgatccacccgccttggcctcccaaaatgctgggattacaggcgtgtgagccaccgcgcccggcctggatactttctttagctcctctgtacaatttaccaacagtctctccagccatatcaaatctgccattaaatccatcaattgaacatattattatttattatttatttattttttgagacggagtctcactctaccacccaggctggagtgcagtggcacgatctcagctcactgcaacttctgcaccccgggttcaagcggttctcctgcctcagcctcccgagtagctgggactacaggcgtgtgcaccacgctggctaattttgtatttctagtagagatggggtttctctgtgttggtcaggctggtcttgaactccccgacctcaggtgatcccgcccgcctcggcctcccaaagtgctggaaagtacaggtgtgaaccactgtgccaggcatttttttttttttttttgtattttgtatagacggggtttcaccatgttggccagactggtcttgacctcctgacctccgcccgcctcggcctcccaaagtgctgggattacaggcatgagcaccacacctggcctatattgaacatttaaatagtttgaaaactgtgaaatctggcatatgtatataaaggtgcagaaaacattgatgtatgttttaagaagtaacgataaggtgaacacacatttaaccactactcaggccaggcaccccagcctccacagtcaccccagtcataatccccttctcccgctctagtgggaaccaccatcctggggtttctgttgccaacatccatgctgctctttagctttcctgcctgtgtagtcatccctacacaatattgtttagttttgcctgctcttggaatttatgtaaatggaaccatatatagtatggattttctgtctggtttcttttgttcaacattatgcttgtgaaatgcattcatgtttttcaaggctgtagttcattctcattgctgtacagtagtatgttgttgcatatattacagtttacttacactttctgggcaggtggtttgttgctagttgttggatattgagaacatcagtgtacttgcctcctgggaatatcgcctatgaatgcagttgctggatcatttggtaggtatatcttcaactttgtgatactgtcaagtggttttctaaggtggctgtagtacaaatttgcttcccgccagtaatgattgagagttcctgttgcgctatatccttgccaactcttattgttgttagtctgtctgagtttgaccaatctactgggtacatagtggtatcactttgcattttaaaaattgaggtataggccagatgcagtggctcacaccggtaatcccagcactctttgggaggccgaggcgggaggatcacttgaggtcaggagttggaaaccagcctggtcaacatggtgaaaccctgtctctactaataatacacgaattagctgggtgtggtgatgcacacctgtaatcccagctactcgggaggctgagccatgagaattgcttaaacccgggaggcgaaggttgtagtgagccgagattgcaccactgcactccagcctgggtgacagagtgagactccgtctcaaaaaacaaaaaagtagaaacggaacagaggctgcacctgagctgccccccacctccctctcctagctccttgctctggtgggctgggttccagctatgctgctcttgccatctttattttagaggtaagaaaactgagcctcagagcagtttattaacttgctcaaggtctcagagtggtagagccaggatttgaactgggctcttcgtcaaaggcaatgttaatcccctcaccatgtgagagactcattcttttgtgttacagtagaattttctgccgtagactgtcagctgtatgagatcaaggaatgtatctggcttctgtaccacgtggtaggcactcagagaaagtatgtgttgaatgaatgattggatgaatgaatgaacctgttaggaggcaaatctctctgcctaacccttcctgtctccctgggagtagcaatacagcaagctgtaagagttgacggaaataagcttattccatactttacaagaacagttctttataaatgagacccacaattggtaatttttggaagagaaaataggagtgcagtgcaaaaacaggcagatgtagaagggagtctggccacctgtgggtcttagtgaggcacacatgtagagcaaggagtcagacgctgaaaaggaggggagaggggccctgaagatgagcatcacctcctcagtctgtgtcgggcccatcttgaatgcacaaatcttgcgtgtgtaagtatccatgcatatgtggaagtgttttatggagtcataacgtgtccaattctcccacactttgcggctcacagagcaccgtattgtgatttcttgtttcccaacgtaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggtgaggccttggctctggggactggaagcagaggaggaaccgctcccaggagccacctatgggagggtgaaagggagccaggacaggagcctggagagccagggtgaggggccagttggaagagcaggtccatgcttcttttagcgactgggccctgcagtggggcgagccagccctctccctgcagtcccacacctgccttgacccttgctagcgaaaatgctccagcttggcagcccctgccgggtggttgcagcggcatagcggctggccctgaccctgtggtggcaggggacaacatgggggtggcaagagtccggtagacacctggcactagttagggaggtggcgtcctttggtcccagtcggctgggaaggtgggagtcaggaccggagtcgcctcgccagctctggtctcttcacatgtgctcctagctgagctggggcacaggccgggtctcagatacttatttcaaaaatgactgccttctggtgaatgctttctccgcaccgtgcagtagctcgattttctttttcttttttttcttttgagatggagtctcactctgtcgccagactggagtgcagtggcacgatctcggcccactgcaacctccacctcccgggttcaagcgattctcctgcctcagcctcccgagtagctgggaatacaggcgtgcaccagcacatccggctattttttgtatttttagtacaggcggggtttcaccatgttgaccaggatggtctcaatctattgacctcgtgatccgcctgcctcagcctcccagagtgccgggattactggtgtgagccacctcaccctgccctagctcgattttctttccctctaagataaggctagggcctaccaattggaggaaaaaaaaaaaaaaaaaaaaaaaggcaaacccaatctctcaacggattctctccattcctattgggaccgttctctgggtttccatgggccctcagggggtgccacattctgtccccctcgctgcagtctgtggctaattaacgccagtccctccagcgtcctggctagggaggcagcgattcccttaggtgagccaagattctcagcatttgcatgaaaagaagaactccgcagtccttttagtgcctgatgcaggggaagcggcgtgtgggaatcatcctctttagtttccccagggaaatcttgccagcgtttacatggcctaagaatctgttaaaggacaatcaaagaatattacagggcaaccactgtcaatgagatgactagtcagagtcacaggcgtctcttgcagattattttcataggacatggcaaccaaatctaaaatcttgggagcatcaaagacccttttgtgaaaatcacacttacccggtcagctttctattaagcaacagcagaacttggtggcagttacaaacttccccgtatgtttccaagccacaggggccaatgagaatgctgtgctcaggtaaactcttaacccctctcaaatccgagtctttcgcccgctcttgatacagcggtgactaccggggagcagggcaatacctctgtctctccccctctcagacttttgctgcaaattctagaagcctgcacttctgacccggtaccccccattggactgtgacatgggatgtctggttgtttgctgcagcagcgagcctacccttactaatgttcatcgtgagcagaaaagcaggtctacagggcccaagcaggtctacaggaggagaaagggctgctgatgatttttcactgttgtcacgggctcgtaactgagctggggcaccaggttaagcagccttgttctttggccctcagacgcctactttatggttggggaagcagagtctcacggaggcacaagcaggctacgtggctgctaagtgcggacctgagagcatttcaccacaccctggctgtgtggctaagttagatgcaggggacacaggagttcatggcattttaaaaacatatacttccgtaaaatcttcttcaaaacttttacatgatctggacacagaagtgtttcaaccagccaggctccctgtgactgttgcgtcccctctggtgcatcacaaactgagaatccatactgcaagtcctgtgctgtttatcacagttaaatccgtttgctttcaggagggctgttgtggtttttatcattatggtttctttttaatttggtctcggcatgtctctactgagagtggccatagccgagatacccagtttctaggagatccctgacccgtgggaaagttaggttcggatgtgtgtgtcaggggagccacagtgaggaggcagacgaaaatgcatgaaacagcagaaatgggctgggcgtgggggctcacgcctgtaatcctagcactttgggaggttgaggtgggcagactgcttgagctcaggagtttgagaccagcctgggcaacatagtgagacccggtatctacaaaaacatcaaaaaattagctgggcgtgatggcgcgtgcctgtagtcacagctactcaggaggctgagcgggagcggggatcccttgagcccgggaggttgaggctgcagtgagtcatgattgcaccactgcactccattctgggtgacagagcaagaccctgtgtcaaaaaaaaaaaaaaaaaaagaaatgtatgactcagatcgaagagatgttaggtgtgctgatgggaggcagaggggaagtctggaggcagcagggagctgattgagctcatcagctgtgcaacagcgaagcccagaacggaagggcggggaagcttccggggctgtgcctgtattaaggtcacagggtgtgaagtgatcccacaggctttcctgcgggggttgtggattggctggtttaaagaaaacatgcacgaggaggaaactgatttacatgactctggtgttgagcattaggtcttatcgtggtcagcagccgtgggatgtgttgggttttgggtcagtgaggcgaggaccacgtgggctatgtcgcaaacaatcacatgacagggagggaggggtgttatctagggcaaaggtgacagggtacaactgctaaagttggatgctgaggcagcaactgtattaaacgcatttatgacaagggcttacttaaaaaaattgatgtagaattcacataatttcacgtaatgtgaaattaaccatttggaagcatgtaattcagtgcattaagtacatctgcagtgtggttcaaccatcacctctgtccggttgtctaacattctcatcaccccagaaggagacctccagactcactacacggtcactcctagcctcggctccaggcgttccctaatctgctttctgtctccgtgggtttgcctcttctggacttttcatataaatgggaccatacgatatgtgggcttttgtgtctagctcctttcactgttttcaaggttcactaatgttgtagcacgtatcagtacttcattctcttgacggctgactaatattccagtgcatgggtagaccacattttgtttatctgtccatcagtggatggagatttgagttgtttccaccttttggctattgtgagaagccctgcgctgaacactcagatacatgccagttgtttgaacaccagttttcaattctttggggtctataatcaggagtagaattgctggaccccgtggtgactccaggtgtagcgtttagaggagtcttcccacagcagccgcgcagctccatcttcccaccagcaatgcagaaggcttccagttgcctcacatccttgccaacatttgttgttatcctttttttttttttccaacagatgtaactgtgaagtggtatctcattatgagggctggctttcttttttatttttcctgagtctttggataggcaaaagttctttctttctttctttctttctttcttctttttctttttctctctttctttccatctctctctctctctttctttctttttctttctctctttctctttcttcctttctctctgtctctctctctctctctctatctctctttctttctttctttttcttcagggtctctgttgcccaggctgcatgcagtcatagttcactacagccttgaactcctgggctcaagcgatcttcctgcctcagcctcccgagtagctgggagtacaaagcatgtgccaccatgcctggctaactttttaaaaattattattatttgtagagatgggatcttgctatgttgcccaggctggtcttgaacacctggccacggcctccccaagtactggggttacagatgtgagccactgtgcctggacagttcttactttttaatgcattttttaattgattgtggtaaaaacaaaaaacccacaatatattctttttgattctgcgaagtgcagggtctctatcacagcaacaattagactcaggaggcttggggctggccctggggtctcctccttcatgaggtctgggtttgtaggtccttgcagaggacgttcctgggtcctggaaggactgtgactgcttccgctggagttgcttgaggcccctggtaactctcctctctgtgtgctgaggagaagcacgggcgtcgcgaacttgatgattctggatggaagggtctttgccaagcttccctttctttcttgtggaaataggaggagcttcagatctccgagaagatgcacagtgagcggccgacctcctcagcacaagccagtctcctgggggaccagaaggccccggtccctcagtttcttcgtgggtcaggaggaaagaaggcttgagaaactcagaaaacgttcattggtagaagagatggcacccaaggaaggcatggggagccttcaagtaaaagtctcgactggccaggtctcatctgggcaccttgcatgcagagttgcaggaggccccctctagcctcctaatgagccagggggctctgggagggtcttgggggtccttccccatctcttacaggatgcgcagctgacttctgcttgatggtgaaaggcagtcaggtttcagtcttggccccgtagacagggcatggacaagtcctggagttgggggtatggtgccagcaaaaccatctttactctctggggtccatagccagtcccagcctgcccagccccaccctcctccttcacctttgtagcccgagtggtcaatgcctggggtagatgggttgctgggacatctttgttctttgttggatgagtaaaatggtcctgggagaaaacccgactgtgaggagcacattgcttcttttttttgtcttttttatgagatggagtctcactctgtcccccaggctggagtgcagtggcacgatctcggcccactgcaacctccacctccccggttcaagcgattctcctgcctcagcctcccgagtagctgggattacaggcacacgccagcatgcctggctactttttgtatttttcagtagagatggggtttcgccatgttgaccaggggtctcgaactcctgacctgaagcgatccacccacctcggcctcccaaagtgctggagttacaggtgtgagccaccacacctggctggaggacattgcttcttgccccatttctagttccctagacctgccttggcatcaactcattgaaggctccacttggtgacaaggaaccggcttatttggaaacagggtcgttgcggacgtgatgagttagatctggatgaggtcattctgcagaggggtgggccctaatgcagtgtgacctgtgtcctgacagaaaggggagacggagacacggacacacccagagggagagcgccgtgtggagacagaggctgaggccgacctgccgtggcagaagccaaggaagcccgcaggtgggcagcagagcagaagctgggacagaggccccgagtggaggcgccttctcggtcctcggcaggagcccgcccagcctgggccttcctctcggactgctggacccccagccaggagagaggccatctctgctgggaaagccactcaaagtttgtaacgctttgtgatggcagccagaggaaactcccacactcagcttgtcctttaggctctgctctgatgtcctctcctcaaagggacttcccaggctaccacgttcaaatggcctcttcttttattcttttggaagcggggttttttgaagtaaagtttttgtttttttgttttttttagatggagttttgctcttgttgcccagaccggagtgcaatggcgcaatctcggctcactgcaacctccgcctcctgagttcaagcgattctcctgcgtcagcctcccgagtagctgggattacaggcaggcaccaccacgcctggctaattttgtaattttagtagagatggggtttctccatgttggtcaggctggtctcgaactcctgtcctcaggcgatccacctgcctcggcctcccaaagtgctgggattacaggagtgagccaccgcgcctggcctttttgaggtaaattttatgcagtgaaattgcatttaagtttaggcatacagtttaacgagttttgacaaaggtttacacctgggcagctaaaatcccaataaagagctttgccaccaccccagaaagtaccctcataccctcttccagtgaatgcccgtctcccataattggccactgttccggtttctgtcactctagcttcatctccttttgaacttcacgtaagtggaatcgcacggcacgcagtgctttgtgtctggcggctttcgctccgtggaattgttttgagatccacccaagctgtgtgaagtgagtagctcatggcttcgtattgcttggcagccttccattgcatggagacgccgcaggttgcttatgccctggtccgctgccagttggggcgactgaataaagctgctatgaacgttctcgcacaagtctttctgtgaacatatgctttcatatatggaattgctagataacagggaagtgttatgtgtcttagtcccactttctgttgctgtaacagagtaccgcaggctgggtggtttataaagaaaggaagttcaatgtcaaggcgctggcagctggtgaggacctttgtacggcatcatcctatggcggaaggcagaagggcaagagggcgtgagagagcgagcgggggccaaactttcatgataacaatattaatattaatcgcctcttaccagtcccaccccttaacaccatcacatggccattaaatttcaacacgagttttgggggggacatgtacaccatagcagtatgcttaactttttaagaaagaggaaggccgggcgcggtggctcacccctgtaatcccagcactttgggaggctgaggcaggcggatcacctgaggtcgggagttcgagaccagcctgaacaacatggagtaaaccctgtctctactaaaaatacaaaattagcccggcgtggtggcacatgcctgtaatcccagctactcgggaggctgacgcaggagaatcgcttgaactcaggaggcggaggttgcggtgagccgagatcgtgccattgcactccagcctgggcaacgagtgaaactccatctcaaaaaaaaaaaaaagaggaactgttttccgacatggctataccattttacagtcccgctaggagtgtataagagttccagttgccaacgtttggcaagatcagtcttttaaatgtcagcctcttaagttcagccacaacttggtgaaattagactccaaaatttcatcaccctagcccatgttctctcgaccttggcactgtcgacattttggaccaaatgattctctgttgtgcggggctgtcctgtacattctaggatgatgagcagcatccctggtctccacttacttgatgccagtggtgccgtgaattaattgatgctgccgtgacaaattgcccccaacttcatggcttaaaataatagaaagttattctctcgcagtcctggaggctagaaggccgaaatccgtttcactgggctgaaatcaggcgaggaggacacacactcattggaggctctaggggacaaactgatctttgcctcttccagtttctggtggctgccaaattccttaattttgtggccacatcattcctgtcctgaaggccagcatcttcaaacctgtgttctgtcttcacatgacattctcgtctgtgtgtgtctaatgtccttctgcctctctctcatacatgtgattgcatttagggccaccaggataatctaggataatctttgcatctcaatacccttaaactcaccacttctggaaagcccccttttttggtcatagaaggtaacattcacagtttccaaggattatgacacagatatcttttgcggaggggctttttgtttttttcttttttagacagagtctctctctgtcacccaggctggagtgcagtggcacgatcttggctcactgcaacctccgcctcctgggttcaagcaattctcctgcctcagcctcccaagtagctgggactacaagcgcgtgccaccacacccagctaatttttttgtatttttcatagagacggggtttcaccctgttgctcagggtgttcttgaactcctgagcccaggtaatctgcccaccacagcctcacaaagtgctggggttacagatgtgagccaccgtgcccagcctaggggggcaattttagcctaccgtgccccacctatttgtaacaaccagaaatgtctgtccagagattgccaaatgtcccttgtttggggaggggggggccggcaaattgcccctggttgagaaccagtatcctagcccatgagactagtgggtgtgtgaccctgcctctgacaattaatgatgctgaaccccttttcatgtgcttatcagccaataagtctttggcttgttttcaacttggattgtctttttattgttgagttgtcagagctctttatatactccggaccagtctttgtcactcccctactttttcctttctcgcagcactcaccgcctaaactgctctcccttgtgtaggtattcatttgtgttgtattgttctcgtcaaaatatcagcacattcaggtcggccactgtgtctgagtgactgcccaaagacatgttggcacatgatggctgttctgtgagtacctgtttcatggatcagtctggatgctgcttttcctcccttcctgaagggacccagctcgccctctgggctgcctccctcctccatgtatgtcagaactctatctgctgtgtcttgggaacatcagggcagggccaggagggctgattctggatttaggcctggcccagcctcctctctgcaaggtatttactgaatgaccttggacgaggtgcttcaagtttgcaatcctcagtttccacatctgtaacatggaggtaaaaatgatcccactattgttggaactgttgtgagaattaattaatacttgtgtgtaagccccaagtagatgctgatggaactgaatttacaattcctttctgcttcctatgtgcaaactaagtccttgaaagatcgtaaagaaaaatggggccagatgtggtggcttatggctgtaatcccagtgctttgggaggtcgaggcaggaggattgcttcagcccaggagtctgagaccagcttgggtaacaaagtgagaccatatctctgcaaaaaattttaaaagtattaaccggacttggtggcacatgcctgtagtccctgctacatgggaggctgagacaggaggatcgcttgagcccgagagttttatgttgcagtgaactatgattgtgccactgtgctccagcctgggtgatagaggacagagtgagaacttgtctcaaaaaaaaaacagaaagagagagagagagagaggagagagagagagaggagagagagagagagagagagggagagagagagagagagagagagagaaagaaagagaaagaaagaaagaaagaaagaaagaaagaaagttgttaatggcttttttttttttttgaggtggtgtcttgctctgctgcccaggctggagggagtgcagtggcttgatctcagctcactgcaacctctgcgtcccggattcaagtgattctcctgtctcagcctcctgagtagctgagattacaggcatgcaccaccacgcccagctaatttttgcatattttagtagagacggggtttcatcatgttggccaggctggtctccaactcctaatctcaaatgatccacctgccttggcctcccaaagtgctgtgattacaggcgtgagccaccactcccggccaatgactcttgataaattcatcaatggagcaccctaggttgatgagctcagggatttggccaagatctcgacctgaccctgccttcctcttctttccctgagtcaatgcctcctgggtttgtcattcctgctgccctctcctctccacagcattacagtgctccactaccccttactctggttgtctgtcactttctagcagcttctctaggaccgtctccacatacctgatggtcttgtccatctctcattcataaattgctggtagaggttcagagataagaagctactcaagtcagaaagcagattggtggttaccagggactggggtgatggggaatggggagtgactgctaaatagtattttttcgaggcagtgatgaaaatgttttggaacaattttttttttttttttgagacggagtctcgttctgtcacccaggctggagtgcagtggcgtgatctcggctcactgcaagctccgcctcccgggttcacgccattctcctgcctcagcctcccgagtagctgggactacaggcgcgcaccaccacgcccggctaatttttgtatttttagtagagacggggtttcaccgtgttggccaggatggtctcgatctcctgacctcgtgatccgcccgcctcggcctcccaaagtgctgggattacaggcatgactgcagccggccaatgtcttggaactattaatagccatggtggttgcacaacaccacatgtgctaaatgccactgaattgttcaccttaaaataattcattttatgttacatgaaatttacctcaataaaaattgaataaaaaagaagctactcaggtgccgagtaggcaaaactttcactcttgctttgtatttctggctgtatccacaagtgggcagtcgtgaaattttcttatagcctcctgtcatattgaaaacgcccggaagtgaatatgccaggtctccatgtttttctttcccttctggacacgaggtccttgggggcatccagaccctagctcctctgtcccaagactgttctggtatgtttcgctttcagacgaggcttggagataacaggctatggttcctagaggcttcagtgttgctctgtgacctctcagccccagggatccagtctcgggctgactttcctcaaggtatctgcttagggctttgttgcaggctggggtcgtgttaacttgaaggcacaagaacttccattttttccccgacttctcctccatgtcacagcatcctgcatcttgggatctctgaggaggtctgacctaaggtctgatctgctctctgaactggttcctctcatccctattgcgttgaagcaaagcacagacattatatcagttcatctgtaaatatttcagtgtgaacctgaaatatggatcattttgttaacatagcctaaataccataccaaaaatgttttaaaacaagtccacaatgttaaatatgcagtcactgtcaccttattgcctcacacatgccatcattcctttttatttctgaaggaattcttttttttttttttttttgtgagacagagcctcaccctgtcacccaggttggagtgcaatggtgagatctcggctcgctgcaacctctgcctcccaggttcaagcgattcccctgcctcagcctcctcagtagctgggattacaggcatgtgccaccacgcccggctagtttttgtatttttagtagagacggggtttcaccatgttggccaggccggtcttgaactcctgacctcgtgatccgcctgcctcggcctcccaaagtgctgggattacaggcgtgagccaccacacccggccctgaaggatattttttgctggacatagaattctaagttggcacttaatttttggaaataataagcattttgaacaaatcattcccttctgacttccatggtttctgttgaaaaggcagctgccagtcttcttgttgctcctcggatcacagttttgttttcctcaggctccttttaagatcttttgtttttctttgttgtttagtggttttgctatgatgatgtttggcgtgattttctttctctcttcttttttgtgccgctgactctccccttggtgtgattttctttgcattcatcctgcttgggcttcgcattgctacttggggttatggcttgatgtcttttgtcagttttggacgttttcagccattatattttcaaatagtgactctgccctagtctctcatttttccccttctaaggccccagttacatgtatgttcaacctttccactgtatccctacatcctctgggttcctgtgtgagccgtcctggcgaatttcctcctgctttcgcttctgttttgttggctcttcccccagctccccagggccccttgctttggcacatttgctcagagtgagctcatccatcctggccacatgcaccgattgcacctgggctattgacccctcctacagctgtttctccgtctcagacttttcctccaagttgtgggccatgattaggctctagctcaatttgccaaaagcaaattctcagaaatgaccaagaatatactctttccggctgggcccaatggctcacacctgtaatcccagcactttgggaggccgaggcaggcgggtcacctgaggtcaggagttggagaccagcctggccaacatggtgaaaccctgtctctactaaaaatacaaaaaattagcccggcatgatggcgcatacctgtagtcccagctactcaggaggccgaggcaggaaaatcacttgaacccgggaggcggaggttgcagcaagccaagatcgtgccactgcactccagcctgggcaaacagaaggagatccgtctcaaaaaaaaaaaacaacaacactattttgaaaaaaacaataaagtttagaacactttgtgttggagagggtggtcttaacaccttcggtctgtcttgagggtgtctgggttgactggtcatcgttttgtgttcataagagcattctccagagttgtccatttgcttttgtgactgtaggaggtggagagaggggggtccttgaccaaggaagagaagggagcgcggctgccagagggccaggagatgggggccagagagaaggggagactgagagaatatccttatgaaaatattgtttactgacatctgaatagactcttcaagaatgcactgaagaatatcttcatgtatctttaccaatacattgatgaagattgacttcatattcctgaggacagttaaaatcttgaatgttctcacagctagatcattcatgtaaatggaaagacagtaatgaggaatctattttcggggtgaccatcctgccgacccactccccctctctgtgagcagtggcctagtccatgttgtccaccgactctcttcttaacagggacctggggcagagacaaatggaatattccttgaaatgctgcgaggaaccagcttttgacaaattggctttcaacaaatgagctgtcagcttattcagtgcccgggggatttctccgtgtgggtgttggtcaagtccttggagtgggaccgaatagaagtcgtcactgttttccccgtctctgtcagcaccaccgtttagacctcctgcacctgaggcctgccgccaccctcctgggcctcctggggcggcagccctgccagtctatgggttccatcacgctctggtgccttctctcttctacgtaagcggtggtgccagagccccctcactggccccctggcctctgtccttctggcccgttctttgtggtgccaaaaggggaacttcatagaagtttttaaattatgaagtatttcaagcaaagggaaaatgtaaggataacataattaacagccccagctttctgaaatcttaacatttgccatattcacttcaaatcttatttttttaggaaataaaactttaaaatattctgttgaagccctcattacccctttccagcaccatctcccttccttgctattctggccttgctatactggcctcaccattctcatttgggtgcttatcttttccatgcatggttttatacttttactacttatataattatatacacaacaggtagtgattgttttcttttagagatagggtctcactctgctgcccaggctggagtgcagtggcgtgatggcagctcactgcagcctcgaactcccggactcaagaggtcctcctgcctcagcctccagagtagctgagactacaggcgcgtgccaccacacccagataattaaaaattttttttgtagagacagggtctcactgtgttgcccaggctggtgttgaattcctcctggcctcaaacaatccccttgccttggcctcccaaagcgctgggattgcaactgtgaaccactgcgcctggcctgcttgtggttttttaacagctctattgagatataatttacatattataaaatgcaccattttaactacatttcaatggtttttagtaaatttactgagttgcgcaactattgccatgattcacttttctctttttgtttaaataacggctctattgagatataattcacatcccataaaattcaccaatttaaagtgtacaattcactggtttttcgtatagtcacagagttgttcaaccatcaccactatctaattccacaatattctcttttttttttttttgagacggagtctcgctctgtcgcccaggctggagtgcagtggtgtgaactctgctcaccgcaagctccgcctcccgggttcacgccattctcctgcctcagcctcccgagtagctgggactacaggcgtccgccaccacgcccggctaatttttttttgtatttttagtacagacggggtttcaccgtgtcagccaggatggtctcgatctcctgacctcatgatccgcccgccttggcctcccaaagtgctgggattacaggcgtgagccaccgtgcccggtcctacaatattttcaccagccccaaagcaaccctgtactcattagcagccactgcccatcccccacccccagcccctggcacccactaatctgctttctgtctctatggatttgcctattctggacatttcgtaactaatggaattgtactggaatctgtggtcttttgtggcttttcaatccttatagtcaccatgtttctatagagtaactgcaggctaaactgcaggctagacttcgtgctcaacactggtcctgggggatttgcggaactgaagagcacacacagatagttcacactgtcatttctacaacttctagtctgtggctatttttgtaaagctgttacaaaagagtaactacatataaaatatatatgaatattggtgtgcgtgtggctggtgtgtgtttggggtgttcccaggcagacctggagtgggaggcaggctttccctagagcctggggagcggggaggaaggcagaagctgaacccgaatctagtctaggtcaggaccgctcgctgttggcatgagctctggatgaggtactgaaggaatctcactttctcttttgctcccaaggcaagcattgatggaagaacaggtgaatggtcgcctgcagggacagctgaatgagatttacaacctcaaacacaatctggcctgcagcgaagagagaatggcctatctatcctatgagagagccaaggaaatatgggtgagaacctcctgggggagccttgcaagaagactggagggatgagcgaatctattctgatacccccaaaccaaagcaagacacgggtcctcgagctgccccctcctgagggttcgatggccacacacatttgtttcagagctagcagcatctgatctttacactcacgctccgcttcccaccatctggcttagctgcttttgccactctggtgctgcagtgctcacccgtgagcctctgactcgggagatctggggtggagctgcttctgctgcggctgcaggtgtagggagcgccctctcagaacccctccttagacctggcttccctctcctcacttttccattcccatagcgcccacccccgtccctgggtagctgtgtcttgaccaggtcctcagcttcgggagacagtggatgggggagtgcagccgggtcagatgaagctttccctgttgctggagagcctgcgccctcccctctgccctgaatgtgctctaggctctctgcttccctcctcgaatacccactccacagtgctttctgctcacccctaagaactcaataaacgaccacaactctgtgctgacttctggtgcgtgcattttcgtctcctgcaggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcac

SEQ ID NO: 5401 - DNA, 13530 bp, human; identical to SEQ ID NO: 5397

SEQ ID NO: 5402 - DNA, 33924 bp, human; identical to SEQ ID NO: 4092

SEQ ID NO: 5403 - DNA, 34686 bp, human; identical to SEQ ID NO: 4093

SEQ ID NO: 5404 - DNA, 34676 bp, human; identical to SEQ ID NO: 4094

SEQ ID NO: 5405 - DNA, 5080 bp, human; identical to SEQ ID NO: 4095

SEQ ID NO: 5406 - DNA, 25291 bp, human; identical to SEQ ID NO: 4096

SEQ ID NO: 5407 - DNA, 1077 bp, human
aggattctgccacaggacttttggaggtaaagctgaagtggggcccacagcctcacgatgacagcactggccaccgtcatggagagtagagtcagtgggcaggtcaaagagtaaggctggacctgtcagggttccggggtggaatcctcaaagatccccaatcacatcattgtcagcaatggctgggagcatccaccccctcctcacagcagccctaggatgtcggtgccagtgttacccccattttcagacaaaaacaggagggaaatgtgactcatgaagttgggctccagagcctgagccctttctcggctttgctgcactccctcccactcctgccctttggagattccccgtggtgtgtggtgtgtggtgtgtggagtgtgatgcatgtggaaggaaggagtcggaggcaagtctggctcagtatctcccaggcctcgggtcatcacgcgaaaaacagaggagggtaaaatgagaaccgctgttctcctctcgggcctgatcggctgaactctgcaagcacagactgaccagcttagaattctcagcagatcacagagcagttctcatagatgtttgcattattgtgatgtaaagctactgacttctcagatctctaatagtctctctgacacaacaacctaagggtagaaagaaagagatacaaaagagaagagttagaaatccagggagatttgaaaagcagcacgtacataagcctagtcattgcaatgaaaatctcatccaatggactcaacagcaaattgatgcccctgaacacagaatgagtgacctggaagacgatgccaaagacacttcctcctgccccgttcttagcagatgatgtggcttcctccttctgtgacgcactgcagcagcccctcctcgaggtccagagccctaggccttccatgctcccaggctcagtactagactcctggtcaccccaacatctttatttttgcctccctgctctgggggttgtagcttcttccttcaccaactctgttacttcagtatcccttttgcactttcagccctcaaaccccaagtaaatacgctttcacttccctt

SEQ ID NO: 5408 - DNA, 10192 bp, human
cgcttcggtcgctcccggtaagctccaggcgcccacgggaagccccgcccagccccgcctatccgtcctcctcttcgcctgtcctcgccaatgaccatgctcagattgcacggaattcccgcccctcgcccttgactgacgctcctgctgcccagtggacgacaccccgtcgcgtgcgcgccgctgcggccctgccgggtgtggcgcggcgctctcaggctcctaggcgttcccggggcgagacccagggcgctggccgcagagtcgccggtgcacacgcaacagtgccgccttgtgttttgggtgtggacctgcgcttctctaagcgttccattcccgagaaggggcgagaaacgtccagaggtcgtggcacctgcccgccgctgccggggcgtcggccgtgggcgcaagtgaagcgccccgggagcgcggcgcgacgtccgtgccttccgagggcggcccgggtgtcgccgcggtgcgcgcgggagggcgcggccgtgggcatttccgcgcttgcgcgggttcctgtcccgccccggccccggccccggccccggccccggccccggccccggccccggccccggcccctccctctcgtggccccgcagtagacgcagcccctccctcccgcggtgcagcgcagccagggctctgctccgggagtcatggagtccatcaccgcggagcgttatctcagcggacccacgcggtgtcctccgctggggtgggccgagtaccctccgcctcccgcccgcgagatccatcccagcccctggcgggggcccgtggttcttcccgctcatggccacggaacggtccacgctcgcggagccgcaggctgagcttttgctggtgagggacaaggtcgtggtttcccgtggctggtggccctcacggaggagcctgctgggagcacgcccgtgtagggtttcctgtcatcgggttgccacgcccatcttgaacgctcgagtccacgcagaagtgtagaagtggatgtgtagctttatttgtaattctctttctttcttcctttctttccttctttctttccttttctttctttttgagtcagggtctcactctgcgcccagtctggagtgcagtggcgcgatgagggctcactacagccttgacctctccaccccagcgagggcttcaacctccagcctcagccttccgtgtagctgggactacaggcgcacgccaccaccatgtccggctaattttttactttttgtagagatggggtctcgctttttcgcccaggttggtctgggattcctgggctcaggtgatccaccccagcctcacaaagtgctgggattctgggcaccgcgcaccggccgccgcgcccggcttgatgtgtagtttcaatagaaaccaccaaggtcttcagggtggcctgtgcatcactttacacatactcaagcgaatcattgagaggtgtttgaggccgggcgcggtggctcacgcctgtgatcccagcacttcgggaggccgaggcgggtggatcgtttgaggtcaggagtttgagaccagcctgaccaacatagtgaaactctgtctctaataaaaatataaaattagccgggcgtggtggcgccctcgcctataatcccaactactcaggaggctgaggcaggagaatcgcttgaacccaggaggcagaggttgcactgagccgagatcgcaccacggcactccagcctgggtgacagagcaagattctgtctcaaaaaaaaaaaaaaaaaaacgtttttgaaacaacttgaagcaagttatcccatgtataaaaaagcatgaagttatttatactatttttctgtgcaatcacccacataattagccaagttaagacccattatgcggccgggcgcggtggctcacgcctgtaatcccagcactttgggaggctgaggcgcgtggatcacgaggtcaggagttcgagaccagcctggctaatatggtgaaacctcgtttctactaaaaatacaaaaattagctgggcgtggtggcgtgtgcctgtagtcccagctactcgggaggctgaggcagaagaatcgcttgaacccgggaggtgaaggttgcagcaagccgagatcgcaccactgcactccagcctgggtgacacagtgagactccgtctgaaaaacaaaaacaaaaaaaaaccgttatgctacacgttttgtagtgattttgttttgtttgttttagcttttttataatttcaacttttttgtttttgagatagagtctcactcttgtcgcccaggctgagtgcaatggcaccatctcggctcattgcaacctttgcctcccaggctgaagggatcctctcacctctcacctgggttggtcaggctggtctcaaattcctgacctcagtgatgcaccagcctcggcctcccaaagtgctgggattacaggcatgagccaccgcgcccggcctgatgtactttaaacttttttttttctttttttgagacagagagtttcactcatgttgcccaggctggagtgcaatggcgtgatctcagctcaccacaacctccacctcctgggctcaagtgattctcctgcctcagcctcccgagtacctgggattacaggcatgtgccactgcaccgggcctccatttgatgtacttttaaagcattattatttctaccttgcatttactatgaacacagccttgaacgtgcatccatctctctctagaataattacctgtaagtggaattgctgggtcgagatatatgtacattaaaaaaaaaatttttttttttttttgagacaggatctcagtctgtcgctcaggctggagtggagtggctcgatcacagctcaccaccgcctcaacctcctgggctcaagtgatcttcctgtttcagcctcctgagctgctgggaccacaagtgtgtgccaccatccctggcttttttagaaaacttctttttgtacagacagggtctcactgtgttgcccaggctggtcttgaacccctgggctcaagtcctccctccttggcctctcaaagtgctggttttacagatgtgtcccaccttgtgtggcctgcatttaaaattgtaagagacactagggaattgcctcccctaaagaccctacctttgatactgtccgtccctcgcattgtaccctcagcgtttacccacagcctcaccagcaccttttgggctaacagctttttaggtagctgaaaattagatgggagaactgtagcttttcgctttttccttcttccctgtttcctagtcctgttcccctccctcccaaaggggtcatttaaaatgtggtgtcatttggaatgtgtttgttcaattgtattttagttttctgagacagggcctcgctttgtcacccaggctggagtgcagtggtgtgatcatagctcacggcagccttgatgtcccagactcaagtgatcctcccacctcagcttctggagtaactaggactacaggcatgtgccaccacgccagctaattttatttttttgtagagacgaggtctcaccctgttgcccaggttggtctcctatttctggcttcaagcgatctgcccgtctcggcctcccaaagtgcttggatgacaggcgtgagccactgccctgcacctgtggattttttgtgtgtatggttttgcccaccgtaactgtccctgtgctgcattcctattctgctgactgcttccgtcattcaacagggtttctcagctctttgtctgtggccctggagacgtacagttgactcctgtgctcctgcagaggatttcagagcttggatgcaacacatttgatcattcccaccctgagtgatgcaaccccagggcttcagctcctggtgtgccacaaaccatgccacgaaggccatggcacggaatgtggccttagcgagaagggagaattgctcttgctgaggttatcaaggggtaggattgctgggttcaagaacactgatgtttcattttcttatgtttgttctgttctttttttttttttttttttgaaagagtctcactctgtcacccaggctggagtgtagtggcgcgatctcggctcactgcaacattcacctcctgggtttaagcaattctcccatctcagcctaccgagtagctgggactaaaggcgcacgccagcatgcctggctagtttttgcatttttagtagagacggggtttcaccgtgttggccaggctggtcttgaactccggacctcaagtgatccccccgcctcggcctcccacagtgctgggatgacaggcgtgagccaccgcgcctggctcctttcccattttctaagggacagtcagtctcctccataccatttgtcacacagcctttcccccatgatggcactgccatactcccgctaaatgcgcaggcatctgtggtctcctctgcacttgtccttccagggaacgatgcagtgggctccttgctttgcatctcgccatacctggtgcacctgccagctcccttagcaggaccttgcagacagtttcagtcattcttgggcattttcttctccatgtgaagtttcccatcatcttgtcccggaccattagacacccacatccctggcttcctgggactctggtggcgtgatgggaagagcccacttcttaatattgtttttttcaagaggatctcattcttagtccaggtggcaggaatggtttcccctgctggcctcagctctgttggcaagggatacctgcagtctggggcctggagttggagcgctccagacacggtcccttccttccgggagtttctttctcgtgggtgagccagaagcaaacacctcatcccacagttctgagggcctgggtggggccatcgtcctggtccaggtaagagaccatggagtctggccaagcacgttggctcctgcctgtaatccccgcactttgggttagggttagggcaggaggatcacttggctccagcagttcaagaccagtctgggcaacctaataaggccccatctctacaaaagaaaaaaaaaattatccaggcatggtggcgtgtgcctgtagtcccagccgattgggaggctgaggcaggagcatctctggagcccaggagttcgaggctgcagtgagtgttgatcatgccactgcattccagtctgggcaacggagcaagaccctgtctcaattaaaaaaaaaaaaaagccgggcgtggtggctcacacctgtaattccagcacattgggaggctgaggcgggcagatcacctgaggtcaggagtttgagaccagcctgaccacacggagaaaccctgtctctactaaaaatacaaaataagccaggcatggtggcacatgcctgtgatcccagctactcgggaggctgaggcaggagaattgcttgaacccgggaggcagaggttgcactgagctgagatcgtgccatggcactccagcctgggcaacaagagcgaaactccatctcagaaaaaaaaaaaaaaaaaaaaaaagacagtggagtcctagatggcgagggtagcaatggagaaacccacttcaatttctttgagccaacagttggaaggattcccgtgggaaggtcaggagggagaggagccaacaggtggaactccgacagttcccccgtcctcaccttgtagggctgcaagattccttggtgcctgtctgggctccagggcccccacccacccctgcaggcttatgtgcggatcagcaagaggcactctgctctcggggcaggtactcggctggaggcgaggacacgggagggatttcagccctctcgctccccaggaagatgtccttgtgcagagaacagcctgcacgacctactagggcacccaggattaggctgtatcctccgtctgcccaaactggctacagaaagctcattttaacgcccactagagagtgaggagactgtaggtgcaatttcttttttcttttttttctgagacagatgagtcttgctctgtggtcccaggctggagtgcagtggtgtgatcttggctcactcaaacctccacctcccaggttcaagccagattctcctgcctcagcctcccgagtagctgagattacaggcatgcgccaccatgcccagctaatttttttatatttttagtagagacgtggtttcaccctgttggccaggctggtctccaactcctgacctcaattgatccacccacctcagcctcccaaagtgctgggattataggcgtgagccactgcacccgccctgtaggcagatttttttttttttttctgagatagtttctctctgtagactaggctggagtgcagtggcatgatctcggctcactgcaacctctgtcttccgggctcaagcaattctcctgcctcagcctcccaagtagctagtattacaggtgtgtgccaccacacccggctcatttttgtatttttagtagacagggtttcaccatgttggccaggttggccttgaactcctgacctcaggtaatccgcccgcctcggcctcccaaagcgctcggattacaggcgtgagccacagcgcccggccatacacgaatttttttgagacagtcttgctctgtcgcccaggctggagtacagtggtgtgatctcagctcactgcaatctctgcgtcctgagctcaagcgatcctcccacctcagctgggattagagtgtgccgccacgcctggctaatttttaaatatatatatatatatatatttttttttttttttttttttttctgagacggagtctcgctctgtcacccaggctggagtgcaatggcgtggtctcggctcactgcaacctccgcctcccgggttcaagcgattctcctgcctcagcctccgaagcagctgggattacaggcaccagccagcatgcccagctaatttttgtatttttagtagagacggggtttcaccatgttggccaggctggtctcgatctgctgacctcatgatccgcccgcctcggcctcccaaagtgctggaattacaggcgtgagccactgcgcccagccaatttttagtttttaatttttgtagaggcggtttttcgccatgttgtccaggtctcaaattcctgggctcaagtgatccgcccacctccgcccctcaaagtgctgagatcacaggcgtgagccacggcactccgccgcaattcctgacttgtactgccccagtggtgttacagcctcgaacccagtttccagacctaagtcaccgccggcatccagagtcccatgatggaaagggaggctaggttcccctgggaaggaccttgcaccactgctgcaagtgcaccccagaaatcgtcccaagcttttctcaaagggacctgcagccatttataaaagcgacatatcatcctggaaaacaggtgcgctcgagcaggatttcctcccgtccttcctgtcaaaggacgggaagactttgttaccccaccgcgccccacctgcagaatggtggacagatacctccagatgccacttcccccaggacgcccgcctgctctgcgcacctctccccggatgctgccccgtgggcgggtgggggcggccctgcttccccacgacccccagacgcacccggagggactcttgagcacagtggagtgggaagggcgaggtggggcggtgcccaggcgagagcggctcatgggaggcggcgcccgagacgcagctggtcgggacggtgcgggtcagggtgggcggagcggggctagagatgccccggggtttcccaggccatgagtctccgtggagatttctcctcgacctcttccccgcggcaatgtgcgaaccctgggtctccaggaaacggggatacggggcatggctcccagcaaggcctggtccagcctctccggtaggggaatgggtctccccctccggcctcccgggttgacaaaggaacgcgggcccagatccccgtatggcgcttcaccgccggggcctctagcctagaaggaggcacggagcgcgtgtccgagacccgtgcaagctcagggacactctcgcggtcgccgggaggcccacctagggtactttccttttttccactctcagaaatatacgtctgtcacagttaacggcaaagcctagggcaagagttctacgcccaagatggccagccggaagcgggcttctcgcgaccatgtggcgaagccccattcgtcagctggccgcccgcggccctggtacccggtcacctctctgatctgcgcatgtgctgggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttggtgagtcttgaatccgtgtactttcactgctgggaaacgggcggggaaagaagtgcctatggccgctgaaaacaattgtggggtggagcctcccccgtgcggcggccctgtcttgggaactgaccctatgttttacacctcccggctattttttagtctgcaatattactgtctgttccttcgttcccgtgtcggtgtggaagcgacggttccctcgtatctctgcctgtgtcctgcaagctcaccgcattttcgggcgctagatacgctcttggggcctttgtgtgcgttctctgtcttatttccgggcgacgtgccgcgtgcgttgtcggacgtgaagggcagtccgggaaaaacgggtgcggccgcctcctgtgtcctacagggggcgccagacgcatttccactcggcttggaggtggatttagtgccacgtgcccgaaagtcttaaattgggtgacctgagctgtgcaatgataatgcggcgattttgtagtacgcagtgtcttgaagagagaatttttaactaggaaagtttgttgcaaagtgtttataggaagcgtaagacaaagtaacggaagatggtgtctgttgtttctagtcttgggtgttgtctgtgttgcagcagccaactgttgctttgtagtttatttccccgaatggaaacggtttagaagtggacgtgcattccccacccttttcccgtccctcgtttgggttgttccttgaggggcaaagtgcctgttgggctttctgtgaacctcacctaacctgtgttttttcactcccctgcagttaccggtattgtaagaacaagccgtacccaaagtctcgcttctgccgaggtgtccctggtaagtagtggaagagcccctgcactggttggctctgcggactccgcgtccgtctgtgacaccccctgcacacttacccaatccttttagatgccaagattcgcatttttgacctggggcggaaaaaggcaaaagtggatgagtttccgctttgtggccacatggtgtcagatgaatatgagcagctgtcctctgaaggtaaggcaggattctttgttcgtcaccccccagtccttcctccgtgctccctcaaccccacccacatacactgcactggaattgggagttgatgaaacatgagccttacaaaactcagccaacacagttcccctgagctggagatagtcgtggtgaatgtttctctattatcttctctcactttgctgcttttcttctccctacctagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggtgagcttggtctgggccttttaaggcagttggagtctctacattattaggcttgcattattttatcagagcatagaggtggccccagtgactcagccactatggctactagaaaagccaggctggcaagtgactttcagtggtcactcaggaccccttcctgcagatacaaacaaagcatgagtaagtcttagcaagctcttccccacaggttaggggaaacac

SEQ ID NO: 5409 - DNA, 10123 bp, human
ctgtgcacccagagatagttgggtgacaaatcacctccaggttggggatgcctcagacttgtgatgggactgggcagatgcatctgggaaggtgagtctgtgctttgggcttcccaacctctcaagtcagcatgaaattcagaaggcagagagggacatgtggccctccaactcggggcccagggagccactgtggcatttgagagcgccaccctagctttacctcctctggtgtcctggccttgtgtatctcttagagatggcaaaatttgcagccctgacctcaaggattacaaactaatttccagtcctgtaggggtcatgggttctgctgtggccagtgtggcactgagtttgtcaggcagaatttctaattatggaaggaactctgcttcctcagtgattgaactgacctttgtgggggtgcctttgtggggtgagaatgggcatacttgggcctcagttgtgatggccatggggtggagctgaggtctaggcccagggctgggaaagcttctaccaaccccgaggcatttgggtgttttagggcagaagaggagccaggaggatgggtatgccccactggagctgtgtgtggggcagcaggtgagggtgggattccagagggagggtcaacccagccaagcagaggaaggggaggagagggtttgttttggaaagaacatcaccctctcagtttcctggggtctggatagcctgttcttgtgatgagctggaggatgtgggccctgcttggatcctcctctcccctccctgcccccattttctcttcctgtgatttatgctgttctgggctcaccctcttcccagagctgtcacgctacagctgacaggcagggcaggcgttttaattattattaatttttttttgagacagagtttgagacagtatcaagagtgggtatcctctcagcgtgtcttcaagtagcatcccagagccccgctcctgggtacccacaacatgaacaccgtccagaagcaagggcagcctctgcaggtggggcgggggttggaaaacatttatcaaacggttgagttgggtgcaggggatgcaacatgatcaaacagggtcttgcctccaggagcctcatgtagggacaacgcacagtgatgaccttcaactgcagtggggcagcaaggctgtgggaggggtgttttgggcagagcaggcgacgtgggtacctcttcaccaagacagcaggaagagcacggacatcattttcccgtctcacctccagactcccaggggactgtgccaatatcctcactccagccctggcccatggccactgctcaacccttgggccctgtcagttcagggctgtgcagaaggagagttgcctgtgctcaggctcaggggttccgtccagctaaggaggcctactaggggactggggaaaggcctcatgaaggaccaggcctgtgatggggagggaagatggcagaggggacagtgggaagcagagcagcaggggtctcctccacgcctctctgtacttctcccacccacccttgcctactcccctctgccctgggtatgtgcccttgtccacccaacacctctgcagtgccaagtccagccctgacttcttcctgagctgtggcccagcgttcccacaggcatttacctcacggatgcagcactgcccctcatcctcttctctgaaagtgtgtgggaaatgcttcttggtgccatctctctcccaccctgccttccctgcaccttctctatgaggtgtctgttgtctctgtacttgcctccagctggcctttcagaccccatccctcctgcctcctgcccatccctacccctgtcagcaccttacatactctgtgcccaacagcattggggattcccactgtgctgaaggaagtcctcatgtggtccagagagggagctggcccctgctcccatttccagcaccattttctggcacaggctccatgtccccaggctccagctgcttctggggtaccaaggtctgcatttcttcctcttcccccagcagacagaagaccttgctggacaggtgtccacttcaatagtaacttctgaggctgccagcctcctgaatggtccagaagaaccagacccttccccgcccccattaaaaaagacaaaatatggccaggcatgttggctcatgcctgacatcccagcactttgggaggccaaagcaggtgaatcacttgaggccaggagtacgagaccagcctgacaaacatggtgaaaccctgtgtctactaaaaatacaaaaattagccaggcgtggtgactcatgcttgtaaatgcttgtaatcccagctacttgggaggctgaagcaggaggatcacttgaactcgggaggcagaggttgcagtgagccgagatcacgccactgtgttccagcctgagcgacagagcgagactccgtctaaaaaaaaaaaatatatatatatatacacacatatatatatgcataatagtctctgtgtaacagtaagtggatgcagtaactggtgtgagggcaacttggagagtgtgcttggaggcacagagatgctcagggctgcctggactgcctccatgatggtggcctgctctgtattaggtgagtgttcaggaaaggtgagggcagggcagcccacagcttcacagtggcccagggaagcagggcaggcaggctatgaggcctagtaggcatctgggccagactttgacactgaggccatggaatgggtggggctctgagaacagaccaaagtgatcatgggctgaaggctatgtccacagatccaaggcgggataggctgtgctgggcagtgatgtcagccaggctccccagcgggactgggggtgtcaggggcagctctgtcccaggtggcagacactggtttcccctcctgctctcacaaccggcctgttaccaggtgttgtctgagctgtggtgaggcttccctggtgacattcaggagcagggagcctgtgagtaagggtgtatgcatctgccctgactgcctggccctgtggtcaaggatgggggaaggcagctctgcctgcagctccaccccatttataaagcactgtggtgccttctgctggggcatgtgctgagtggtgcctcgcaggcactgccctcgggaagttcacaggcttatgtggaagctggtgggaatgggccaagaagagaggtgtcaggagccaggtattgggcaggtcccaggtctctgagcctcagtttcttcatctgtaggagggtggtgaccctgccctgctcagcttaccaggtacagatgtaagttttcagtgcagaggaaaagcagagaacttcccctcagatggccatacccccttgtcgctgtacccaactctccggtcctactttgtagctctcaggtgtcacatgtggatcctgccctaccatcccccttccctgtctagaaacgaggcctgctgagcttggagccatcccactccctgctctcaagccgtctgctcctgggttagcctgtggctggcctggcctgattctacatagatgtgggtgtttctccactgctggggcagcagttgtccattctggggcctgggtcagctctcagctgtggccgttgtgcctgtgcttccccaggtcctggtggtgactccaaccctgccctcacatatcccaagagcaggctgactgccttccccattcccacctttccagtaactgctgcaagaacggacagacactgctgcagagaacttgccacggtgtttcatgctgtggctggtggttccaggctgcacgctccattctaggaaagggtgaggcttcctgatcatcagtcttaacaggggactgtcctatgggtacctgtatacgctgccgggagtggggcagagtggggttagagtagtgcctgctgcccattggtttgtgcggtcctttaaggctgtaagtctgtgtgcgtgtctggttttttcctcctcctatcagtaatcagtcttgtataaccaggctggccctgcttcctgcctaggggctatcggtgtaccatctggagttgcaaatggggtgatagggcgtcagcggccttcccacacccaagcacttcctgacacccagcccctcatctctagccaacctctggctcccctagggatcctggggctcaggcctcacgctccagcatccgggggctttgcccttctggtgttgctcttctttgcaggtgccttggaacaggggtgcaacagagttcagaaagtgccatctgttgcatggataccctgctgccaccctcgtccacctttctggggcagaacagttggatgggtctttatttaagaggacaaaagggagagagaatgcatagaggctgggtctggtgctcacgcctgtaatcccaacactttgggaggccaaggcaggtggatcccttgaggtcaggaggtcaagactagcctggccaacatggtgaaaccccgtctctactaaaaatacaaaaaaaaaaaaattagctgggcatggcgggagatgcctgtaatcccagctactcgggaggctgaggcaggataatcacttgaacccaggaggcggaggttgcagtgagccaagatcacaccactgcactctagcctgggtgacagagggagactgtctcaaaaaaaaaaatttgcttagaatttgtctgtgtgaccctgggcaagtcatttcccctccttgggactcagttccttgcctgtgaacggggacagtgcttctcccttacagagctgttgtgagaattaaagtagaaaatgtacctatggtggttgttggtagtgaccagttcccccaaccctgactcccctgcaggatggggcctgggcccgggaatgggggatgggctggcagaggatgactgtcccagagaggagtcttctcggcagatgtggagacctagctgagtcagaggccaggatctaagtttgagggtgttccttacaccctgcagccatgagtctttggctgagtcaaatggcctttctgagctcagttccttatcagtaaagcctggacagtggtccaggacgctggacactgtgtgagtgttaggacacaggacactgtgtgagtgcaggtggggacccatggagcactctgctggggagcaattcatggggagcacccctccagagagggatgatttgcacagggccctcagcccagtcccttgcaggctggaccttggagagtgaggccctgaggcgagacatgggcacctggctcctggcctgcatctgcatctgcacctgtgtctgcttgggagtctctgtcacaggggaaggacaaggtgagggctgggcactaatgtctgtatgaggtgggtggagaactagggcatgtttgggggactgggttgtccgatgtcaagcctctagggaaaggtttggcccaaactgtgctggggcatgtcctctaggggtcagcctggacctcagtctctagtctccctacttttacctccctaccttcattccctggaccgactgtagtctcccttccttcactctcttgacgcctctccagatctgacttgcccgtgtaccacaggtcagagcccatcacttcccaggcctcccagtgcttccctggacagattctgggatcatttactggtgactgccctgctagggtgtcagctgtcagatcctccccaacccccgagctcagctctggcctgaagtacttaccgtgggctcctgatggtcactgtctccagggccaaggtctagaaccttcacctgcctcaccaacaacattctcaggatcgattgccactggtctgccccagagctgggacagggctccagcccctggctcctcttcaccaggtgagcatggagggccatgcccacctggacagggatgagggtgagttccccaggattgaagcagctatgccaggacagtgtagcagccccgtggtgctgacaaatgccctttccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacggtgagcagcagctataggtctggggcggggccgcttggcaagaacatcctggctgcttgggggtttggagcagggccttgcagcctgtgagtggcccagtgagtgttctcagtcccagccgagtgagatccagggctgggggcaggcttggcccttgggaggggagggcccatatggttactgcaggggcagggttttggcaggaaataaacatgcacggctgctagttggggcaggggctggcacttgagtcatgtgaaatgcacttcagtcataccaggaaggactccaataagatgctgggaaaagcttccagcagcagactgtgaaggaaagggaaagcaagatttagaaaccacctagtctaggtgcagaggccagaggaagtcattgctgtcctgtcccgcctggggcttttgtggaccagtctcccagtgaggtgcctggtctgagagggccttgaccattccccttgggagtctttcagaccccagtcttgtgtgttctgactgacacacccagacccatggggcttcagcctcacatggattcactctgttccagttaagctggacccgccctctgacttgcagagcaacatcagttctggccactgcatcctgacctggagcatcagtcctgccttggagccaatgaccacacttctcagctatgagctggccttcaagaagcaggaagaggcctgggaggtaacactttggctggctttccctgggggcctctctcctgggaacagcagtccagggtagactccccactctacatagggagatgtcaacttgtagtgatgagaagggaggaactagagcggggtgtgtgtgcacacacacatgctggcatgcagatgtgtatgctttatgtgtgtgtatgggagtagggtgagtgcgcctgtgtctctgtgtgtgcacataagtgtggtgagtgtgcatgtatgtgtttatgtgtacacatatgtaactgtgcacactcatgtttgtgtgcccatgtttgtgtgtttatatgtaagtgtacatatgtgtgtgcctgtgccttgcatttgtgtgagtgtgcacatgggcatgcctatgtgtatgagtgtgtatgtgagtgtggtgagttgcttctgtgcacacacttttgtttatgagtgtgcatgcaagtgtgatgagtgtgaaagtgttcctgtagacatgtttgcctgtgtgtgcatatgtgtatttgtgggcaaacgcagctgtgtctgtgagtgtgagtgtgccttctgtgtgtgtgtgtgcacgtgaatgtggtgagtgtgtctgtgtgttaacacaagtgtgttcaagagtgtgttatatgagcatataatgcatgtgtgtattctcgagggctgagggacccagccccaccttcaccacctgctaactgtccccacccccacagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggtgggcactgctgtggctgctgcacttccagcggagtctgggctgggcgtcttctcccctgttcacctcagccctgcaccctttcaccctcctgtaagcccctccccgaggcagccatgcctcagttgacccccttcctctgaaggtctgaggtctgtagggaggacagaaacacctgccaactctggggcttcctgggaacctgtagttagtggctgctgttaggagtgagggtggcagggctgcacaccagggctgggctcctgcctggaggctggacatgacctcagtgtccttaatgggggctggactgacccttgcgcactgcagtgctgagatggcccagggactttatgacccaccttgtggcagatgggaagagtgaggcccaggagtgtggttcacacaaggtccttcagcaggtgacacaaacctccaaggcccatcacaaggtccttcagcaggtgacacaaacctccaaggcccatcacaaaccttccactttggcccagggcactaaagggcgcacctttgccaggtgggtttggggggagcctcctggcactgaggctgctcacagccctgggcccttcctgtccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggtgggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcaccacatgtcaggttacaagacagggtgcaggggccatgtcaggccgcagatgtgaggaagagggtgtggggagaggggtgttgggtggggctaagtgggagggtgcttcgcttctccttggagcaaaggaaagtgtaaaactgtgtgacacaacctagtttatgttttgaggaatagattgctgggacaaggggacatgggggacctgctggaggccaatgggggccagtgaggtgcccacagggagacgatttggcatgagccagtgaaagaagtggagatagagaaaagtggagagaattgcagggtctcatgaggggaaatagaagggacatgtgggtggatgagatatgagtggtgacccctgaggtggggaaatgggggacagccttgcagggaggttggtgaagtctatttggacctgttgggttggagccccaggtgacatccttgtgggagggtcagtggatccttggcagcaagtctggtgctcagggagacactgggtggggtgggagccacagaccttctgctgatggcaaagacagggttcctggagtgctggctccctctgtgatctgaggacccagctagtaactccccgttctgaacccgccatcgcagctcacgctgtaaaggacgcgcgcctcagtataaatcagttctatgcggccgttaggcaaggaggcccagttgggtcctgccctgagagtgggttggaatgtgatgagatgggagagaggcagtggcagggacgaggtgggcggacctcctgctgatggaaggaagctcagcctctgcagtgacctcaggccacctgggtcgccataggcctctgactggcctctcttggcctcagggtgaagagaatcttctaccagaacgtgccctctccagcgatgttcttccagcccctctacagtgtacacaatgggaacttccaggtgtgtgcagagaccacagaaggacatggggggcaggggttgcccagagctctggcctgcccaagatgttggctttcactgagggttggcggccagtatgggaggcttgtcagtgcttggagccttttttgtatattcagtgaatttcaatttatacgcgtatctcaaatggggaaaaattagctttattttccattgctgatttctttttg

SEQ ID NO: 5410 - DNA, 1932 bp, human
aacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggtgggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcaccacatgtcaggttacaagacagggtgcaggggccatgtcaggccgcagatgtgaggaagagggtgtggggagaggggtgttgggtggggctaagtgggagggtgcttcgcttctccttggagcaaaggaaagtgtaaaactgtgtgacacaacctagtttatgttttgaggaatagattgctgggacaaggggacatgggggacctgctggaggccaatgggggccagtgaggtgcccacagggagacgatttggcatgagccagtgaaagaagtggagatagagaaaagtggagagaattgcagggtctcatgaggggaaatagaagggacatgtgggtggatgagatatgagtggtgacccctgaggtggggaaatgggggacagccttgcagggaggttggtgaagtctatttggacctgttgggttggagccccaggtgacatccttgtgggagggtcagtggatccttggcagcaagtctggtgctcagggagacactgggtggggtgggagccacagaccttctgctgatggcaaagacagggttcctggagtgctggctccctctgtgatctgaggacccagctagtaactccccgttctgaacccgccatcgcagctcacgctgtaaaggacgcgcgcctcagtataaatcagttctatgcggccgttaggcaaggaggcccagttgggtcctgccctgagagtgggttggaatgtgatgagatgggagagaggcagtggcagggacgaggtgggcggacctcctgctgatggaaggaagctcagcctctgcagtgacctcaggccacctgggtcgccataggcctctgactggcctctcttggcctcagggtgaagagaatcttctaccagaacgtgccctctccagcgatgttcttccagcccctctacagtgtacacaatgggaacttccaggtgtgtgcagagaccacagaaggacatggggggcaggggttgcccagagctctggcctgcccaagatgttggctttcactgagggttggcggccagtatgggaggcttgtcagtgcttggagccttttttgtatattcagtgaatttcaatttatacgcgtatctcaaatggggaaaaattagctttattttccattgctgatttctttttgttctcaggtctctagttccattgttgattgaaaaaatgtaaatttctcataacttatctctgtcccctctggtttgcagctttctgcacccaccatgtgcctcacctcctccttctgcgaaggtgtctgtcctgtggccatggggaagggtctgtggtgtgtgtgctgcccttggggctctcactgcctctgggctcctgctctgcctggtcccctggtctccccgg

SEQ ID NO: 5411 - DNA, 13236 bp, human
gcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaaggtgagtctgtgctttgggcttcccaacctctcaagtcagcatgaaattcagaaggcagagagggacatgtggccctccaactcggggcccagggagccactgtggcatttgagagcgccaccctagctttacctcctctggtgtcctggccttgtgtatctcttagagatggcaaaatttgcagccctgacctcaaggattacaaactaatttccagtcctgtaggggtcatgggttctgctgtggccagtgtggcactgagtttgtcaggcagaatttctaattatggaaggaactctgcttcctcagtgattgaactgacctttgtgggggtgcctttgtggggtgagaatgggcatacttgggcctcagttgtgatggccatggggtggagctgaggtctaggcccagggctgggaaagcttctaccaaccccgaggcatttgggtgttttagggcagaagaggagccaggaggatgggtatgccccactggagctgtgtgtggggcagcaggtgagggtgggattccagagggagggtcaacccagccaagcagaggaaggggaggagagggtttgttttggaaagaacatcaccctctcagtttcctggggtctggatagcctgttcttgtgatgagctggaggatgtgggccctgcttggatcctcctctcccctccctgcccccattttctcttcctgtgatttatgctgttctgggctcaccctcttcccagagctgtcacgctacagctgacaggcagggcaggcgttttaattattattaatttttttttgagacagagtttgagacagtatcaagagtgggtatcctctcagcgtgtcttcaagtagcatcccagagccccgctcctgggtacccacaacatgaacaccgtccagaagcaagggcagcctctgcaggtggggcgggggttggaaaacatttatcaaacggttgagttgggtgcaggggatgcaacatgatcaaacagggtcttgcctccaggagcctcatgtagggacaacgcacagtgatgaccttcaactgcagtggggcagcaaggctgtgggaggggtgttttgggcagagcaggcgacgtgggtacctcttcaccaagacagcaggaagagcacggacatcattttcccgtctcacctccagactcccaggggactgtgccaatatcctcactccagccctggcccatggccactgctcaacccttgggccctgtcagttcagggctgtgcagaaggagagttgcctgtgctcaggctcaggggttccgtccagctaaggaggcctactaggggactggggaaaggcctcatgaaggaccaggcctgtgatggggagggaagatggcagaggggacagtgggaagcagagcagcaggggtctcctccacgcctctctgtacttctcccacccacccttgcctactcccctctgccctgggtatgtgcccttgtccacccaacacctctgcagtgccaagtccagccctgacttcttcctgagctgtggcccagcgttcccacaggcatttacctcacggatgcagcactgcccctcatcctcttctctgaaagtgtgtgggaaatgcttcttggtgccatctctctcccaccctgccttccctgcaccttctctatgaggtgtctgttgtctctgtacttgcctccagctggcctttcagaccccatccctcctgcctcctgcccatccctacccctgtcagcaccttacatactctgtgcccaacagcattggggattcccactgtgctgaaggaagtcctcatgtggtccagagagggagctggcccctgctcccatttccagcaccattttctggcacaggctccatgtccccaggctccagctgcttctggggtaccaaggtctgcatttcttcctcttcccccagcagacagaagaccttgctggacaggtgtccacttcaatagtaacttctgaggctgccagcctcctgaatggtccagaagaaccagacccttccccgcccccattaaaaaagacaaaatatggccaggcatgttggctcatgcctgacatcccagcactttgggaggccaaagcaggtgaatcacttgaggccaggagtacgagaccagcctgacaaacatggtgaaaccctgtgtctactaaaaatacaaaaattagccaggcgtggtgactcatgcttgtaaatgcttgtaatcccagctacttgggaggctgaagcaggaggatcacttgaactcgggaggcagaggttgcagtgagccgagatcacgccactgtgttccagcctgagcgacagagcgagactccgtctaaaaaaaaaaaatatatatatatatacacacatatatatatgcataatagtctctgtgtaacagtaagtggatgcagtaactggtgtgagggcaacttggagagtgtgcttggaggcacagagatgctcagggctgcctggactgcctccatgatggtggcctgctctgtattaggtgagtgttcaggaaaggtgagggcagggcagcccacagcttcacagtggcccagggaagcagggcaggcaggctatgaggcctagtaggcatctgggccagactttgacactgaggccatggaatgggtggggctctgagaacagaccaaagtgatcatgggctgaaggctatgtccacagatccaaggcgggataggctgtgctgggcagtgatgtcagccaggctccccagcgggactgggggtgtcaggggcagctctgtcccaggtggcagacactggtttcccctcctgctctcacaaccggcctgttaccaggtgttgtctgagctgtggtgaggcttccctggtgacattcaggagcagggagcctgtgagtaagggtgtatgcatctgccctgactgcctggccctgtggtcaaggatgggggaaggcagctctgcctgcagctccaccccatttataaagcactgtggtgccttctgctggggcatgtgctgagtggtgcctcgcaggcactgccctcgggaagttcacaggcttatgtggaagctggtgggaatgggccaagaagagaggtgtcaggagccaggtattgggcaggtcccaggtctctgagcctcagtttcttcatctgtaggagggtggtgaccctgccctgctcagcttaccaggtacagatgtaagttttcagtgcagaggaaaagcagagaacttcccctcagatggccatacccccttgtcgctgtacccaactctccggtcctactttgtagctctcaggtgtcacatgtggatcctgccctaccatcccccttccctgtctagaaacgaggcctgctgagcttggagccatcccactccctgctctcaagccgtctgctcctgggttagcctgtggctggcctggcctgattctacatagatgtgggtgtttctccactgctggggcagcagttgtccattctggggcctgggtcagctctcagctgtggccgttgtgcctgtgcttccccaggtcctggtggtgactccaaccctgccctcacatatcccaagagcaggctgactgccttccccattcccacctttccagtaactgctgcaagaacggacagacactgctgcagagaacttgccacggtgtttcatgctgtggctggtggttccaggctgcacgctccattctaggaaagggtgaggcttcctgatcatcagtcttaacaggggactgtcctatgggtacctgtatacgctgccgggagtggggcagagtggggttagagtagtgcctgctgcccattggtttgtgcggtcctttaaggctgtaagtctgtgtgcgtgtctggttttttcctcctcctatcagtaatcagtcttgtataaccaggctggccctgcttcctgcctaggggctatcggtgtaccatctggagttgcaaatggggtgatagggcgtcagcggccttcccacacccaagcacttcctgacacccagcccctcatctctagccaacctctggctcccctagggatcctggggctcaggcctcacgctccagcatccgggggctttgcccttctggtgttgctcttctttgcaggtgccttggaacaggggtgcaacagagttcagaaagtgccatctgttgcatggataccctgctgccaccctcgtccacctttctggggcagaacagttggatgggtctttatttaagaggacaaaagggagagagaatgcatagaggctgggtctggtgctcacgcctgtaatcccaacactttgggaggccaaggcaggtggatcccttgaggtcaggaggtcaagactagcctggccaacatggtgaaaccccgtctctactaaaaatacaaaaaaaaaaaaattagctgggcatggcgggagatgcctgtaatcccagctactcgggaggctgaggcaggataatcacttgaacccaggaggcggaggttgcagtgagccaagatcacaccactgcactctagcctgggtgacagagggagactgtctcaaaaaaaaaaatttgcttagaatttgtctgtgtgaccctgggcaagtcatttcccctccttgggactcagttccttgcctgtgaacggggacagtgcttctcccttacagagctgttgtgagaattaaagtagaaaatgtacctatggtggttgttggtagtgaccagttcccccaaccctgactcccctgcaggatggggcctgggcccgggaatgggggatgggctggcagaggatgactgtcccagagaggagtcttctcggcagatgtggagacctagctgagtcagaggccaggatctaagtttgagggtgttccttacaccctgcagccatgagtctttggctgagtcaaatggcctttctgagctcagttccttatcagtaaagcctggacagtggtccaggacgctggacactgtgtgagtgttaggacacaggacactgtgtgagtgcaggtggggacccatggagcactctgctggggagcaattcatggggagcacccctccagagagggatgatttgcacagggccctcagcccagtcccttgcaggctggaccttggagagtgaggccctgaggcgagacatgggcacctggctcctggcctgcatctgcatctgcacctgtgtctgcttgggagtctctgtcacaggggaaggacaaggtgagggctgggcactaatgtctgtatgaggtgggtggagaactagggcatgtttgggggactgggttgtccgatgtcaagcctctagggaaaggtttggcccaaactgtgctggggcatgtcctctaggggtcagcctggacctcagtctctagtctccctacttttacctccctaccttcattccctggaccgactgtagtctcccttccttcactctcttgacgcctctccagatctgacttgcccgtgtaccacaggtcagagcccatcacttcccaggcctcccagtgcttccctggacagattctgggatcatttactggtgactgccctgctagggtgtcagctgtcagatcctccccaacccccgagctcagctctggcctgaagtacttaccgtgggctcctgatggtcactgtctccagggccaaggtctagaaccttcacctgcctcaccaacaacattctcaggatcgattgccactggtctgccccagagctgggacagggctccagcccctggctcctcttcaccaggtgagcatggagggccatgcccacctggacagggatgagggtgagttccccaggattgaagcagctatgccaggacagtgtagcagccccgtggtgctgacaaatgccctttccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacggtgagcagcagctataggtctggggcggggccgcttggcaagaacatcctggctgcttgggggtttggagcagggccttgcagcctgtgagtggcccagtgagtgttctcagtcccagccgagtgagatccagggctgggggcaggcttggcccttgggaggggagggcccatatggttactgcaggggcagggttttggcaggaaataaacatgcacggctgctagttggggcaggggctggcacttgagtcatgtgaaatgcacttcagtcataccaggaaggactccaataagatgctgggaaaagcttccagcagcagactgtgaaggaaagggaaagcaagatttagaaaccacctagtctaggtgcagaggccagaggaagtcattgctgtcctgtcccgcctggggcttttgtggaccagtctcccagtgaggtgcctggtctgagagggccttgaccattccccttgggagtctttcagaccccagtcttgtgtgttctgactgacacacccagacccatggggcttcagcctcacatggattcactctgttccagttaagctggacccgccctctgacttgcagagcaacatcagttctggccactgcatcctgacctggagcatcagtcctgccttggagccaatgaccacacttctcagctatgagctggccttcaagaagcaggaagaggcctgggaggtaacactttggctggctttccctgggggcctctctcctgggaacagcagtccagggtagactccccactctacatagggagatgtcaacttgtagtgatgagaagggaggaactagagcggggtgtgtgtgcacacacacatgctggcatgcagatgtgtatgctttatgtgtgtgtatgggagtagggtgagtgcgcctgtgtctctgtgtgtgcacataagtgtggtgagtgtgcatgtatgtgtttatgtgtacacatatgtaactgtgcacactcatgtttgtgtgcccatgtttgtgtgtttatatgtaagtgtacatatgtgtgtgcctgtgccttgcatttgtgtgagtgtgcacatgggcatgcctatgtgtatgagtgtgtatgtgagtgtggtgagttgcttctgtgcacacacttttgtttatgagtgtgcatgcaagtgtgatgagtgtgaaagtgttcctgtagacatgtttgcctgtgtgtgcatatgtgtatttgtgggcaaacgcagctgtgtctgtgagtgtgagtgtgccttctgtgtgtgtgtgtgcacgtgaatgtggtgagtgtgtctgtgtgttaacacaagtgtgttcaagagtgtgttatatgagcatataatgcatgtgtgtattctcgagggctgagggacccagccccaccttcaccacctgctaactgtccccacccccacagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggtgggcactgctgtggctgctgcacttccagcggagtctgggctgggcgtcttctcccctgttcacctcagccctgcaccctttcaccctcctgtaagcccctccccgaggcagccatgcctcagttgacccccttcctctgaaggtctgaggtctgtagggaggacagaaacacctgccaactctggggcttcctgggaacctgtagttagtggctgctgttaggagtgagggtggcagggctgcacaccagggctgggctcctgcctggaggctggacatgacctcagtgtccttaatgggggctggactgacccttgcgcactgcagtgctgagatggcccagggactttatgacccaccttgtggcagatgggaagagtgaggcccaggagtgtggttcacacaaggtccttcagcaggtgacacaaacctccaaggcccatcacaaggtccttcagcaggtgacacaaacctccaaggcccatcacaaaccttccactttggcccagggcactaaagggcgcacctttgccaggtgggtttggggggagcctcctggcactgaggctgctcacagccctgggcccttcctgtccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggtgggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcaccacatgtcaggttacaagacagggtgcaggggccatgtcaggccgcagatgtgaggaagagggtgtggggagaggggtgttgggtggggctaagtgggagggtgcttcgcttctccttggagcaaaggaaagtgtaaaactgtgtgacacaacctagtttatgttttgaggaatagattgctgggacaaggggacatgggggacctgctggaggccaatgggggccagtgaggtgcccacagggagacgatttggcatgagccagtgaaagaagtggagatagagaaaagtggagagaattgcagggtctcatgaggggaaatagaagggacatgtgggtggatgagatatgagtggtgacccctgaggtggggaaatgggggacagccttgcagggaggttggtgaagtctatttggacctgttgggttggagccccaggtgacatccttgtgggagggtcagtggatccttggcagcaagtctggtgctcagggagacactgggtggggtgggagccacagaccttctgctgatggcaaagacagggttcctggagtgctggctccctctgtgatctgaggacccagctagtaactccccgttctgaacccgccatcgcagctcacgctgtaaaggacgcgcgcctcagtataaatcagttctatgcggccgttaggcaaggaggcccagttgggtcctgccctgagagtgggttggaatgtgatgagatgggagagaggcagtggcagggacgaggtgggcggacctcctgctgatggaaggaagctcagcctctgcagtgacctcaggccacctgggtcgccataggcctctgactggcctctcttggcctcagggtgaagagaatcttctaccagaacgtgccctctccagcgatgttcttccagcccctctacagtgtacacaatgggaacttccaggtgtgtgcagagaccacagaaggacatggggggcaggggttgcccagagctctggcctgcccaagatgttggctttcactgagggttggcggccagtatgggaggcttgtcagtgcttggagccttttttgtatattcagtgaatttcaatttatacgcgtatctcaaatggggaaaaattagctttattttccattgctgatttctttttgttctcaggtctctagttccattgttgattgaaaaaatgtaaatttctcataacttatctctgtcccctctggtttgcagctttctgcacccaccatgtgcctcacctcctccttctgcgaaggtgtctgtcctgtggccatggggaagggtctgtggtgtgtgtgctgcccttggggctctcactgcctctgggctcctgctctgcctggtcccctggtctccccggatcacatgatggcaccacagctgaggagtgggctctgcacttcccccccttccacccatgttgggctcctacagcccaggcaccagtgagcaacttgggggttgcatcagcccctcccctccctgctgggctgttggttcatgccccctgggtgggaggagggggagagggagagctccagtgagtggtctctggtttttcccctcagactcctcactttgggcaaaggacaagaggcagtgagggcccctccctggggtctgggccaagctgaccactcttctccagaatcttccctccctgtccccttcacactgtggctccagcttactatgcagaaaaatccttttctctctcaatgaggagcgtagttttcaagatttttgtccaaaaatataatttgaaccatgaaccgggcatctggctcttggcagagtctccctctttccccaaggtggtagatgtgactgtcaggagcctgggcagctgacgacaaggctgagcaggtcagattgtgactgtcccctggactgtcatcctgttgcgggcaccagctgttccctagagaactaggacacctgccacgggttatttagacctgcgggtgaggatctggtgccataggttggtctccagggagcactgcagtgatggagggtgttgtgtgtgtgatgcatgggatggaggctcctggtcccaccaagggaacagcttccttttggaggcgggggcctcctgtggccccacagaaggatccaggtctgctggccatagccgagtgctttgaaagtcaccagtcctgacagcgattcgtgtgtgtgtctgtgtgtgtgtgtgtgtgtgtttatgtgtctgtgtgtgttcgtgtgtgtgtctgtgtgtgtgtttgtgtgtgtatgtctgtgtgtgtgtgtttatgtgtgtgtgtctgtgtgtgtttaagtctgtgtgtgtttgtgtgtgtgtgtctctgtgtgtgtgtctgtatctgtgtgtgtttgtgtctgtgtgtgtttgtgtgtgtgtctgtgtgtgtttgtgtgtgtgtgtctgtgtgtgtgtttatgtgtctgtgtatgtttgtgtgtgtgtttgtgtgtgtgtgtttgtgtttatgtgtgtatgtctgtgtgtgtctgtgtgtctgtgtgtgtatgtgtctgtgtgtgtttatgtgtctgtgtgtgttcgtgtggtgtgtgtgtctgtgtgtgtgtgtttgtgtgtgtatgtctgtgtgtgtgtgtgtttatgtgtgtgtgtctgtgtgtgtttatgtctgtgtgtgtttgtgtgtgtgtgtctcgtgtgtgtgtgtctgtgtgtatctgtgtgtgtttgtgtgtgtgtgtgtctctgtgtgtgtgtgtgtttgtgtatgtttgtgtgtgtgtgtgtgtgtgttgggaatgcccagtctctgcagctgctgaaaggccctgaggcacatgctgtcaggagctggctctgtcctgggcagatatcaccatctgtacctcggttcaggctgccgtgggcaccaggccctgtgctgggggagtgctgaggagcctgaagggactcagggtcccgtgatgaggctgggctggcacatggaggaaagacagaatgtccaagacacaggcgctgcttggcctctgggtgtggacctcaggagggcttcctggaggaggagggatgctgggcttgccagaaaggaggcagctgctcccaggatgagttctgaacatgctacctgagcccttccctcctcccgtgctctgttccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcaccatgaccacctggtgtgacctctctgtgccttactgaggcacctttctagagattaaaaggggcttgatggctgtt

SEQ ID NO: 5412 - DNA, 13027 bp, human
gcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaaggtgagtctgtgctttgggcttcccaacctctcaagtcagcatgaaattcagaaggcagagagggacatgtggccctccaactcggggcccagggagccactgtggcatttgagagcgccaccctagctttacctcctctggtgtcctggccttgtgtatctcttagagatggcaaaatttgcagccctgacctcaaggattacaaactaatttccagtcctgtaggggtcatgggttctgctgtggccagtgtggcactgagtttgtcaggcagaatttctaattatggaaggaactctgcttcctcagtgattgaactgacctttgtgggggtgcctttgtggggtgagaatgggcatacttgggcctcagttgtgatggccatggggtggagctgaggtctaggcccagggctgggaaagcttctaccaaccccgaggcatttgggtgttttagggcagaagaggagccaggaggatgggtatgccccactggagctgtgtgtggggcagcaggtgagggtgggattccagagggagggtcaacccagccaagcagaggaaggggaggagagggtttgttttggaaagaacatcaccctctcagtttcctggggtctggatagcctgttcttgtgatgagctggaggatgtgggccctgcttggatcctcctctcccctccctgcccccattttctcttcctgtgatttatgctgttctgggctcaccctcttcccagagctgtcacgctacagctgacaggcagggcaggcgttttaattattattaatttttttttgagacagagtttgagacagtatcaagagtgggtatcctctcagcgtgtcttcaagtagcatcccagagccccgctcctgggtacccacaacatgaacaccgtccagaagcaagggcagcctctgcaggtggggcgggggttggaaaacatttatcaaacggttgagttgggtgcaggggatgcaacatgatcaaacagggtcttgcctccaggagcctcatgtagggacaacgcacagtgatgaccttcaactgcagtggggcagcaaggctgtgggaggggtgttttgggcagagcaggcgacgtgggtacctcttcaccaagacagcaggaagagcacggacatcattttcccgtctcacctccagactcccaggggactgtgccaatatcctcactccagccctggcccatggccactgctcaacccttgggccctgtcagttcagggctgtgcagaaggagagttgcctgtgctcaggctcaggggttccgtccagctaaggaggcctactaggggactggggaaaggcctcatgaaggaccaggcctgtgatggggagggaagatggcagaggggacagtgggaagcagagcagcaggggtctcctccacgcctctctgtacttctcccacccacccttgcctactcccctctgccctgggtatgtgcccttgtccacccaacacctctgcagtgccaagtccagccctgacttcttcctgagctgtggcccagcgttcccacaggcatttacctcacggatgcagcactgcccctcatcctcttctctgaaagtgtgtgggaaatgcttcttggtgccatctctctcccaccctgccttccctgcaccttctctatgaggtgtctgttgtctctgtacttgcctccagctggcctttcagaccccatccctcctgcctcctgcccatccctacccctgtcagcaccttacatactctgtgcccaacagcattggggattcccactgtgctgaaggaagtcctcatgtggtccagagagggagctggcccctgctcccatttccagcaccattttctggcacaggctccatgtccccaggctccagctgcttctggggtaccaaggtctgcatttcttcctcttcccccagcagacagaagaccttgctggacaggtgtccacttcaatagtaacttctgaggctgccagcctcctgaatggtccagaagaaccagacccttccccgcccccattaaaaaagacaaaatatggccaggcatgttggctcatgcctgacatcccagcactttgggaggccaaagcaggtgaatcacttgaggccaggagtacgagaccagcctgacaaacatggtgaaaccctgtgtctactaaaaatacaaaaattagccaggcgtggtgactcatgcttgtaaatgcttgtaatcccagctacttgggaggctgaagcaggaggatcacttgaactcgggaggcagaggttgcagtgagccgagatcacgccactgtgttccagcctgagcgacagagcgagactccgtctaaaaaaaaaaaatatatatatatatacacacatatatatatgcataatagtctctgtgtaacagtaagtggatgcagtaactggtgtgagggcaacttggagagtgtgcttggaggcacagagatgctcagggctgcctggactgcctccatgatggtggcctgctctgtattaggtgagtgttcaggaaaggtgagggcagggcagcccacagcttcacagtggcccagggaagcagggcaggcaggctatgaggcctagtaggcatctgggccagactttgacactgaggccatggaatgggtggggctctgagaacagaccaaagtgatcatgggctgaaggctatgtccacagatccaaggcgggataggctgtgctgggcagtgatgtcagccaggctccccagcgggactgggggtgtcaggggcagctctgtcccaggtggcagacactggtttcccctcctgctctcacaaccggcctgttaccaggtgttgtctgagctgtggtgaggcttccctggtgacattcaggagcagggagcctgtgagtaagggtgtatgcatctgccctgactgcctggccctgtggtcaaggatgggggaaggcagctctgcctgcagctccaccccatttataaagcactgtggtgccttctgctggggcatgtgctgagtggtgcctcgcaggcactgccctcgggaagttcacaggcttatgtggaagctggtgggaatgggccaagaagagaggtgtcaggagccaggtattgggcaggtcccaggtctctgagcctcagtttcttcatctgtaggagggtggtgaccctgccctgctcagcttaccaggtacagatgtaagttttcagtgcagaggaaaagcagagaacttcccctcagatggccatacccccttgtcgctgtacccaactctccggtcctactttgtagctctcaggtgtcacatgtggatcctgccctaccatcccccttccctgtctagaaacgaggcctgctgagcttggagccatcccactccctgctctcaagccgtctgctcctgggttagcctgtggctggcctggcctgattctacatagatgtgggtgtttctccactgctggggcagcagttgtccattctggggcctgggtcagctctcagctgtggccgttgtgcctgtgcttccccaggtcctggtggtgactccaaccctgccctcacatatcccaagagcaggctgactgccttccccattcccacctttccagtaactgctgcaagaacggacagacactgctgcagagaacttgccacggtgtttcatgctgtggctggtggttccaggctgcacgctccattctaggaaagggtgaggcttcctgatcatcagtcttaacaggggactgtcctatgggtacctgtatacgctgccgggagtggggcagagtggggttagagtagtgcctgctgcccattggtttgtgcggtcctttaaggctgtaagtctgtgtgcgtgtctggttttttcctcctcctatcagtaatcagtcttgtataaccaggctggccctgcttcctgcctaggggctatcggtgtaccatctggagttgcaaatggggtgatagggcgtcagcggccttcccacacccaagcacttcctgacacccagcccctcatctctagccaacctctggctcccctagggatcctggggctcaggcctcacgctccagcatccgggggctttgcccttctggtgttgctcttctttgcaggtgccttggaacaggggtgcaacagagttcagaaagtgccatctgttgcatggataccctgctgccaccctcgtccacctttctggggcagaacagttggatgggtctttatttaagaggacaaaagggagagagaatgcatagaggctgggtctggtgctcacgcctgtaatcccaacactttgggaggccaaggcaggtggatcccttgaggtcaggaggtcaagactagcctggccaacatggtgaaaccccgtctctactaaaaatacaaaaaaaaaaaaattagctgggcatggcgggagatgcctgtaatcccagctactcgggaggctgaggcaggataatcacttgaacccaggaggcggaggttgcagtgagccaagatcacaccactgcactctagcctgggtgacagagggagactgtctcaaaaaaaaaaatttgcttagaatttgtctgtgtgaccctgggcaagtcatttcccctccttgggactcagttccttgcctgtgaacggggacagtgcttctcccttacagagctgttgtgagaattaaagtagaaaatgtacctatggtggttgttggtagtgaccagttcccccaaccctgactcccctgcaggatggggcctgggcccgggaatgggggatgggctggcagaggatgactgtcccagagaggagtcttctcggcagatgtggagacctagctgagtcagaggccaggatctaagtttgagggtgttccttacaccctgcagccatgagtctttggctgagtcaaatggcctttctgagctcagttccttatcagtaaagcctggacagtggtccaggacgctggacactgtgtgagtgttaggacacaggacactgtgtgagtgcaggtggggacccatggagcactctgctggggagcaattcatggggagcacccctccagagagggatgatttgcacagggccctcagcccagtcccttgcaggctggaccttggagagtgaggccctgaggcgagacatgggcacctggctcctggcctgcatctgcatctgcacctgtgtctgcttgggagtctctgtcacaggggaaggacaaggtgagggctgggcactaatgtctgtatgaggtgggtggagaactagggcatgtttgggggactgggttgtccgatgtcaagcctctagggaaaggtttggcccaaactgtgctggggcatgtcctctaggggtcagcctggacctcagtctctagtctccctacttttacctccctaccttcattccctggaccgactgtagtctcccttccttcactctcttgacgcctctccagatctgacttgcccgtgtaccacaggtcagagcccatcacttcccaggcctcccagtgcttccctggacagattctgggatcatttactggtgactgccctgctagggtgtcagctgtcagatcctccccaacccccgagctcagctctggcctgaagtacttaccgtgggctcctgatggtcactgtctccagggccaaggtctagaaccttcacctgcctcaccaacaacattctcaggatcgattgccactggtctgccccagagctgggacagggctccagcccctggctcctcttcaccaggtgagcatggagggccatgcccacctggacagggatgagggtgagttccccaggattgaagcagctatgccaggacagtgtagcagccccgtggtgctgacaaatgccctttccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacggtgagcagcagctataggtctggggcggggccgcttggcaagaacatcctggctgcttgggggtttggagcagggccttgcagcctgtgagtggcccagtgagtgttctcagtcccagccgagtgagatccagggctgggggcaggcttggcccttgggaggggagggcccatatggttactgcaggggcagggttttggcaggaaataaacatgcacggctgctagttggggcaggggctggcacttgagtcatgtgaaatgcacttcagtcataccaggaaggactccaataagatgctgggaaaagcttccagcagcagactgtgaaggaaagggaaagcaagatttagaaaccacctagtctaggtgcagaggccagaggaagtcattgctgtcctgtcccgcctggggcttttgtggaccagtctcccagtgaggtgcctggtctgagagggccttgaccattccccttgggagtctttcagaccccagtcttgtgtgttctgactgacacacccagacccatggggcttcagcctcacatggattcactctgttccagttaagctggacccgccctctgacttgcagagcaacatcagttctggccactgcatcctgacctggagcatcagtcctgccttggagccaatgaccacacttctcagctatgagctggccttcaagaagcaggaagaggcctgggaggtaacactttggctggctttccctgggggcctctctcctgggaacagcagtccagggtagactccccactctacatagggagatgtcaacttgtagtgatgagaagggaggaactagagcggggtgtgtgtgcacacacacatgctggcatgcagatgtgtatgctttatgtgtgtgtatgggagtagggtgagtgcgcctgtgtctctgtgtgtgcacataagtgtggtgagtgtgcatgtatgtgtttatgtgtacacatatgtaactgtgcacactcatgtttgtgtgcccatgtttgtgtgtttatatgtaagtgtacatatgtgtgtgcctgtgccttgcatttgtgtgagtgtgcacatgggcatgcctatgtgtatgagtgtgtatgtgagtgtggtgagttgcttctgtgcacacacttttgtttatgagtgtgcatgcaagtgtgatgagtgtgaaagtgttcctgtagacatgtttgcctgtgtgtgcatatgtgtatttgtgggcaaacgcagctgtgtctgtgagtgtgagtgtgccttctgtgtgtgtgtgtgcacgtgaatgtggtgagtgtgtctgtgtgttaacacaagtgtgttcaagagtgtgttatatgagcatataatgcatgtgtgtattctcgagggctgagggacccagccccaccttcaccacctgctaactgtccccacccccacagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggtgggcactgctgtggctgctgcacttccagcggagtctgggctgggcgtcttctcccctgttcacctcagccctgcaccctttcaccctcctgtaagcccctccccgaggcagccatgcctcagttgacccccttcctctgaaggtctgaggtctgtagggaggacagaaacacctgccaactctggggcttcctgggaacctgtagttagtggctgctgttaggagtgagggtggcagggctgcacaccagggctgggctcctgcctggaggctggacatgacctcagtgtccttaatgggggctggactgacccttgcgcactgcagtgctgagatggcccagggactttatgacccaccttgtggcagatgggaagagtgaggcccaggagtgtggttcacacaaggtccttcagcaggtgacacaaacctccaaggcccatcacaaggtccttcagcaggtgacacaaacctccaaggcccatcacaaaccttccactttggcccagggcactaaagggcgcacctttgccaggtgggtttggggggagcctcctggcactgaggctgctcacagccctgggcccttcctgtccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggtgggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcaccacatgtcaggttacaagacagggtgcaggggccatgtcaggccgcagatgtgaggaagagggtgtggggagaggggtgttgggtggggctaagtgggagggtgcttcgcttctccttggagcaaaggaaagtgtaaaactgtgtgacacaacctagtttatgttttgaggaatagattgctgggacaaggggacatgggggacctgctggaggccaatgggggccagtgaggtgcccacagggagacgatttggcatgagccagtgaaagaagtggagatagagaaaagtggagagaattgcagggtctcatgaggggaaatagaagggacatgtgggtggatgagatatgagtggtgacccctgaggtggggaaatgggggacagccttgcagggaggttggtgaagtctatttggacctgttgggttggagccccaggtgacatccttgtgggagggtcagtggatccttggcagcaagtctggtgctcagggagacactgggtggggtgggagccacagaccttctgctgatggcaaagacagggttcctggagtgctggctccctctgtgatctgaggacccagctagtaactccccgttctgaacccgccatcgcagctcacgctgtaaaggacgcgcgcctcagtataaatcagttctatgcggccgttaggcaaggaggcccagttgggtcctgccctgagagtgggttggaatgtgatgagatgggagagaggcagtggcagggacgaggtgggcggacctcctgctgatggaaggaagctcagcctctgcagtgacctcaggccacctgggtcgccataggcctctgactggcctctcttggcctcagggtgaagagaatcttctaccagaacgtgccctctccagcgatgttcttccagcccctctacagtgtacacaatgggaacttccaggtgtgtgcagagaccacagaaggacatggggggcaggggttgcccagagctctggcctgcccaagatgttggctttcactgagggttggcggccagtatgggaggcttgtcagtgcttggagccttttttgtatattcagtgaatttcaatttatacgcgtatctcaaatggggaaaaattagctttattttccattgctgatttctttttgttctcaggtctctagttccattgttgattgaaaaaatgtaaatttctcataacttatctctgtcccctctggtttgcagctttctgcacccaccatgtgcctcacctcctccttctgcgaaggtgtctgtcctgtggccatggggaagggtctgtggtgtgtgtgctgcccttggggctctcactgcctctgggctcctgctctgcctggtcccctggtctccccggatcacatgatggcaccacagctgaggagtgggctctgcacttcccccccttccacccatgttgggctcctacagcccaggcaccagtgagcaacttgggggttgcatcagcccctcccctccctgctgggctgttggttcatgccccctgggtgggaggagggggagagggagagctccagtgagtggtctctggtttttcccctcagactcctcactttgggcaaaggacaagaggcagtgagggcccctccctggggtctgggccaagctgaccactcttctccagaatcttccctccctgtccccttcacactgtggctccagcttactatgcagaaaaatccttttctctctcaatgaggagcgtagttttcaagatttttgtccaaaaatataatttgaaccatgaaccgggcatctggctcttggcagagtctccctctttccccaaggtggtagatgtgactgtcaggagcctgggcagctgacgacaaggctgagcaggtcagattgtgactgtcccctggactgtcatcctgttgcgggcaccagctgttccctagagaactaggacacctgccacgggttatttagacctgcgggtgaggatctggtgccataggttggtctccagggagcactgcagtgatggagggtgttgtgtgtgtgatgcatgggatggaggctcctggtcccaccaagggaacagcttccttttggaggcgggggcctcctgtggccccacagaaggatccaggtctgctggccatagccgagtgctttgaaagtcaccagtcctgacagcgattcgtgtgtgtgtctgtgtgtgtgtgtgtgtgtgtttatgtgtctgtgtgtgttcgtgtgtgtgtctgtgtgtgtgtttgtgtgtgtatgtctgtgtgtgtgtgtttatgtgtgtgtgtctgtgtgtgtttaagtctgtgtgtgtttgtgtgtgtgtgtctctgtgtgtgtgtctgtatctgtgtgtgtttgtgtctgtgtgtgtttgtgtgtgtgtctgtgtgtgtttgtgtgtgtgtgtctgtgtgtgtgtttatgtgtctgtgtatgtttgtgtgtgtgtttgtgtgtgtgtgtttgtgtttatgtgtgtatgtctgtgtgtgtctgtgtgtctgtgtgtgtatgtgtctgtgtgtgtttatgtgtctgtgtgtgttcgtgtggtgtgtgtgtctgtgtgtgtgtgtttgtgtgtgtatgtctgtgtgtgtgtgtgtttatgtgtgtgtgtctgtgtgtgtttatgtctgtgtgtgtttgtgtgtgtgtgtctcgtgtgtgtgtgtctgtgtgtatctgtgtgtgtttgtgtgtgtgtgtgtctctgtgtgtgtgtgtgtttgtgtatgtttgtgtgtgtgtgtgtgtgtgttgggaatgcccagtctctgcagctgctgaaaggccctgaggcacatgctgtcaggagctggctctgtcctgggcagatatcaccatctgtacctcggttcaggctgccgtgggcaccaggccctgtgctgggggagtgctgaggagcctgaagggactcagggtcccgtgatgaggctgggctggcacatggaggaaagacagaatgtccaagacacaggcgctgcttggcctctgggtgtggacctcaggagggcttcctggaggaggagggatgctgggcttgccagaaaggaggcagctgctcccaggatgagttctgaacatgctacctgagcccttccctcctcccgtgctctgttccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctgg

SEQ ID NO: 5413 - DNA, 13111 bp, human
agagatagttgggtgacaaatcacctccaggttggggatgcctcagacttgtgatgggactgggcagatgcatctgggaaggtgagtctgtgctttgggcttcccaacctctcaagtcagcatgaaattcagaaggcagagagggacatgtggccctccaactcggggcccagggagccactgtggcatttgagagcgccaccctagctttacctcctctggtgtcctggccttgtgtatctcttagagatggcaaaatttgcagccctgacctcaaggattacaaactaatttccagtcctgtaggggtcatgggttctgctgtggccagtgtggcactgagtttgtcaggcagaatttctaattatggaaggaactctgcttcctcagtgattgaactgacctttgtgggggtgcctttgtggggtgagaatgggcatacttgggcctcagttgtgatggccatggggtggagctgaggtctaggcccagggctgggaaagcttctaccaaccccgaggcatttgggtgttttagggcagaagaggagccaggaggatgggtatgccccactggagctgtgtgtggggcagcaggtgagggtgggattccagagggagggtcaacccagccaagcagaggaaggggaggagagggtttgttttggaaagaacatcaccctctcagtttcctggggtctggatagcctgttcttgtgatgagctggaggatgtgggccctgcttggatcctcctctcccctccctgcccccattttctcttcctgtgatttatgctgttctgggctcaccctcttcccagagctgtcacgctacagctgacaggcagggcaggcgttttaattattattaatttttttttgagacagagtttgagacagtatcaagagtgggtatcctctcagcgtgtcttcaagtagcatcccagagccccgctcctgggtacccacaacatgaacaccgtccagaagcaagggcagcctctgcaggtggggcgggggttggaaaacatttatcaaacggttgagttgggtgcaggggatgcaacatgatcaaacagggtcttgcctccaggagcctcatgtagggacaacgcacagtgatgaccttcaactgcagtggggcagcaaggctgtgggaggggtgttttgggcagagcaggcgacgtgggtacctcttcaccaagacagcaggaagagcacggacatcattttcccgtctcacctccagactcccaggggactgtgccaatatcctcactccagccctggcccatggccactgctcaacccttgggccctgtcagttcagggctgtgcagaaggagagttgcctgtgctcaggctcaggggttccgtccagctaaggaggcctactaggggactggggaaaggcctcatgaaggaccaggcctgtgatggggagggaagatggcagaggggacagtgggaagcagagcagcaggggtctcctccacgcctctctgtacttctcccacccacccttgcctactcccctctgccctgggtatgtgcccttgtccacccaacacctctgcagtgccaagtccagccctgacttcttcctgagctgtggcccagcgttcccacaggcatttacctcacggatgcagcactgcccctcatcctcttctctgaaagtgtgtgggaaatgcttcttggtgccatctctctcccaccctgccttccctgcaccttctctatgaggtgtctgttgtctctgtacttgcctccagctggcctttcagaccccatccctcctgcctcctgcccatccctacccctgtcagcaccttacatactctgtgcccaacagcattggggattcccactgtgctgaaggaagtcctcatgtggtccagagagggagctggcccctgctcccatttccagcaccattttctggcacaggctccatgtccccaggctccagctgcttctggggtaccaaggtctgcatttcttcctcttcccccagcagacagaagaccttgctggacaggtgtccacttcaatagtaacttctgaggctgccagcctcctgaatggtccagaagaaccagacccttccccgcccccattaaaaaagacaaaatatggccaggcatgttggctcatgcctgacatcccagcactttgggaggccaaagcaggtgaatcacttgaggccaggagtacgagaccagcctgacaaacatggtgaaaccctgtgtctactaaaaatacaaaaattagccaggcgtggtgactcatgcttgtaaatgcttgtaatcccagctacttgggaggctgaagcaggaggatcacttgaactcgggaggcagaggttgcagtgagccgagatcacgccactgtgttccagcctgagcgacagagcgagactccgtctaaaaaaaaaaaatatatatatatatacacacatatatatatgcataatagtctctgtgtaacagtaagtggatgcagtaactggtgtgagggcaacttggagagtgtgcttggaggcacagagatgctcagggctgcctggactgcctccatgatggtggcctgctctgtattaggtgagtgttcaggaaaggtgagggcagggcagcccacagcttcacagtggcccagggaagcagggcaggcaggctatgaggcctagtaggcatctgggccagactttgacactgaggccatggaatgggtggggctctgagaacagaccaaagtgatcatgggctgaaggctatgtccacagatccaaggcgggataggctgtgctgggcagtgatgtcagccaggctccccagcgggactgggggtgtcaggggcagctctgtcccaggtggcagacactggtttcccctcctgctctcacaaccggcctgttaccaggtgttgtctgagctgtggtgaggcttccctggtgacattcaggagcagggagcctgtgagtaagggtgtatgcatctgccctgactgcctggccctgtggtcaaggatgggggaaggcagctctgcctgcagctccaccccatttataaagcactgtggtgccttctgctggggcatgtgctgagtggtgcctcgcaggcactgccctcgggaagttcacaggcttatgtggaagctggtgggaatgggccaagaagagaggtgtcaggagccaggtattgggcaggtcccaggtctctgagcctcagtttcttcatctgtaggagggtggtgaccctgccctgctcagcttaccaggtacagatgtaagttttcagtgcagaggaaaagcagagaacttcccctcagatggccatacccccttgtcgctgtacccaactctccggtcctactttgtagctctcaggtgtcacatgtggatcctgccctaccatcccccttccctgtctagaaacgaggcctgctgagcttggagccatcccactccctgctctcaagccgtctgctcctgggttagcctgtggctggcctggcctgattctacatagatgtgggtgtttctccactgctggggcagcagttgtccattctggggcctgggtcagctctcagctgtggccgttgtgcctgtgcttccccaggtcctggtggtgactccaaccctgccctcacatatcccaagagcaggctgactgccttccccattcccacctttccagtaactgctgcaagaacggacagacactgctgcagagaacttgccacggtgtttcatgctgtggctggtggttccaggctgcacgctccattctaggaaagggtgaggcttcctgatcatcagtcttaacaggggactgtcctatgggtacctgtatacgctgccgggagtggggcagagtggggttagagtagtgcctgctgcccattggtttgtgcggtcctttaaggctgtaagtctgtgtgcgtgtctggttttttcctcctcctatcagtaatcagtcttgtataaccaggctggccctgcttcctgcctaggggctatcggtgtaccatctggagttgcaaatggggtgatagggcgtcagcggccttcccacacccaagcacttcctgacacccagcccctcatctctagccaacctctggctcccctagggatcctggggctcaggcctcacgctccagcatccgggggctttgcccttctggtgttgctcttctttgcaggtgccttggaacaggggtgcaacagagttcagaaagtgccatctgttgcatggataccctgctgccaccctcgtccacctttctggggcagaacagttggatgggtctttatttaagaggacaaaagggagagagaatgcatagaggctgggtctggtgctcacgcctgtaatcccaacactttgggaggccaaggcaggtggatcccttgaggtcaggaggtcaagactagcctggccaacatggtgaaaccccgtctctactaaaaatacaaaaaaaaaaaaattagctgggcatggcgggagatgcctgtaatcccagctactcgggaggctgaggcaggataatcacttgaacccaggaggcggaggttgcagtgagccaagatcacaccactgcactctagcctgggtgacagagggagactgtctcaaaaaaaaaaatttgcttagaatttgtctgtgtgaccctgggcaagtcatttcccctccttgggactcagttccttgcctgtgaacggggacagtgcttctcccttacagagctgttgtgagaattaaagtagaaaatgtacctatggtggttgttggtagtgaccagttcccccaaccctgactcccctgcaggatggggcctgggcccgggaatgggggatgggctggcagaggatgactgtcccagagaggagtcttctcggcagatgtggagacctagctgagtcagaggccaggatctaagtttgagggtgttccttacaccctgcagccatgagtctttggctgagtcaaatggcctttctgagctcagttccttatcagtaaagcctggacagtggtccaggacgctggacactgtgtgagtgttaggacacaggacactgtgtgagtgcaggtggggacccatggagcactctgctggggagcaattcatggggagcacccctccagagagggatgatttgcacagggccctcagcccagtcccttgcaggctggaccttggagagtgaggccctgaggcgagacatgggcacctggctcctggcctgcatctgcatctgcacctgtgtctgcttgggagtctctgtcacaggggaaggacaaggtgagggctgggcactaatgtctgtatgaggtgggtggagaactagggcatgtttgggggactgggttgtccgatgtcaagcctctagggaaaggtttggcccaaactgtgctggggcatgtcctctaggggtcagcctggacctcagtctctagtctccctacttttacctccctaccttcattccctggaccgactgtagtctcccttccttcactctcttgacgcctctccagatctgacttgcccgtgtaccacaggtcagagcccatcacttcccaggcctcccagtgcttccctggacagattctgggatcatttactggtgactgccctgctagggtgtcagctgtcagatcctccccaacccccgagctcagctctggcctgaagtacttaccgtgggctcctgatggtcactgtctccagggccaaggtctagaaccttcacctgcctcaccaacaacattctcaggatcgattgccactggtctgccccagagctgggacagggctccagcccctggctcctcttcaccaggtgagcatggagggccatgcccacctggacagggatgagggtgagttccccaggattgaagcagctatgccaggacagtgtagcagccccgtggtgctgacaaatgccctttccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacggtgagcagcagctataggtctggggcggggccgcttggcaagaacatcctggctgcttgggggtttggagcagggccttgcagcctgtgagtggcccagtgagtgttctcagtcccagccgagtgagatccagggctgggggcaggcttggcccttgggaggggagggcccatatggttactgcaggggcagggttttggcaggaaataaacatgcacggctgctagttggggcaggggctggcacttgagtcatgtgaaatgcacttcagtcataccaggaaggactccaataagatgctgggaaaagcttccagcagcagactgtgaaggaaagggaaagcaagatttagaaaccacctagtctaggtgcagaggccagaggaagtcattgctgtcctgtcccgcctggggcttttgtggaccagtctcccagtgaggtgcctggtctgagagggccttgaccattccccttgggagtctttcagaccccagtcttgtgtgttctgactgacacacccagacccatggggcttcagcctcacatggattcactctgttccagttaagctggacccgccctctgacttgcagagcaacatcagttctggccactgcatcctgacctggagcatcagtcctgccttggagccaatgaccacacttctcagctatgagctggccttcaagaagcaggaagaggcctgggaggtaacactttggctggctttccctgggggcctctctcctgggaacagcagtccagggtagactccccactctacatagggagatgtcaacttgtagtgatgagaagggaggaactagagcggggtgtgtgtgcacacacacatgctggcatgcagatgtgtatgctttatgtgtgtgtatgggagtagggtgagtgcgcctgtgtctctgtgtgtgcacataagtgtggtgagtgtgcatgtatgtgtttatgtgtacacatatgtaactgtgcacactcatgtttgtgtgcccatgtttgtgtgtttatatgtaagtgtacatatgtgtgtgcctgtgccttgcatttgtgtgagtgtgcacatgggcatgcctatgtgtatgagtgtgtatgtgagtgtggtgagttgcttctgtgcacacacttttgtttatgagtgtgcatgcaagtgtgatgagtgtgaaagtgttcctgtagacatgtttgcctgtgtgtgcatatgtgtatttgtgggcaaacgcagctgtgtctgtgagtgtgagtgtgccttctgtgtgtgtgtgtgcacgtgaatgtggtgagtgtgtctgtgtgttaacacaagtgtgttcaagagtgtgttatatgagcatataatgcatgtgtgtattctcgagggctgagggacccagccccaccttcaccacctgctaactgtccccacccccacagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggtgggcactgctgtggctgctgcacttccagcggagtctgggctgggcgtcttctcccctgttcacctcagccctgcaccctttcaccctcctgtaagcccctccccgaggcagccatgcctcagttgacccccttcctctgaaggtctgaggtctgtagggaggacagaaacacctgccaactctggggcttcctgggaacctgtagttagtggctgctgttaggagtgagggtggcagggctgcacaccagggctgggctcctgcctggaggctggacatgacctcagtgtccttaatgggggctggactgacccttgcgcactgcagtgctgagatggcccagggactttatgacccaccttgtggcagatgggaagagtgaggcccaggagtgtggttcacacaaggtccttcagcaggtgacacaaacctccaaggcccatcacaaggtccttcagcaggtgacacaaacctccaaggcccatcacaaaccttccactttggcccagggcactaaagggcgcacctttgccaggtgggtttggggggagcctcctggcactgaggctgctcacagccctgggcccttcctgtccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggtgggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcaccacatgtcaggttacaagacagggtgcaggggccatgtcaggccgcagatgtgaggaagagggtgtggggagaggggtgttgggtggggctaagtgggagggtgcttcgcttctccttggagcaaaggaaagtgtaaaactgtgtgacacaacctagtttatgttttgaggaatagattgctgggacaaggggacatgggggacctgctggaggccaatgggggccagtgaggtgcccacagggagacgatttggcatgagccagtgaaagaagtggagatagagaaaagtggagagaattgcagggtctcatgaggggaaatagaagggacatgtgggtggatgagatatgagtggtgacccctgaggtggggaaatgggggacagccttgcagggaggttggtgaagtctatttggacctgttgggttggagccccaggtgacatccttgtgggagggtcagtggatccttggcagcaagtctggtgctcagggagacactgggtggggtgggagccacagaccttctgctgatggcaaagacagggttcctggagtgctggctccctctgtgatctgaggacccagctagtaactccccgttctgaacccgccatcgcagctcacgctgtaaaggacgcgcgcctcagtataaatcagttctatgcggccgttaggcaaggaggcccagttgggtcctgccctgagagtgggttggaatgtgatgagatgggagagaggcagtggcagggacgaggtgggcggacctcctgctgatggaaggaagctcagcctctgcagtgacctcaggccacctgggtcgccataggcctctgactggcctctcttggcctcagggtgaagagaatcttctaccagaacgtgccctctccagcgatgttcttccagcccctctacagtgtacacaatgggaacttccaggtgtgtgcagagaccacagaaggacatggggggcaggggttgcccagagctctggcctgcccaagatgttggctttcactgagggttggcggccagtatgggaggcttgtcagtgcttggagccttttttgtatattcagtgaatttcaatttatacgcgtatctcaaatggggaaaaattagctttattttccattgctgatttctttttgttctcaggtctctagttccattgttgattgaaaaaatgtaaatttctcataacttatctctgtcccctctggtttgcagctttctgcacccaccatgtgcctcacctcctccttctgcgaaggtgtctgtcctgtggccatggggaagggtctgtggtgtgtgtgctgcccttggggctctcactgcctctgggctcctgctctgcctggtcccctggtctccccggatcacatgatggcaccacagctgaggagtgggctctgcacttcccccccttccacccatgttgggctcctacagcccaggcaccagtgagcaacttgggggttgcatcagcccctcccctccctgctgggctgttggttcatgccccctgggtgggaggagggggagagggagagctccagtgagtggtctctggtttttcccctcagactcctcactttgggcaaaggacaagaggcagtgagggcccctccctggggtctgggccaagctgaccactcttctccagaatcttccctccctgtccccttcacactgtggctccagcttactatgcagaaaaatccttttctctctcaatgaggagcgtagttttcaagatttttgtccaaaaatataatttgaaccatgaaccgggcatctggctcttggcagagtctccctctttccccaaggtggtagatgtgactgtcaggagcctgggcagctgacgacaaggctgagcaggtcagattgtgactgtcccctggactgtcatcctgttgcgggcaccagctgttccctagagaactaggacacctgccacgggttatttagacctgcgggtgaggatctggtgccataggttggtctccagggagcactgcagtgatggagggtgttgtgtgtgtgatgcatgggatggaggctcctggtcccaccaagggaacagcttccttttggaggcgggggcctcctgtggccccacagaaggatccaggtctgctggccatagccgagtgctttgaaagtcaccagtcctgacagcgattcgtgtgtgtgtctgtgtgtgtgtgtgtgtgtgtttatgtgtctgtgtgtgttcgtgtgtgtgtctgtgtgtgtgtttgtgtgtgtatgtctgtgtgtgtgtgtttatgtgtgtgtgtctgtgtgtgtttaagtctgtgtgtgtttgtgtgtgtgtgtctctgtgtgtgtgtctgtatctgtgtgtgtttgtgtctgtgtgtgtttgtgtgtgtgtctgtgtgtgtttgtgtgtgtgtgtctgtgtgtgtgtttatgtgtctgtgtatgtttgtgtgtgtgtttgtgtgtgtgtgtttgtgtttatgtgtgtatgtctgtgtgtgtctgtgtgtctgtgtgtgtatgtgtctgtgtgtgtttatgtgtctgtgtgtgttcgtgtggtgtgtgtgtctgtgtgtgtgtgtttgtgtgtgtatgtctgtgtgtgtgtgtgtttatgtgtgtgtgtctgtgtgtgtttatgtctgtgtgtgtttgtgtgtgtgtgtctcgtgtgtgtgtgtctgtgtgtatctgtgtgtgtttgtgtgtgtgtgtgtctctgtgtgtgtgtgtgtttgtgtatgtttgtgtgtgtgtgtgtgtgtgttgggaatgcccagtctctgcagctgctgaaaggccctgaggcacatgctgtcaggagctggctctgtcctgggcagatatcaccatctgtacctcggttcaggctgccgtgggcaccaggccctgtgctgggggagtgctgaggagcctgaagggactcagggtcccgtgatgaggctgggctggcacatggaggaaagacagaatgtccaagacacaggcgctgcttggcctctgggtgtggacctcaggagggcttcctggaggaggagggatgctgggcttgccagaaaggaggcagctgctcccaggatgagttctgaacatgctacctgagcccttccctcctcccgtgctctgttccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcaccatgaccacctggtgtgacctctctgtgccttactgaggcacctttctagagattaaaaggggcttgatggctgtt

SEQ ID NO: 5414 - DNA, 13111 bp, human; identical to SEQ ID NO: 5413

SEQ ID NO: 5415 - DNA, 17806 bp, human
tctaggtgcagaggccagaggaagtcattgctgtcctgtcccgcctggggcttttgtggaccagtctcccagtgaggtgcctggtctgagagggccttgaccattccccttgggagtctttcagaccccagtcttgtgtgttctgactgacacacccagacccatggggcttcagcctcacatggattcactctgttccagttaagctggacccgccctctgacttgcagagcaacatcagttctggccactgcatcctgacctggagcatcagtcctgccttggagccaatgaccacacttctcagctatgagctggccttcaagaagcaggaagaggcctgggaggtaacactttggctggctttccctgggggcctctctcctgggaacagcagtccagggtagactccccactctacatagggagatgtcaacttgtagtgatgagaagggaggaactagagcggggtgtgtgtgcacacacacatgctggcatgcagatgtgtatgctttatgtgtgtgtatgggagtagggtgagtgcgcctgtgtctctgtgtgtgcacataagtgtggtgagtgtgcatgtatgtgtttatgtgtacacatatgtaactgtgcacactcatgtttgtgtgcccatgtttgtgtgtttatatgtaagtgtacatatgtgtgtgcctgtgccttgcatttgtgtgagtgtgcacatgggcatgcctatgtgtatgagtgtgtatgtgagtgtggtgagttgcttctgtgcacacacttttgtttatgagtgtgcatgcaagtgtgatgagtgtgaaagtgttcctgtagacatgtttgcctgtgtgtgcatatgtgtatttgtgggcaaacgcagctgtgtctgtgagtgtgagtgtgccttctgtgtgtgtgtgtgcacgtgaatgtggtgagtgtgtctgtgtgttaacacaagtgtgttcaagagtgtgttatatgagcatataatgcatgtgtgtattctcgagggctgagggacccagccccaccttcaccacctgctaactgtccccacccccacagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggtgggcactgctgtggctgctgcacttccagcggagtctgggctgggcgtcttctcccctgttcacctcagccctgcaccctttcaccctcctgtaagcccctccccgaggcagccatgcctcagttgacccccttcctctgaaggtctgaggtctgtagggaggacagaaacacctgccaactctggggcttcctgggaacctgtagttagtggctgctgttaggagtgagggtggcagggctgcacaccagggctgggctcctgcctggaggctggacatgacctcagtgtccttaatgggggctggactgacccttgcgcactgcagtgctgagatggcccagggactttatgacccaccttgtggcagatgggaagagtgaggcccaggagtgtggttcacacaaggtccttcagcaggtgacacaaacctccaaggcccatcacaaggtccttcagcaggtgacacaaacctccaaggcccatcacaaaccttccactttggcccagggcactaaagggcgcacctttgccaggtgggtttggggggagcctcctggcactgaggctgctcacagccctgggcccttcctgtccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggtgggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcaccacatgtcaggttacaagacagggtgcaggggccatgtcaggccgcagatgtgaggaagagggtgtggggagaggggtgttgggtggggctaagtgggagggtgcttcgcttctccttggagcaaaggaaagtgtaaaactgtgtgacacaacctagtttatgttttgaggaatagattgctgggacaaggggacatgggggacctgctggaggccaatgggggccagtgaggtgcccacagggagacgatttggcatgagccagtgaaagaagtggagatagagaaaagtggagagaattgcagggtctcatgaggggaaatagaagggacatgtgggtggatgagatatgagtggtgacccctgaggtggggaaatgggggacagccttgcagggaggttggtgaagtctatttggacctgttgggttggagccccaggtgacatccttgtgggagggtcagtggatccttggcagcaagtctggtgctcagggagacactgggtggggtgggagccacagaccttctgctgatggcaaagacagggttcctggagtgctggctccctctgtgatctgaggacccagctagtaactccccgttctgaacccgccatcgcagctcacgctgtaaaggacgcgcgcctcagtataaatcagttctatgcggccgttaggcaaggaggcccagttgggtcctgccctgagagtgggttggaatgtgatgagatgggagagaggcagtggcagggacgaggtgggcggacctcctgctgatggaaggaagctcagcctctgcagtgacctcaggccacctgggtcgccataggcctctgactggcctctcttggcctcagggtgaagagaatcttctaccagaacgtgccctctccagcgatgttcttccagcccctctacagtgtacacaatgggaacttccaggtgtgtgcagagaccacagaaggacatggggggcaggggttgcccagagctctggcctgcccaagatgttggctttcactgagggttggcggccagtatgggaggcttgtcagtgcttggagccttttttgtatattcagtgaatttcaatttatacgcgtatctcaaatggggaaaaattagctttattttccattgctgatttctttttgttctcaggtctctagttccattgttgattgaaaaaatgtaaatttctcataacttatctctgtcccctctggtttgcagctttctgcacccaccatgtgcctcacctcctccttctgcgaaggtgtctgtcctgtggccatggggaagggtctgtggtgtgtgtgctgcccttggggctctcactgcctctgggctcctgctctgcctggtcccctggtctccccggatcacatgatggcaccacagctgaggagtgggctctgcacttcccccccttccacccatgttgggctcctacagcccaggcaccagtgagcaacttgggggttgcatcagcccctcccctccctgctgggctgttggttcatgccccctgggtgggaggagggggagagggagagctccagtgagtggtctctggtttttcccctcagactcctcactttgggcaaaggacaagaggcagtgagggcccctccctggggtctgggccaagctgaccactcttctccagaatcttccctccctgtccccttcacactgtggctccagcttactatgcagaaaaatccttttctctctcaatgaggagcgtagttttcaagatttttgtccaaaaatataatttgaaccatgaaccgggcatctggctcttggcagagtctccctctttccccaaggtggtagatgtgactgtcaggagcctgggcagctgacgacaaggctgagcaggtcagattgtgactgtcccctggactgtcatcctgttgcgggcaccagctgttccctagagaactaggacacctgccacgggttatttagacctgcgggtgaggatctggtgccataggttggtctccagggagcactgcagtgatggagggtgttgtgtgtgtgatgcatgggatggaggctcctggtcccaccaagggaacagcttccttttggaggcgggggcctcctgtggccccacagaaggatccaggtctgctggccatagccgagtgctttgaaagtcaccagtcctgacagcgattcgtgtgtgtgtctgtgtgtgtgtgtgtgtgtgtttatgtgtctgtgtgtgttcgtgtgtgtgtctgtgtgtgtgtttgtgtgtgtatgtctgtgtgtgtgtgtttatgtgtgtgtgtctgtgtgtgtttaagtctgtgtgtgtttgtgtgtgtgtgtctctgtgtgtgtgtctgtatctgtgtgtgtttgtgtctgtgtgtgtttgtgtgtgtgtctgtgtgtgtttgtgtgtgtgtgtctgtgtgtgtgtttatgtgtctgtgtatgtttgtgtgtgtgtttgtgtgtgtgtgtttgtgtttatgtgtgtatgtctgtgtgtgtctgtgtgtctgtgtgtgtatgtgtctgtgtgtgtttatgtgtctgtgtgtgttcgtgtggtgtgtgtgtctgtgtgtgtgtgtttgtgtgtgtatgtctgtgtgtgtgtgtgtttatgtgtgtgtgtctgtgtgtgtttatgtctgtgtgtgtttgtgtgtgtgtgtctcgtgtgtgtgtgtctgtgtgtatctgtgtgtgtttgtgtgtgtgtgtgtctctgtgtgtgtgtgtgtttgtgtatgtttgtgtgtgtgtgtgtgtgtgttgggaatgcccagtctctgcagctgctgaaaggccctgaggcacatgctgtcaggagctggctctgtcctgggcagatatcaccatctgtacctcggttcaggctgccgtgggcaccaggccctgtgctgggggagtgctgaggagcctgaagggactcagggtcccgtgatgaggctgggctggcacatggaggaaagacagaatgtccaagacacaggcgctgcttggcctctgggtgtggacctcaggagggcttcctggaggaggagggatgctgggcttgccagaaaggaggcagctgctcccaggatgagttctgaacatgctacctgagcccttccctcctcccgtgctctgttccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcaccatgaccacctggtgtgacctctctgtgccttactgaggcacctttctagagattaaaaggggcttgatggctgttccaaagtgttgatggctgggagaaggggccagaggaggagtgaggggtggggtttgtccagccctgggctttccgggctctagagatagcatggtgtaggctcaatgacagttctggggacagcaagttggaggttcaggggcagcttcaggacagcaggatggaggctcagggacaattcctgggaggccagtgccctcgttcctccttgtcctcatcctcccccttgctccaggaaactgagagctgagcctggagcttccagacagtcagtgctgggggtgaccatccagcagtgatggtggcctgtgaagggtcctgcttctgtcctcagcctctcatggggtgggcttgtggaggagctgtggtctggagagagtggcagttggagcagaacgtgcctgcgtttgtttcctagggctgtcgtaacaaagtgccacaaaatggttagcttagaaccacagagatttgttgtctcacaattctgaagtccagaagttggaaataaagatgttggcagtgttcccaaccacatgttcttgggctcccatgaaacagaagttgatattaggccaaggaagcttcccagacaagactttattaagtcttatgccccgaaagtttgggcagaagagagacggtgcaggaggaagaattcttggctgactccccaaggggaatgcattgtggtgtcttaaggagggtgacatacataatttatgagctacatgagtgtcattgcacatatggggtggagcgaagggtgctcagacgcatgctaacacatacgttgcatgatcagaaaatggcagataagcccctccctgggtgaggactttagtattatcataagaccagggtcattctcctggccttgtgcacaagcaggtgatggagtcaactcccgtcagtaagacttatggcgggatgctgcttatcttagtttatttcagacagttggcaaggtctggccagcgagtatggcacctggagggtggtgctgcaaggtctagtggtcagcgggcacgtatggaacaatacgttagtgggggtgggccgagtcccatttatactctctcagcagggccatgctccctctgaaggcactagggaaggattagtttcaggcctctcttcagcttctgttagtttcttggcttgtgacaccaaagctgtaatctttcttttgttttgtttttgtgacggagttttgctcttgttgcccaggctggagtgcaatggcacaatctcggctcactgcaacctcctcctcccaggttcaagcaattcttctgcctcagcctttggagtagctgtgattacaggcacctgctaccacgcctggctagtttttgtatttttagtagagacggtgtttcgctatgttggccaggctggtctcaaactcctgatatcaagtgatccgtctgtctctgcctcccaaagtgttgggattacaggcatgagccaccgtgcctggccaaagttccagtctttacagggatttttccttgtgtgcatttctgtgtccaaatttcccctttttaaaatcacaataatagtgaattaaggctggccctaacgatttaatcttaacttgatcatctgcaaagacactgtttccatataaggtcacattcacagctactggggttaggacttcaacctagagggcctgacttctggcccaacacatcatggcccatcccagcatgccccatccccttcctgggtgccccaggcagatcacaggagggcctgactgctgggctttgggctgacattgggatcatctgcctagttagggctgtgaccagactgagataggaggtgggacctgactcctgaggcagggcttgaactctggaccagattacagactagctgaaacaggcaaaagcacccctccataagacacacccactggtgccaagtgagtttgccgttctcatggtaacagctggaaattactgcccctttccatggcaatgacctgaaagttaccaccccttttctagaaatttctaaataacctcctccttaatttgtatatagttacaagtgggtataaatatgtgtgcagaactgcctctgagctgctactctgggctgactgcctatggggcatccctgctccataaggagcagtacctctgctgccactgtgcacagctgcttaaataaaagttgctctctaataccaccgactcgcccttgaattctttcctgggtgaagccaaaagccctcctgtgctaaaccccaatttctgggctcacctttcctgcatcaagagtgttttggggctgggagcgctgaagttttgaaggcaggatgaaatggagactgttagctccctgggtcctgagctacagggagcaactctcctgggtgctctcatgcttcctgcaacctgagcagaaagaagtacctgtagcctgatgcccccaaaggcaaaagccccttctggctcagataggcagccctcccaccctgcatgcctgcagagcttctggggttttgtggggagcctcagcagagctggatcctggtctgtgggggcgaggcaggccccagaatgtatctttagcatccagagagtgggaggggtgtggacggaagcgaggtacaggcatcctcagctctaaccaagtataaaaatactagtgtgaatccacttcctggagctgggctctggggagccccgggctagtgtatttataacaggggctgtgtggctcatgaggctccatgtgtgacctgggctacctcatgatcacataaacgaacccacaattgggatgcctctcctgtgtggcctggacacctcttcattcaactcataaactttccctgagtgggccctggagagctggttctgggctggaacctgagagtgaagccactggaggctgtgtaatttgtaggtgagtcactcagtcacctaagcctggccctcccctctgcacagggtgctagccatacctagcagactgctgtgagttcacctgagcaagacacctgcacacagtggtgctcagaaaaagctaataattccttattggaatgagacaggcctggcatggtggctcatgcctgtaatcccagcactttgagaggctgaggcaagcagactgcttgagcccagaagtttgagaccagtctgggcaacatggcaaaaccctatcatctctatgaaaaatacaaaaataattagctgggcatggttgttcaggcctgtaatcccaggtactcgggaggctgaagtaggagaatcacttgaatccgggaggcagaggttgcagtgagccgagatcacgccactgcactccagcctgggcaacaaagtgagactccatgtcaaaaaaagaaaagaggccaggagcagtggcgcatgtctgtaatcccagcactttgggaggccgaggtgggtggaccacaaggtcaggagttcaataccagcctggccaagatggtgaaaccccgtctctactaaaaatataaaaaaaaaaaaaattagccaggcatggtggtaagtgactataatcccagctacttaggaggctgaggcagagaattgctcaaacccaggaggtggaggttgcggtgagccgagattgcgccactgcactccagcctgggagactgagcgagactccgtttcaaaaaaaaaaaaaaaaaaaaggaaaaaagaaagaaaagaccccaggaccatacatatttacagctcagtattaactaaccttaatgaaatatgattttatttaaaatggtcaaggtaaaggaaaaaaaagagtagtgactttcttcaagtaattttatggtataatatcaaagcttgatatagttaatacatttcatctaatataggaatgagaatgcttataaagcagacgtcattttatgtaccattacaaatacactgccaattaaacagactttctcaacaaaagactgttgttgacgaggtgacttccattagacacacaaaatggtttgtttttgttttcatttgtttttgttttttgagacaaggtctcgctctgtcgcccaggctaaatgcagtggcctgagaatgataatgtgcctgcttttccatttcctgtgttgtttccactgcgttaacaaaagagccttaaaacacaaagcactggccgggcccagtgggtcacgcctgtaattccagcactttgggaggccgaggtgggtggatcacctgagatcaggagttcgagaccagcctgatcaacatggagaaacaccgtctctactaaaactacaaaattagccgggcgtgatggcgcatgactgtaaccccagctactcgggaggctgaggcaggagaatcgcttgaacccgggaggcagaggttgcagtgagtcgagatcgcgacatcgcactccagcctggggagcaagagcgaaactccttctcaaaagaaaacaaaacaaaacaaacaccgagcactcatctaggggcgcctgtttcattggccttagactgcggtgcctgctggtccccgacctcacgagggcatctctgtgttcctcctcctttccccgtaccagggtcagccccaggtgtcccggagatgcagccccaggtgtcccagagatgtcctcatcgcggacgtggccccaggtctcctcaggtgtctcgaagccatggcccctcctgggtgggtcctgaggagagaaaactccgtcctcacagtcctcacacccagggatgccgctgtacggatcagacgcagttctactgtggcgctccgggtttggccgggccccctaatggcagccgtggagaatccctgaaaattagcgtttggatttttccatgccgtgattttggaaatttcaactgacatggagcccaccatcccgtgccccgaccgaaacccatggagacagcaagcaaagaagatggccagttcacgcctgtaatcccagcactttaggaggccgaggcaggaggatcacttgagctcagtgagttcgagaccaacctggccaacatggtgaagcccccgtctctactaaaaatacaaaaaaaaaaaaaaaaaaaaaaattagctgggcgccgtgggcaacaactgtatgtagtcccagctacttgggaggctgagggaggagaatcgcttgagcccaggaagcggaggttgcagtgagcagagattgcacacctgcactccatcctagtcaacagagtggggcttcctctcaaaaagaaagagggcagggcatggtggctcacacctgtaatcccagcactttgggaggccgaggcgggcagatcacgaggtcaggagattgagatcatcctggtcaacgtggtgaaaccccgtctctacaaaacatataaaaattagctggacatggtggcctgctcctgtagtgccagctttgggaggctgaggtaggagaatcgcttgaaccatggaggcagaggttgcagtcagcggagattgcgccactgcactccagcctgggtgacagagcgagacgccgtctccaaaaaaaaaaaaaaaaaaaaaaaaaacaaaaagcaaaaaacaaaatcaaaaacaaacatccagcactgatcccaggggcctgtttcctcggcctcaggctgatctcccgacagcgtctccgcgttcttcctcctctcccggtaccagggtctcttcccagaaagaaactcacatccgtaacctgcatcttggcctgaactgggggtgacccgcccaagcctccatgaaggggaatctcctacaaagtgaggtcctgctacaaagtgcacgacgggaaatgcagccgcgctcgctccgccacactcacaccgggggcgggaagccttttcctcaccttggcctcggccccaagtggtgtcccggagatgcagcagcgtctcccagtcctcaccgcggacgccgccccaggtgtccccaggtgtccccaggtgtctcgaagccgcggtctctcccatgcgggtcctggggagaggaagctcagtcctcatagtggccgcaaagtgactgccgctgtgtggatgagacgcggtgcgtgcacggcgccccgagttgccaggggccatgcgcccccttgcggcagccatggggagtctctgaaaatcagcgtctagatttttccaggctgtggattttggaaattacgactgaaatggagcccaccatcccatgccttgatcggaactcatggagcaaggaagcaaagaagatggccagttcatgcctgtaatcccagcattttgggaggctgaggcgggcggattacttcaggtccagagtttgagaccagcctggctaacatggtgaaaccgcatctatactaaaaatacaaaaattagctgggcatggcggcacgtgcctgtaatcccagctactcaggaggctgaggcaggaggattgctcgaacccaggaggcgcaggttgcagtgagccaagatcatgtcactgcactccaacctgggtgacagagccaaactccatctcaaaaaaaagatggccagtaggcaaaacttaattgattttctttcttttctctttaagagacagggtctcgctctgtcacccatgctgaagtgcagtggtgtaatcacagctcccgagttcagcctccagctcccgggttcaagaaattctccagcctcagcctcccaacacactgggattacaggtgtgaacaactgtgtccggcaccacctgattttcctttatttattattttattttttatgggcggggcaggtctaactatgttgcccaggctggtctagaactcccaagctcaaatgatcctcccaactaggcctcccaaagtgctaggattacgggcgttagccaccacacactgcctgattttctttctatcatcagcaataatgtataggaataatttgaacttgaaatttgaaaaaaataccatttacaatagcattcccaaatttaatttattaggtataaatctaacaaaatacatacaaatatgcattcagaaaactttagatcacggttgagaagaatcaaaaatattaaatcaaatgcagatactccttgtttaggagcagtacactcattattgttagctttaccacaaagctaaagcaatgaagagagtgatattggtgaaggaatggacaaacagctcaacagaacacaatacagaacccaaaaaacccgagtaaatacattcaattgattttgtcaaaggggcaaaagcaattcactggggaaagaaaagtctgttccacaaatggcaatagacaatcggaaaccatacggaaaacactgaatgtggacaaaaacttcatagctcacccccaaaaaatcactcaagatagtctgtagccttaaatgatcaaatataaaattgtaaaagttttatagaagaaaatccacgtgactttgggttggtgatgagttcttagatacaataccaaaagccagtccataaaagaaaaaaaatgataatttggacatcattaaaatttaaaatgactactctgtgaaatatcctgttaagagaatcaaaaaataaggcacacactgagagaaaatatttataaaacaagcctgaaaaaaagacttgcatgcaaaatatacaaagacattctaatactcaacaagaagaaaaacaacccaattaaaagataaagacatggaataggaacagctccagtctacagctcccagcctgagtgacgcagaagatgggtgatttctgcatttccaactgtggtactgggttcatctcactggggcttgtcagacagtgggtgcagcccacaagcttgagccgaagcagggcgagacatcgccttcacccgggaagcacaaggggtcagggaattcccttttcctagccaagggaagctgtgacagatggcacctggaaaatagggtcactcccaccctaatactggcgcttttccaacggtcttagcaaaccgcacaccaggagattatatcccacgcctgggctcggagggtcccacacccacggagcctcgctcattgctagcacagcagtctgagattgaactgcaaggtggcagcaaggctggtggaggggtgcccgccattgctgaggcttgagtaggtaaacaaagtggctgggaagcttgaactgggtggaacccaccacagctcaaggaggcctgcctgcctctgtcagactccacttctggggccagggcatagtcgaacaaaaggcaacggaaatctctgcagacttaaatgtccctgtctgacagctttgaagagagtagtggttctccaagcacggagtttgagatctgagaacagacaaactgcctcctcaagtgggtccctgacccccgggtagcctatctgggaggtaccccccagtaggggcagactgacacctcacattgccgggtacccctctgagaccaagcttccagaggaacgatcgggcagcaacatttggtgttcagcaatattcactcttctgcagcctccactgctgatacccaggcaaacagggtctggagtggacctccagcaaactccaacagacctgcagctgagggtcctgactgttagaaggaaaactaacaaacagaaaggacatccacacaaaaaccccatctgtacgtcaccatcatcagagaccaaaggtagataaaaccacaaagatagggaaaaaacagagcagaaaaactgaaaattctaaaaatcagagcgcctctcttcctccaaaggaacaaagctcctcaccaacaatggaacaaaggtggacggagaatgactttgacgagttgagaaaagaaggcttcagatgatcaaacttctccgagctaaaggacgaagttcgaacccagtgcaaagaagttaaagaccttgaaaaaaagattagatgaatggctaactagaataaccaatgcagagaagtcctgatggaggtgaaaaccatggcacgagaactatgtgacgaatgcacaagctttagtagccgatgcgatcaactggaagaaagggtatcagtgattgaagatcaaatgaatgaaatcggggtcagggtcaagggtcagggtcagggtcagggtcaagggtcagggtcaggggtcagggtcagggtgagggtcagggtcagggtcagggtgagggtcagggtcagagtcagggtcagggtgagggtcagggtcagggtcagggtgagggtcagggtagggtgagggtcagggtgagggtgagggtcagggtgagggtcggggttagggttcagggtcggggttagggttcagggtccgggttagggttcagggtccgggtcagggttagggtcagggtcagggttagggtcagggtcagggttagggtcagggttttagggtcagggttttagggtcagggtcagggtgagggtcagggtcagggtgaggaccctttacagcagatgaaggcctctccccagccagaaaagatggagcacacgctgggtggtggccccgcttcctcactggaaggagatggtgctcttcttttttctttctgaattgtggccaccttcataccagtctgtcatggaacacttaagccgcttgagtgcctgctggtactcccagccctgccatgcctgagccccctgcacacaaggagccaggagtaatcagggcagacccattagggcacggggacttctggattgtgaaattggctctctgggggccaaggccttctaacgttggtggaagtggctttggcttattgggtcggattctaggccattcgttccaacctttagagacatcccagctttccctagcccagagtctgcagcccctccaccatcccacatcctccccctccctttcctcatgaaccccagtcgcgcctctgccttctcaaacccctccaccatcccacaccctcctcctgcccttcctcatgaaccccagtcacgcctctgccttctcatccctgcgcgccacacaggctcgctcgtgcccggtgaatgctgaggctgctctgcacgtggagtgtggccctgtgggcaagggctgggctcttggaggtaggggagctacaggggcgactgggaggaggatgttgtgttacacacgcatcagagttaactttgcagtgagagcagccttgctgcggccaaagaacatggaaaagcatgagtggggtgatgtgccttaaagcatcagacacttgggcctcgggcatcaggagccagccacagggatgtctggggaaatggcgttccatgagatgcaagcacacaagaatgcacttggcacatctggggaacagcaggcagctgatatcactgggcccaccccgcaccagggaggatggaagcaggtgaggagctagaccacactgaggcggtggtcgggactcagagtttgctcagtgagccgttcactaggtgcaggggcagttccccgtctgaatttaggtgacgacactcaggtccagccttgccagtctcagcctccggtctccgttccccctctgcagaggtcactttgtctgctgcacgtgattatgaggggttgtgaagtgcttgccccatcagtagccagtgtgcatgtgtaaataccatcctctgtgtgccctggaggctgtccttcagatagcatgtacaggtggcagcatagggcctgtccctagtgagagtgcagggaactcagcaccgtcaactcctcgaccctgcaggtcagattatccttgtagaggccccctggatggcaccaagatcggccctggcaagcaggtgaccctgacttcagagcccttgcctgagggcctggcctggcagctctgctgttagaagcaggaggtgtgcagggggtggggagcagcccagcctctgtgatcttctccatggcaggatctcccagcaggtagagcagagccggagccaggtgcaggccattggagagaaggtctccttggcccaggccaagattgagaagatcaagggcagcaagaaggccatcaaggtagtccccatacccctgtgtcctgaggctactgggcagtccctccatttccccatgcctctgaggccgcccattctctgccctgctgcccacctgtaccttgggctttcttctcgcccaggcttccaactccaccctctcctgccaagcaatcctagccctctgagcctcttagggccccctcagacttgtccctgtgtccacaggtgttctccagtgccaagtaccctgc

SEQ ID NO: 5416 - DNA, 2214 bp, human
cggcagtcactttgcggccactatgaggactgagcttcctctccccaggacccgcatgggagagaccgcggcttcgagacacctggggacacctggggacacctggggcggcgtccgcggtgaggactgggagacgctgctgcatctccgggacaccacttggggccgaggccaaggtgaggaaaaggcttcccgcccccggtgtgagtgtggcggagcgagcgcggctgcatttcccgtcgtgcactttgtagcaggacctcactttgtaggagattccccttcatggaggcttgggcgggtcacccccagttcaggccaagatgcaggttacggatgtgagtttctttctgggaagagaccctggtaccgggagaggaggaagaacgcggagacgctgtcgggagatcagcctgaggccgaggaaacaggcccctgggatcagtgctggatgtttgtttttgattttgttttttgctttttgttttttttttttttttttttttttttggagacggcgtctcgctctgtcacccaggctggagtgcagtggcgcaatctccgctgactgcaacctctgcctccatggttcaagcgattctcctacctcagcctcccaaagctggcactacaggagcaggccaccatgtccagctaatttttatatgttttgtagagacggggtttcaccacgttgaccaggatgatctcaatctcctgacctcgtgatctgcccgcctcggcctcccaaagtgctgggattacaggtgtgagccaccatgccctgccctctttctttttgagaggaagccccactctgttgactaggatggagtgcaggtgtgcaatctctgctcactgcaacctccgcttcctgggctcaagcgattctcctccctcagcctcccaagtagctgggactacatacagttgttgcccacggcgcccagctaatttttttttttttttttttttttgtatttttagtagagacgggggcttcaccatgttggccaggttggtctcgaactcactgagctcaagtgatcctcctgcctcggcctcctaaagtgctgggattacaggcgtgaactggccatcttctttgcttgctgtctccatgggtttcggtcggggcacgggatggtgggctccatgtcagttgaaatttccaaaatcacggcatggaaaaatccaaacgctaattttcagggattctccacggctgccattagggggcccggccaaacccggagcgccacagtagaactgcgtctgatccgtacagcggcatccctgggtgtgaggactgtgaggacggagttttctctcctcaggacccacccaggaggggccatggcttcgagacacctgaggagacctggggccacgtccgcgatgaggacatctctgggacacctggggctgcatctccgggacacctggggctgaccctggtacggggaaaggaggaggaacacagagatgccctcgtgaggtcggggaccagcaggcaccgcagtctaaggccaatgaaacaggcgcccctagatgagtgctcggtgtttgttttgttttgttttcttttgagaaggagtttcgctcttgctccccaggctggagtgcgatgtcgcgatctcgactcactgcaacctctgcctcccgggttcaagcgattctcctgcctcagcctcccgagtagctggggttacagtcatgcgccatcacgcccggctaattttgtagttttagtagagacggtgtttctccatgttgatcaggctggtctcgaactcctgatctcaggtgatccacccacctcggcctcccaaagtgctggaattacaggcgtgacccactgggcccggccagtgctttgtgttttaaggctcttttgttaacgcagtggaaacaacacaggaaatggaaaagcaggcacattatcattctcaggccactgcatttagcctgggcgacagagcgagaccttgtctcaaaaaacaaaaacaaatgaaaacaaaaacaaaccattttgtgtgtctaatggaagtcacctcgtcaacaacagtcttttgttgagaaagtctgtttaattggcagtgtatttgtaatggtacataaaatgacgtctgctttataagcattctcattcctatattagatgaaatgtattaactatatcaagctttgatattataccataaaattacttga

SEQ ID NO: 5417 - DNA, 17806 bp, human; identical to SEQ ID NO: 5415

SEQ ID NO: 5418 - DNA, 1390 bp, human
tgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggtctgctggctgcgcacataacttagcctgtcacacaccaggaggactggatactggggaggagccggggccaccatagggttctgtcccccagaggaggctgactgggatggggtggcagctgattaggcccagcaccaaatattcaccatcccttggccatcctggccctctcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggtgggacagaggtggagacaggtgcagtggcccagggccttgccagagctcttctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaaggcaggtgagctgggttctgggatgggagctgggccggggacctccctgctgacacaccttcttccctagacaccccgcactttgtgtttcagacctacaagatggggtactaacaccacccccaccgcccccaccaccacccccagctcctgaggtgctggccagtgcacccccactccc

SEQ ID NO: 5419 - DNA, 745 bp, human
tttgatgcccccttgtccatcagcaagagagagcagctggaacagcaggtgggaggggtgggacagaggtggagacaggtgcagtggcccagggccttgccagagctcttctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaaggcaggtgagctgggttctgggatgggagctgggccggggacctccctgctgacacaccttcttccctagacaccccgcactttgtgtttcagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcaggtgggagcagctctttgaggccacctgatttctggcgtgctcagtgcactcgggtggattttctgtgggtt

SEQ ID NO: 5420 - DNA, 3664 bp, human
tgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggtctgctggctgcgcacataacttagcctgtcacacaccaggaggactggatactggggaggagccggggccaccatagggttctgtcccccagaggaggctgactgggatggggtggcagctgattaggcccagcaccaaatattcaccatcccttggccatcctggccctctcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggtgggacagaggtggagacaggtgcagtggcccagggccttgccagagctcttctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaaggcaggtgagctgggttctgggatgggagctgggccggggacctccctgctgacacaccttcttccctagacaccccgcactttgtgtttcagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggtccataaaatagtggctttcaaactgtagagctctggacttctcacttctagggcagagggaacctgaacaagtgaggctctgggttccccattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggtgctttctgcccaccccctgctcttgccagctggcccctgcttcccctagggcacatgctggaagccctgggccgccaccagaagtcctcagccctcctgcctgggctatggctccttcctggtttgggagccatagtgaagctttcctctctaagctcacccagcccaaactgtgacaggagaatcttcttcgactgccaagagcggtccaaggcaatggtcagccactgcagccccctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggtcggcaccttgtaattctgtcctgcctttttcttcctgtatttaagtctccgggggctgggggaatcagggtttcccaccaaccaccctcactcagccttttccctccaggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcag

SEQ ID NO: 5421 - DNA, 3978 bp, human
agcaggtagagcagagccggagccaggtgcaggccattggagagaaggtctccttggcccaggccaagattgagaagatcaagggcagcaagaaggccatcaaggtagtccccatacccctgtgtcctgaggctactgggcagtccctccatttccccatgcctctgaggccgcccattctctgccctgctgcccacctgtaccttgggctttcttctcgcccaggcttccaactccaccctctcctgccaagcaatcctagccctctgagcctcttagggccccctcagacttgtccctgtgtccacaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggtctgctggctgcgcacataacttagcctgtcacacaccaggaggactggatactggggaggagccggggccaccatagggttctgtcccccagaggaggctgactgggatggggtggcagctgattaggcccagcaccaaatattcaccatcccttggccatcctggccctctcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggtgggacagaggtggagacaggtgcagtggcccagggccttgccagagctcttctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaaggcaggtgagctgggttctgggatgggagctgggccggggacctccctgctgacacaccttcttccctagacaccccgcactttgtgtttcagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggtccataaaatagtggctttcaaactgtagagctctggacttctcacttctagggcagagggaacctgaacaagtgaggctctgggttccccattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggtgctttctgcccaccccctgctcttgccagctggcccctgcttcccctagggcacatgctggaagccctgggccgccaccagaagtcctcagccctcctgcctgggctatggctccttcctggtttgggagccatagtgaagctttcctctctaagctcacccagcccaaactgtgacaggagaatcttcttcgactgccaagagcggtccaaggcaatggtcagccactgcagccccctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggtcggcaccttgtaattctgtcctgcctttttcttcctgtatttaagtctccgggggctgggggaatcagggtttcccaccaaccaccctcactcagccttttccctccaggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaa

SEQ ID NO: 5422 - DNA, 2299 bp, human
tggccagtgcacccccactcccaccctcaaccgcggcccctgtaggccaaggcgccaggcaggacgacggcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggtccataaaatagtggctttcaaactgtagagctctggacttctcacttctagggcagagggaacctgaacaagtgaggctctgggttccccattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggtgctttctgcccaccccctgctcttgccagctggcccctgcttcccctagggcacatgctggaagccctgggccgccaccagaagtcctcagccctcctgcctgggctatggctccttcctggtttgggagccatagtgaagctttcctctctaagctcacccagcccaaactgtgacaggagaatcttcttcgactgccaagagcggtccaaggcaatggtcagccactgcagccccctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggtcggcaccttgtaattctgtcctgcctttttcttcctgtatttaagtctccgggggctgggggaatcagggtttcccaccaaccaccctcactcagccttttccctccaggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaa

SEQ ID NO: 5423 - DNA, 5360 bp, human
aggagatggtgctcttcttttttctttctgaattgtggccaccttcataccagtctgtcatggaacacttaagccgcttgagtgcctgctggtactcccagccctgccatgcctgagccccctgcacacaaggagccaggagtaatcagggcagacccattagggcacggggacttctggattgtgaaattggctctctgggggccaaggccttctaacgttggtggaagtggctttggcttattgggtcggattctaggccattcgttccaacctttagagacatcccagctttccctagcccagagtctgcagcccctccaccatcccacatcctccccctccctttcctcatgaaccccagtcgcgcctctgccttctcaaacccctccaccatcccacaccctcctcctgcccttcctcatgaaccccagtcacgcctctgccttctcatccctgcgcgccacacaggctcgctcgtgcccggtgaatgctgaggctgctctgcacgtggagtgtggccctgtgggcaagggctgggctcttggaggtaggggagctacaggggcgactgggaggaggatgttgtgttacacacgcatcagagttaactttgcagtgagagcagccttgctgcggccaaagaacatggaaaagcatgagtggggtgatgtgccttaaagcatcagacacttgggcctcgggcatcaggagccagccacagggatgtctggggaaatggcgttccatgagatgcaagcacacaagaatgcacttggcacatctggggaacagcaggcagctgatatcactgggcccaccccgcaccagggaggatggaagcaggtgaggagctagaccacactgaggcggtggtcgggactcagagtttgctcagtgagccgttcactaggtgcaggggcagttccccgtctgaatttaggtgacgacactcaggtccagccttgccagtctcagcctccggtctccgttccccctctgcagaggtcactttgtctgctgcacgtgattatgaggggttgtgaagtgcttgccccatcagtagccagtgtgcatgtgtaaataccatcctctgtgtgccctggaggctgtccttcagatagcatgtacaggtggcagcatagggcctgtccctagtgagagtgcagggaactcagcaccgtcaactcctcgaccctgcaggtcagattatccttgtagaggccccctggatggcaccaagatcggccctggcaagcaggtgaccctgacttcagagcccttgcctgagggcctggcctggcagctctgctgttagaagcaggaggtgtgcagggggtggggagcagcccagcctctgtgatcttctccatggcaggatctcccagcaggtagagcagagccggagccaggtgcaggccattggagagaaggtctccttggcccaggccaagattgagaagatcaagggcagcaagaaggccatcaaggtagtccccatacccctgtgtcctgaggctactgggcagtccctccatttccccatgcctctgaggccgcccattctctgccctgctgcccacctgtaccttgggctttcttctcgcccaggcttccaactccaccctctcctgccaagcaatcctagccctctgagcctcttagggccccctcagacttgtccctgtgtccacaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggtctgctggctgcgcacataacttagcctgtcacacaccaggaggactggatactggggaggagccggggccaccatagggttctgtcccccagaggaggctgactgggatggggtggcagctgattaggcccagcaccaaatattcaccatcccttggccatcctggccctctcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggtgggacagaggtggagacaggtgcagtggcccagggccttgccagagctcttctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaaggcaggtgagctgggttctgggatgggagctgggccggggacctccctgctgacacaccttcttccctagacaccccgcactttgtgtttcagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggtccataaaatagtggctttcaaactgtagagctctggacttctcacttctagggcagagggaacctgaacaagtgaggctctgggttccccattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggtgctttctgcccaccccctgctcttgccagctggcccctgcttcccctagggcacatgctggaagccctgggccgccaccagaagtcctcagccctcctgcctgggctatggctccttcctggtttgggagccatagtgaagctttcctctctaagctcacccagcccaaactgtgacaggagaatcttcttcgactgccaagagcggtccaaggcaatggtcagccactgcagccccctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggtcggcaccttgtaattctgtcctgcctttttcttcctgtatttaagtctccgggggctgggggaatcagggtttcccaccaaccaccctcactcagccttttccctccaggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagca

SEQ ID NO: 5424 - DNA, 4335 bp, human
gtgattatgaggggttgtgaagtgcttgccccatcagtagccagtgtgcatgtgtaaataccatcctctgtgtgccctggaggctgtccttcagatagcatgtacaggtggcagcatagggcctgtccctagtgagagtgcagggaactcagcaccgtcaactcctcgaccctgcaggtcagattatccttgtagaggccccctggatggcaccaagatcggccctggcaagcaggtgaccctgacttcagagcccttgcctgagggcctggcctggcagctctgctgttagaagcaggaggtgtgcagggggtggggagcagcccagcctctgtgatcttctccatggcaggatctcccagcaggtagagcagagccggagccaggtgcaggccattggagagaaggtctccttggcccaggccaagattgagaagatcaagggcagcaagaaggccatcaaggtagtccccatacccctgtgtcctgaggctactgggcagtccctccatttccccatgcctctgaggccgcccattctctgccctgctgcccacctgtaccttgggctttcttctcgcccaggcttccaactccaccctctcctgccaagcaatcctagccctctgagcctcttagggccccctcagacttgtccctgtgtccacaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggtctgctggctgcgcacataacttagcctgtcacacaccaggaggactggatactggggaggagccggggccaccatagggttctgtcccccagaggaggctgactgggatggggtggcagctgattaggcccagcaccaaatattcaccatcccttggccatcctggccctctcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggtgggacagaggtggagacaggtgcagtggcccagggccttgccagagctcttctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaaggcaggtgagctgggttctgggatgggagctgggccggggacctccctgctgacacaccttcttccctagacaccccgcactttgtgtttcagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggtccataaaatagtggctttcaaactgtagagctctggacttctcacttctagggcagagggaacctgaacaagtgaggctctgggttccccattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggtgctttctgcccaccccctgctcttgccagctggcccctgcttcccctagggcacatgctggaagccctgggccgccaccagaagtcctcagccctcctgcctgggctatggctccttcctggtttgggagccatagtgaagctttcctctctaagctcacccagcccaaactgtgacaggagaatcttcttcgactgccaagagcggtccaaggcaatggtcagccactgcagccccctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggtcggcaccttgtaattctgtcctgcctttttcttcctgtatttaagtctccgggggctgggggaatcagggtttcccaccaaccaccctcactcagccttttccctccaggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcag

SEQ ID NO: 5425 - DNA, 4022 bp, human
agcaggtagagcagagccggagccaggtgcaggccattggagagaaggtctccttggcccaggccaagattgagaagatcaagggcagcaagaaggccatcaaggtagtccccatacccctgtgtcctgaggctactgggcagtccctccatttccccatgcctctgaggccgcccattctctgccctgctgcccacctgtaccttgggctttcttctcgcccaggcttccaactccaccctctcctgccaagcaatcctagccctctgagcctcttagggccccctcagacttgtccctgtgtccacaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggtctgctggctgcgcacataacttagcctgtcacacaccaggaggactggatactggggaggagccggggccaccatagggttctgtcccccagaggaggctgactgggatggggtggcagctgattaggcccagcaccaaatattcaccatcccttggccatcctggccctctcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggtgggacagaggtggagacaggtgcagtggcccagggccttgccagagctcttctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaaggcaggtgagctgggttctgggatgggagctgggccggggacctccctgctgacacaccttcttccctagacaccccgcactttgtgtttcagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggtccataaaatagtggctttcaaactgtagagctctggacttctcacttctagggcagagggaacctgaacaagtgaggctctgggttccccattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggtgctttctgcccaccccctgctcttgccagctggcccctgcttcccctagggcacatgctggaagccctgggccgccaccagaagtcctcagccctcctgcctgggctatggctccttcctggtttgggagccatagtgaagctttcctctctaagctcacccagcccaaactgtgacaggagaatcttcttcgactgccaagagcggtccaaggcaatggtcagccactgcagccccctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggtcggcaccttgtaattctgtcctgcctttttcttcctgtatttaagtctccgggggctgggggaatcagggtttcccaccaaccaccctcactcagccttttccctccaggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaacagtgtgcttttaataaaggacctctagctgtgcaggatg

SEQ ID NO: 5426 - DNA, 1730 bp, human
tgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggtgctttctgcccaccccctgctcttgccagctggcccctgcttcccctagggcacatgctggaagccctgggccgccaccagaagtcctcagccctcctgcctgggctatggctccttcctggtttgggagccatagtgaagctttcctctctaagctcacccagcccaaactgtgacaggagaatcttcttcgactgccaagagcggtccaaggcaatggtcagccactgcagccccctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggtcggcaccttgtaattctgtcctgcctttttcttcctgtatttaagtctccgggggctgggggaatcagggtttcccaccaaccaccctcactcagccttttccctccaggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggac

SEQ ID NO: 5427 - DNA, 1483 bp, human
cctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggtgctttctgcccaccccctgctcttgccagctggcccctgcttcccctagggcacatgctggaagccctgggccgccaccagaagtcctcagccctcctgcctgggctatggctccttcctggtttgggagccatagtgaagctttcctctctaagctcacccagcccaaactgtgacaggagaatcttcttcgactgccaagagcggtccaaggcaatggtcagccactgcagccccctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggtcggcaccttgtaattctgtcctgcctttttcttcctgtatttaagtctccgggggctgggggaatcagggtttcccaccaaccaccctcactcagccttttccctccaggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggac

SEQ ID NO: 5428 - DNA, 4593 bp, human
tggcgttccatgagatgcaagcacacaagaatgcacttggcacatctggggaacagcaggcagctgatatcactgggcccaccccgcaccagggaggatggaagcaggtgaggagctagaccacactgaggcggtggtcgggactcagagtttgctcagtgagccgttcactaggtgcaggggcagttccccgtctgaatttaggtgacgacactcaggtccagccttgccagtctcagcctccggtctccgttccccctctgcagaggtcactttgtctgctgcacgtgattatgaggggttgtgaagtgcttgccccatcagtagccagtgtgcatgtgtaaataccatcctctgtgtgccctggaggctgtccttcagatagcatgtacaggtggcagcatagggcctgtccctagtgagagtgcagggaactcagcaccgtcaactcctcgaccctgcaggtcagattatccttgtagaggccccctggatggcaccaagatcggccctggcaagcaggtgaccctgacttcagagcccttgcctgagggcctggcctggcagctctgctgttagaagcaggaggtgtgcagggggtggggagcagcccagcctctgtgatcttctccatggcaggatctcccagcaggtagagcagagccggagccaggtgcaggccattggagagaaggtctccttggcccaggccaagattgagaagatcaagggcagcaagaaggccatcaaggtagtccccatacccctgtgtcctgaggctactgggcagtccctccatttccccatgcctctgaggccgcccattctctgccctgctgcccacctgtaccttgggctttcttctcgcccaggcttccaactccaccctctcctgccaagcaatcctagccctctgagcctcttagggccccctcagacttgtccctgtgtccacaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggtctgctggctgcgcacataacttagcctgtcacacaccaggaggactggatactggggaggagccggggccaccatagggttctgtcccccagaggaggctgactgggatggggtggcagctgattaggcccagcaccaaatattcaccatcccttggccatcctggccctctcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggtgggacagaggtggagacaggtgcagtggcccagggccttgccagagctcttctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaaggcaggtgagctgggttctgggatgggagctgggccggggacctccctgctgacacaccttcttccctagacaccccgcactttgtgtttcagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggtccataaaatagtggctttcaaactgtagagctctggacttctcacttctagggcagagggaacctgaacaagtgaggctctgggttccccattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggtgctttctgcccaccccctgctcttgccagctggcccctgcttcccctagggcacatgctggaagccctgggccgccaccagaagtcctcagccctcctgcctgggctatggctccttcctggtttgggagccatagtgaagctttcctctctaagctcacccagcccaaactgtgacaggagaatcttcttcgactgccaagagcggtccaaggcaatggtcagccactgcagccccctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggtcggcaccttgtaattctgtcctgcctttttcttcctgtatttaagtctccgggggctgggggaatcagggtttcccaccaaccaccctcactcagccttttccctccaggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaac

SEQ ID NO: 5429 - DNA, 3978 bp, human; identical to SEQ ID NO: 5421

SEQ ID NO: 5430 - DNA, 52747 bp, human
cgcgggcccagcccccgccatgccgcccggcaaagtgctgcagccggtcctgaagatgaaggtggacgagctgttcctgtactggctcagcgaggccagcacgcagcggatgctgcaggactgcctgcgccggatcaaggcgcccgggcgggaccagccgaccccgggggacggggagcagcccggggcctggcccacagccccgctcgccgccccccggcccagcgggctcgaacccccgggaacccccgggccgggccctgcgctgcccctgggcgccgcctccagccccaggaacgcgccccacgttcgaggcacccgtagatccgcagggacgagagtagtaagttactcttccttctgctaacaactgcgcaggtggctctggtcgcatagtgggcgtgtggctgcgcgatggaggctggtgggcgagcgtcagaccccaaaacggtttcatattgagtctgttccccgccccgaccccccccaccacacacatacagacaagaaagtcccacgtactgaacattccgtcattgacagttgttaacctaaaaatcacacaatttataaaggtagaaaggcttcctattttattttattttattattttaatttgttttaattttgagacagagttttgctctgttgcccaggctggagtacgatggcgcgatcttggctcactgcaacctctgcctcccaggttcaagcgattctcctgcctcaggctcccgaggagctgggacttacaggcacgtgccaccacgcctggctgatgttgtatttttagtagagactgggtttcccccatgtgggccaggctggtctcgaactcctgacctcaagtgatcctcccgccttggcctcccaaagtgctgggatttcagacgtgagtcactgcgcctggtccgttttttatttattttacaattctttggagacagggtcttgctctgtctcctaggctggagtgcagtggcgcaaacacagttggacttcctgcctcagcctccccagtagctgggattacaggcgtgcaccatcacgccaggctaatttttgtttatttatttatttatttatttttgcagagacgaggtcttgctatgttacctagagtgctctggaattcctgggtccaagcaatcctcccgcttcggcctcccaaaatcccactgtatttcttagaagaaacgccatttatttcatagaaggtgattatacaccgcaggtgagaagcgcagcctctggctaatgtacctgtaatctcagctacccgggaggctgaggcaggagaatcactggaacccaggaggcagaggctgcactccagcctgggcaccagagcaagactccatctcaaaaaaaaaaaaaaaaaaaaaaaaaagaaaactaaaaacaagcacttggagggaagaaaagatgagacgggaatttatgctgagtgggttggccaagtgtatatattcaagaagttataggaagagctatggatattcaccaagggtgtcctgacgcatgggtattgaacaaacatgcatgttacctactcccgagttcaccttggagcggagacttaacatttaaatgcattatggttaggccccctaggtcaaaaggtgaagcaactctgcagcctctgtcaaccggccagaaccagtccgtggtgagtagttaccaggataaagtgattgcaatcagttttttttttttttttttttttttgagacagattctcactctcacccaggctgagatgcaatggtgcaatctcagctcactgcaacctccgcctcccgggttcaagcgattctcctccctcagcctcccgagtagctgtgattacaggcgcacaccaccacccccggctaatttttgtatttttagtagaggcaggctttcaccttgttggctagactggtctcaaactcctgacctcaggtgatccacccgcctcagcctctcaaagtgctgggatgacaggcgtgagccaccacacctggcctggaatcagtcttttcccagtcaaagctgtagttacggctggtggaacagaggggtctgttcatcaggatctgacaggaagctgcaggtgttttaatattgtttatattggtcaggcatggtgactcacgcctgtgattccagcatttgggagttggaggcaggcagatcacttgagttcaggagttcgagaccagcctgggcaacatggcgaaaccccatctctgctaaaaatacacaaattagccaggcgtggtggcgcacctgaagtctcagctactcaggaggctgaggcaggagaaatgcttgaagctgggagtcggagattactgtgagctgagattgcaccactgctcaccagcctgagcaacagaggaaggccctgtctcaaaaaaaaaaaaaaagtatatatatatatatagagagagagagagagagagagtcttcttgcgtgcgcgagcttgaggccaagataagcaatagagaaaaagaaaaacatcctttatttacttcttgaatctcaaaaacgagtttctgcagaggtctctagtgaataacctaaaaggacatttagctgctggagaaaaagaaatgctttggcagttggaactgtagtttattctttaagtgtaggcggtgtgtgacttaaccctcacctcaggtggcccttggtcttgtttgccacagagtctgttctgtcagtcttacgatgttgattttaacctttttgctggttggttgtgtttaaactgccaaagcaggaggggtataataaggtgtgtccaaactcccatccagtcatgactgggaacttagttgtttttttgtttttttggttttttttttttttttttttttttttttttgagacggagtctcgctctgtcccccaggctggagtgcagtggcgcgatctcggctcactgcaagctccgcctcccgggttcacgccattctcctgcctcagcctcccaagtagctgggactacaggcgcccgccaccacgcccggctaatttttttgtatttttagtagagacggggtttcaccgtgttagccgggatggtcttgatctcctgacctcgtgatccgcccgcctcggcctcccaaagttttgggattacaggtgtgagccaccgtgcccgccgacagccgtgtatttttaaaaatgctttctgtcgttttatactatgcagtttaaagcgataaaacattgcttccagatgttatagaaacacgtatggctggtgcgtctggtgtcccgagaatactacggaagcctgaaatattcagaatgttccgtcggaacttgtttataccatttgaaaattttcagctgaacaccagctttccatcagcagcactaataagcatgtcacaaagtgatatttacgtagcaccacagttttccagccaaaatggaccagcctctctacttgctgagtgagaggtgggtggcaatctgaggtgagctccttgcgttctaaattaccggtggttgtccgatgtcttctgatggatctagaacattttccaaaagtacgtgtcgatgaaaatgtgaactagagctagaggcagcttggagaccgtctggctcaggccctccagatcccgatccaggaggggactcagggccccaggacgcatctcttgagctccggcccagtgcactttcccagtgagctgcaaaacctgaagcaccttaggaactcttgcccaaatccctcatttactgaggaggttgagaggagggccaggactcaagaagcatgtgctagtaatgatggttcccctccatgacttgctttctcagtgggatcgctaatgagctgccattttgtccttaaacgtgttgaatgacagccagacgctaaggtaaatgcttgaattgtgtgactttgcaagaattctcctagggctgggactattgtgactttgcatgaattctcctagggctgggaatattgacggaaggtcaggtctgtgcaaacgaggccatttgggtgcatgtgagaggatgatatattctgtaaatcaggcaagaagcctctaacaagtggaaattaagttccaaaggtgttcaaagcagggagacatcatttctctcctggagaaagttttgaggaggaagtgagtagtggaacttgagaaatgcactgagtttattgggtatagggggcaggaccaagggaggcggtgaaaatgagaccaggctcagtcgctcacacctgaattcctagcactttgggaggctgaggtggacggatcacctgaggtcaggagttcgagatcaacctggccaacatggtgaaaccctgtctctactaaaaatacaaaaattagctgggtgtggtggtgggcacctgtaatcccagctactctggaggctgaggcaggagaatcacttgaacctgggaggcggagattgcagtgagctgaaattgtgccactgcactccagcctgggtgacaagagtgagacactctgtctcaaaaaaaaaaaaaaaagaaaaaaaaagatgagatgttcaggtcacgttgagggactggagtggtctgaccggagaagcagaaggaaggatgcgtgtggaccgtgggcatggcggccagggtgtgcagggtgcaggattctgcacttaggagatggcaagaattttcaaaaagcagtgactgaccttgtttgggactaaaagtttaccttaaacatgtctacgtgtttggaacctatggcttacttcagctgaatctcaagaagtgaataacttagaaagatgtgtctgttcattgggacaaaaaagatgagcttgggctgggcacggtggctcatgcctgtgatcccagcactttgggaggccgaggcgggcggatcacaaggtcaggagatagagaccatcttggctaacacagtgaaaccctgtctctactaaagatacagaaaattagccgggcgtggtggcgggtgcctgtagtcccagctactccggaggctgaggcaggagaatggcatgaacctgggtggcagagcttgcagtgagctgagatcgcgccactgcactccagcctgggtgacagagcaagactctgtctcaaaaaaaaaaaaaaaaaaaaaaagatgagcttgttcctgtccatcccatatacagaatacgcgaggccacgttaacagtgaaggatgcagttccatgctacaaactctggctggggaggggcgatgctggggtcagaggaagagattttcataaataaagcagctttttctcacccacacatgtacagaatggagtatgagctgtcaggagggttcacgctaggtccattgaactccccagccaagggtgaaaggaacggcattgttttacgttacctacgccttcatcgttactgagcagagagattgcattctgtgtttgaaaggggtgcttgcagtggctccttcccgtctttggggaagagaaactggtacaaattagaaaatgtgagcattggccgggtgcagtggctcaatcccagcactttgggaggccaaggagggaggatcccttgaggccaggagtttgagcccagcctgggcaacatagcgagactcccccatctctgtaaaatagtaaaatcagccaggcatggtggttcatgcctgaagtctcagctgcttgtgaggctgaggcaggaagatcccaggagttcgaggctgcagtgagctatgtttgtgccagtgcactcccgccggggcaacaaagtgagactctgtctctaaaaaaaaaaaaaagaaagaaaacgccagtatcgatgggctgatgctgcaagccagggtgcttctgctaggggggaccctaaatgcatctttaaagtaagttcttacaaggggaattaagaacctcatgtggatgagctgctttttttttttttttttttttttttgagatggagtttcactcttgttgcccaggctgcagtgcaatgacgcaatttcggctcactacaacctccacctcctgcagttcaagtgagtctcctgcctcagcctcccgagtagctgggattacaggcacccgccaccacgcccggctagttttgtatttttagtagagatggggtttcactatgttggtcaggctggtcttgaactcctgacctcaggtgatccacccgccccagcctcccagagtgctgggatgacagacgagggcaaccacacccggccagtactgcacgattttgattgcatttccctgcggcctggtgacgccgaggaattttcaggtgcttatttgccattcatgtggttcccactgtcgagcgtctgttcaggtcgtgtgtttgctttttaaattgggttatgttatcactgagttgcgagagctctttacatacaactgttggcaagtccttggtaagacaatgtggtgtgtgcatatgtctcttgagtctggcttgctttttgttttcttcagtgtctcaaagagcaaaagtgtttagtttttcaacttttttcttttatgactcttattttttgtgtcttattacaaaatgtttgcataccacaaggtgtcaaatattttctcctatttatcttgagaaagcagtgtggttttaggtttgcgtttcggcctgtgatccagttcaggtcagtttttctgcgtggtatgaggtgaggtatctggatgaccccagcaccgtatattgaacagtcttttctccccccgtggaattgtgttgttgaaagtcagttgagtacgtacgtctgttttattattatttccatcccattgctgtatgtgcatcccctcaccttcatggcactttccagattagtgtaactttctagcaaattttgaaagcagatactgtgagtccaagcctgttctttaaaaattgctttccagcaagaaaagcctgttggaattttgattgggattgctttgaatctgtggatcaatttaggataattgataccttaacagtattttccaatccacaaacaaaggactttccattcatttaggttttgttcagcaacgttgtgtacttccccgggtacacctcttgcacctccttgattaagtttctatctgtttatttagttcttctctaatttctggaagctactcagttttggtgtccacctaacctgtgatttttatcagaccgggtgccagcattctagaacattagaacagggtatttggagataaacacgggcgtgcgtgtgcatcacacacacaggtgcatacacacaaacacacaggtgcatacacacacacaggtgcatatgcacaaacacaggtgcatacacacataggtgcatacacacataggtgcatacacaggtacatacacacataggtgcatacacacaggtgcataacaggtgcatacacacgcatacacacatacataggtccatacacacagatacatacacacaggtgcatacacatacataggtccatacacacacacacacataggtgcatacacacaggtgcatacacaggtgcatacacacgcatacacacatacataggtccatacacacaggtacatgcacacataggtgcatacacacacataggtgcatacacacaggtgcacacacaggtgcatacacacacacgtaggtgcatacacacacacaggtgcatacacacaaacacacaggtgcatacacacacacaggtgcatgtacatacaggtgtggttatcttaacgtttcattagaagttcttaacaaacatgttgtaagacaaaagcacctagaaccctcagggcaggagctcagggtttctgaaggtttcgtgcgggagccttgagcttgcccagggactgtagcttttgtacaggtgcgtgcctgtctgcgttcagttctcactgccttcgtaacaacgacctattcacgttttcatagtgggcaccgatgagagtctcgttgtgaggaggaaggaaggtgtcgaaaacccttcttgcaacctccgagaatctgcaaccatggaaactgtgtaaagagcttcatccctccctccccttctgttgacagagagaaccatgccgtttcctgagatgaggtggacgggttttgaatccgctggagcctgtcctctcagggcctttgaaacagggaggaagccgtgctctgcagacggcacctgcagggtgaggacaggattctgggccatcttcctgtctcataggcttgcctgttactagctatgcttttagctttggatgttcagaaaaactttttctcacaaagggcaggtcgccttcgtaagcctttcaaatctgggatttcagaaaagccattatgtttgctcatggaagacacatttttatcctaaaacaagccgtctgaacaaatgtatgtttagtgagaatgaaaagtgaagagatttttatgaaaattttgcataaaggtcttctgggcattttaggagcctttagaggttgatggtaagattgtgtcccgacagcagagggacggtggagattcgggtgccgtgaggggcttcatcggcccagatggcaatgttgtctcttcagagtaggaatttggggggaacaggctgaaaacaggcctcgcagattccgtgctggcctgtggtgcaaaaacaatgctatgacggccccgtccctgtacacagtagtgtatagacagccctgtggtggtcctgtcaagtgtggacggcccgtccctgtacacagtagtgtatagacagccccatggcggccccactgtagacggcccgtccctgcatacagtagtgtatagacagccccatggtggccccactgggtgtggatggcccgtccctgtacacagtagtgtatagacagccccacggcggacccactgggtgtggacggcccgtccctgcatacagtagtgtatagacagccccatggtggccccactgggtgtggacggcccgtccctgtacacagtagtgtatagacagccccatggtggccccactgggtgtggacggcccgtccctgtacacagtagtgtatagacagccccatggcggccccactgggtgtggacggcccgtccctgcatacagtagtgtatagacagccccatggcggccccactgtagacggcccgtccctgtacacagtagtgtatagacagccccatggtggccccactgggtgtggacggcccgtccctgtacacagtagtgtatagacagccccatggcggccccactgtggacggcccgtccctgtacacagtagtgtatagacagccccatggtggccccactgggtgtggacggcccgtccctgtacacagtagtgtatagacagccccatggcggccccactgtggacggcccgtccctgcatacagtagtgtatagacagccccatggcggccccactgggtgtggacggcccgtccctgtacacagtagtgtatagacagccccatggcggccccactgtggacggcccgtccctgcatacagtagtgtatagacagccccatggtggccccactgggtgtggacggcccgtccctgtacacagtagtgtatagacagccccatggcggccccactgtggacggcccgtccctgcatacagtagtgtatagacagccccatggtggccccactgggtgtggacggcccgtccctgtacacagtagtgtatagacagccccatggcggccccactgggtgtggacggcccgtccctgcatacagtagtgtatagacagccccatggcggccccactgggtgtggacggcccgtccctgcatacagtagtgtatagacagccccatggcggccccactgggtgtggacggcccgtccctgcatacagtagtgtatagacagccccatggcggccccactgtggacggcccgtccctgtatacagtagtgtatagacagccccatggcggccccactgtggacggcccgtccctgtacacagtagtgtatagacagccccatggtggccccactgggtgtggacggcccgtccctgtacacagtagtgtatagacagccccatggtggccccactgggtgtggatggcccgtccctgcatacagtagtgtatagacagccccatggcggccccactgggtgtggacggcccgtccctgcatacagtagtgtatagacagccccatggcggccccactgggtgtggacggcccgtccctgcatacagtagtgtatagacagccccatggcggccccactgtggacggcccgtccctgtacacggtagtggatggccccatgggggctctgtcgagtgtggacagccctgtccctcccccatccggtgtagacagccctgtggctgcactgggggcgggtggtgcgggttctgcatcgggacaggacgcaagggctccaggggggcagtgggactgcatccagaggtggttcgagggctccaggtcagagtctaaatctctgcctatgtgtgcacttcaggattttgaggctgttttccaaaagtcttttttttttttttttcctttttgagacgaagtctcgctcttgtcccccaggctgcagtgcagtggcgcaatctcggctcactgcaacctctgccttctgagttcaagcgattcttctccctcagcctcccaagtagctgggatgacaggcacccgccaccatgcccagctaattttgtatttttagtagagacagggtttcaccatgttggcctggctggtctcgaactcctgacctcatgatctgcctgccttgacctcccaaagtgctgggattacaggcatgagccactgtgcctggctgtgttccaaaagtcttgtacggaaagaggaaacctggcagtaaagtccacaggggtgtgtgtcacccgccgtggcaggacagggcgtgtgtcacctggcgtggcaggacagggcatgttgcctgagtgtgaggatcgcgcccgttggctcgcttcccccgcattttgggtttgatctttgactttcggagggagatcacaggaggttggctcccaatctggttcccctagctgcgtttgggaggccgtccgtgtgtagtgctgatatgaactgaaggggcggcacctctgccctgtgagtttgcgccccacatcgtgggtgactgggcggcacctctgtcctgtgagtttgcgccccgcatcgtgggtgacgggacggcacctctgccctgtgagtttgtgccccacatcatgggttactgggccgcacctctgccctgtgagtttgcatcctgcatcgtgggtgactgggcggcacctctgccctgtgagtttgcatcctgcatcgtgggtgactgggcagcacctctgccctgtgagtttgcgccccgcatcgtgggtgactgggcggcacctctgccctgtgagtttgcgccccgcatcgtgggttactgggtgcacttgtttaaatcgtctcctggtggtttgagcacattccctctggtgctgtcttaaagcttccctttggagacttaccgggggtcagaggccgacttctgaatcctcaaggacagtaaggaagtgagaaggatggagggatccgaggatggctggagaagggaaggaggtggaagagaaggaagtggagaggggcgtacccctaagaagagttggaaggggccttgcgggtggggggctgtggtgggcgtcagaggtggtgtggaaggttgcaggagaagaaaaggccagtctgagatggctgcagacttctggttccaagtctaggacactcggaaaaaggaaaacgatggagacaggaaacagatcggggcttgcgggggttgggtgcgtcagtgccacacagacgtttttcagggcagggaaactcctctgcgtgaccccacagtggtagatccgtgtcatcctgcgtttttccagactcaacagagcgtgcggcagcgggagagcccagtgcacgctgttgactcggggtgatagtgacccgtccaaggaggtttattgactgtaacagatgcaggcggtcacgcaggaccttcctgatcggggacccgggaggctttctgctgacagcgttcagcctggcagggatgtggccagtttctgaccctcagcccgaaggtatcctgtctccttcccggtgggatcgaggtgcaggcccccggaatgtcagctcaccctcatttaaagttgcccgtcccccttttccaccgcccctcttttcttgttctaaatacgattgcaaacaagcgcagttatcacagtgagcagtggcagagaagacgagatcctggatgcccactgcagcttagctgtattctagaaactcctgaagtttggggaggggcggagatgccggcgcgctttgatgccgggctgccgggatgtctgggctgccgtgcgtgtttgtggaggcgcagctgcacctggcgtgccctgtgctctggaggggcaagccggagtcggcaccgagcctgcagccagctctggtgttgtcgtggaggggggggacctcacttctcgcggggagcgccttcgcctgggtccccgaggccgtccccaggctctcttctcggggacctgttgatgcgcgttccgcccaggctctcctctcggggacctgttgatgcgcgttccgcccaggctctcctctcggggacctgttgatgcgcgctccagggcgagccacgtgacggctgccgcggtgcagaaagcgcccccttgcccggccggacggcccagcccggagcgaacggggagaggagagaagaggaccggagggagcggagggcagtgcagggagcggagaaggaggagaggagagcagcgccgggagcagccgggtctgcacagtcgcgggtcgggagaggcggccgcccccacccccggcgccatgcgccctcctcagcctgaggaatgcgcgcggcgcgggccccggccccagagcgcctggcgggcgacgcatggagcgcgctgagcccgggccacgcctgcagcgccccgccggccccggcccggccctgccccgagagcgcggcgcccggcccggcccgcggagagccctgcgcgccggcggcatgcgactccgcgagcgctcgctgcgccaggaccccgacctgcgccaggagctggcctcactggcccgcggctgcgacttcgtgctgccctctcggttcaagaagcggctgaaggccttccagcaggtcagccccgcgcgccccgcggctgcccgacaccgggcgaggcctcccggcccggcgagccctgccctcccggccccgcgtgggcccccgctcgccgctgctggccgtgcacccgttgttgcgtggcggggcccaaacgccagatttacagggccagttgtgggcgcaggggacccgctcgggccgcacgccgccgaaaaccgggtgctgctctgtgggaagcggtgccaagcttgttaggaaaaccgggctttgaaaagagcactcgctcctttcccgggagttttggctgtgagtgcgcgccttgctgtgatcaaccaaggcgggtgagagccgtcagcgcctgggagtgttcgctgcagacagatttttaatttaaatataccttgcattgctggtaataaacatcgggaaactccttcacccttcgtaaaggcgtcgggtgggtgaaactttcccggcgttattgcaatacccagcattccttcccactggctaacttaagagtcggttgagatatcactcacataccggactatttatgcagcgtggttttattcagtaactcagtggctttgaaatttatttatttatatttatttatttgagacgaagcctctctgtttcccaggctggagtgcagcggcgctatctcggctcactgcaacctccacctcctgggttcaagtgattttcctgcttcagcctcccgagtagggctaatttttgcatttttagtagggacggggtttcaccatgttggccaggctggtcttgaactcctgacctcaggtgatcgcccacctgggccttccaaagtgctgggagtaggggcgtgagcctccaccccagctggctttgaaatttaatctcagttctcataagtgctcagggaagtaaaatttgtgtctgtaccccgtgtatattgtatgagttagttttacgagtaccatgtgatttaaacgtgtaagagtcttcctgtgacaatcccagtataatttgagaatttagggtttggctgcggccgaatctgatccgaatttcatccagacagggtgtgcgtggcgggcgcctcacacccacgtggcacatcagacgcgcttttcaaactcagttccaggagtctggaactagtggcctaacatcaaggtgaaccaaggcatcctgcttgaagggggaggaagacccacttctttctgttgatattttaattgaaattttttctgtaagatctcacatcaacttttgcactccttcggagtttttgacctctgtcttccaggttttgacattttgcctgtaagtgggtaagggcgaggctggtgtctttaaaatcctcttaacctgcgaagagcgagatcagcctcgtgcgggatttgctctagatggtgggaggtgctgggcggtgcgggctcgctggtcgcagagtcaatgaggtgattagctcgcacgtggctggatgaggaagcccttcagccctgcagtggggccctggctcttctgtggggggctgtggtgacgatgcacctgtgaggactgtttatttttaaaaagtcagtttctgggaaatcatgaattccgtttacagaagtttgcttcattttacagaaaataggtttccacgtttttagggagtgaggacagacgtgtgaaatgcatgttgtctgaggggtggtggaggaattacaggcatatttgggggtatttgtgggggtggtgttgggggagaaggggacgtttcctggctgctttcactccgcgcatgagtgtgggctctgtctgttgggtccaccccacttggacacaccctcagggttgtcagggagcacccgtgttggagccactggacgtgttggggtgccgcacctccgccttcggacgctcccggccgggcagcacggtactgttttcaggggtcctctgacgggcacagccttccacggccaacgttggccgcacccacgagcccctggcgggtgctcctgagcttgatcttctgactgtgcgacgtcccacctgggcttctgttcccactaaccccctggcgggtgctgcctgccccgatggtgaacccaagctcctcctcctccctgccactgcccacttccctgtcaccggcatccttgacaaaccaaactcggggggtgggggcgttcagcgaccgccggccttgggaacggaacagcatgcgttcacgccgtgggtccggggaggctcccgtgtgacgatggcgtgttacacgtactctcaccgtgggtccggggaggctcccgtgtgacgatggcgtgttacacggctcatgctctcactgtaggacccagcatgtacctggagtggggccgtgcagctgcttggctgagctcttcttgccggagccactgcctgcgcctcctgcccagggattctcgggccttctgtccccgggcaacagcaggacagctcagaccttgttcccagcccaggacagctgtgctgcctagcctggccctccccgcctggggagtgactctcccgctccccacacactgactcagcacacagacgcccctcttcacctgtcctggtcacacagacactgtccggcgtccccacggggtccttcgggtggacgcacagaccctacacggcaccacgcatggctgaaagcgccgtcccctacgcggcagccccgctgtacttggaactgacttcagcgtggtgacagcctgggctctgggcgtccctgacgcacctcctgctctcaccgccagggcacgtgccgttcccctcccaaggccagtggtcaccaaaacccttgcagcctttggtttggccaggacgctgcccaggatgccactccctgggcagtggcagggagaaggcagggcttgggttccccacctggcagggagctgcagcaaggggggttaacgggaaacagaagcccgggtgggaacgtccacacagaagaccaagctcaggagcatccgccaggggcttgtggacgcagggagggtgccggatcctcccctcgctgtgttgcgcggcatccaccgtcaccccttggctggtggacagaatgatccccacgtcccccagcccagccttccgagctctgtggagactcacgcctcgctgcagccgtggctgcaggcgccagtgcctgggctgcaggtgtgggtgcaggccccagccgacgtctctcagcgtccgttgaggcccggttgctcggctgcagtcatgtgtctgagtgaatgttagcccacgtgagctctggcctactcagacacctgcacctgctgcgtttctgtgttgacccctccacaccagttctccctctttgctagagaggggatttttaaacccacacgtggggcctctcatctccgtgttcggctcctctgtgtaaacaccgacctttttgactcctgtgtttagccgtccagcgtgcggtttgcaggtgtagctggcagccctctaccagccctctcagagggtccctgggagtcaagtgctgggccgagaagaatgctcagagcttgcagcaggccctgccttccagggggtggccgtcatctgggtgggcgaggggctcagctggaatccatgagtgtgcgtcccggccaaaccccccgtccctgattccataccacagcctcccgtgcttccgcctcccgctgcagagtgggggccgctgcagagcgggggctcctgggggcacggctgtgcgttgcagcccgtactgagcgtcccttccgccggccccctgctgctccggcacctcctctgtggctttgatcgtggtgtccggtcctgctgccgtgggggcgagggtcatttctgctggtcaccgcgccctgcctgctgtgcgcaccctctgcacatgcgggggtctgcccgaggctggtgtcgcgagaggatgtgtcacggtgcacgtggcctgtgttctcggggtacactcacctgcacccatcaagcgcacgcacttctacgcaaaaacaggcagcctcagtgttaggctcagcctttgtttttggtcgtatatggacgtgttttgcaaaactgtgggtgtactctggaagggcgacacatgtatctgtgacttctggaattgtgatgagtcagggagctgccttctcagtgccctcaacagaaatagcttgttgggagtcagggtgtcgcctttatcagtgcgctttgggtgacgggctctttacgaagttctttttaaagtacacgtactgaggaggatttaaagtggatgacctggccgccacaggcccctctggtttgtctgaactttttaatgaacaggcggctggctttagaattcttcttccacatacatgcagctgtttttgctccttctgtgtttaccgtagatgcctggcctcaccggctacgtttggggcagggcagcagtccctgtgattccttcagaaccccctgagacctgcagctcagcccgagaggtggccagttcccaagtgagctgtgtgtgttgaaaagaatgtgtgctctgcagctgtgctggggccgagtctatttctgtccatgagattaagcttgtaaatcttctgtgcccgcatggggtggttgtgttgtttgttccatctctcgtctattagtgcccatggtgggtggtcccggctttccccccgtcggtgcccagggtgggtggtcctggccttcccccggtcggtgcccaaggtgggtggtcccggccttccccccgtcagtgcccggggtgggtggtcccggccttccccgtgtcggtgcccaaggtgggtggtcccggccttccccccgtcggtgcccaaggtgggtggtcccggccttccccccgtcggtgcccagggtgggtggtcccggccttcccccggtcggtgcccagggtgggtggtcccggccttccccccgtcggtgcccagggtgggtggtcccggccttcccccggtcggtgcccggggtgggtggtcccggccttccccccgtcggtgcccggggtgggtggtcccgtccttccccccgtcggtgcccaaggtgggtggtcccggccttccccccgtcggtgcccggggtgggtggtcccggccttcccccccgtcagtgcccggggtgggtggtcccggccttccccgtgtcggtgcccaaggtgggtggtcccggccttccccccgtcggtgcccggggtgggtggtcccggccttccccgtgtcggtgcccaaggtgggtggtcccggccttccccccgtcggtgcccaaggtgggtggtcccggccttccccgtgtctgtgcccggggtgggtggtcccggccttccccccgtcagtgcccggggtgggtgatcccggccttccccccgtcagtgcccaaggtgggtggtcccggccttccccgtgtctgtgcccagggtgggtggtcccggccttccctgtgtctgtgcccggggtgggtgggctccgccttgcctagcgggctcagtttgtgtccagtggtgtttacttgatcagtgccgaggctgcgttgtcaggcatggataaagttagcatcagcctgtcttcccctgactgacctcttcagcgttccttggtggcctgtctgtctccaggtctgtccatcaccttgtgtcacttcatggatgttaatacagcgacaccagctttctctactgtctgcctgctctttttccatctcaaaaaaaaatgtgtagcctctgggtccttaagtcacatatatctcctgtctttctgtcctctgtgtctcccatgtacgtgaatgctgttttctttctgcagtcagacctttgtcttgtaactagagcactcggtgcattgaggtcgatgttgcctgctcatccgtgtgatggactgtgaccgtctcatcctgcacctctgtctcctgctctttttcagcttggtcgccttttctctcgtttggagtacacgcttcctactagctcactgtttatcctacaaatgtcaatggctggccgggcacggggcctcacacctgtgatcccagcgccttgggaggctgaggcaggagaatcgctggaggccaggagttcaagaccagccagcacaacatagcgagaccccgtctctataaagaaaaaaaaaaggaacgtcgactaaatttttcaaagcccaatattaatcagtatcttttcctccaactcacaaaccgtctcacactcatccagtcagcatgtcactgacaggctgttgtattgactttttttttttaattgaacatacgttgttttcactgatttatgttttttaaattgaacatacattgttatcactgatttatgtggtcagctgccgaggttttcccactcattaccgctgacctgctcttcatcccttctttcaattccaaccttccctttgggagctcttggcttctccctgctgcatttcctcagcttttgccccgtagagtgtctgttaatggggtgcatgctctgtaaatttggggctaaaaatgtccaagtattcatctcacttttttttttttgagacagagtctcactctgtcacccaggctggaggacagtggtgcgacctcagctcaccgcaccctccgcctcccgggtttaagcgattctcctgcctcagcctctcaagtagctgggattacaggcatgcgccaccacacctggttaatcgtttgttttgttttgagacagagtctcactctgtcgcccaggctggagtgcagtagtgcgatctcagctcactgcaacctctgcctcctgtgttgaagcgattctcctgcctcagcctctcaagtagctgggattacaggcatgcgccaccacacctggttaatcgtttgttttgttttgagacagagtctcactctgtcgcccaggctggagtgcagtggtgcgatctcagctcactgcaacctctgcctcctgtgttgaagcgattctcctgcctcagcctcccgagtagctgggagtacaggcaccctccaccacacctggttaatcgtttgttttgttttgagacagagtctcactctgtcgcccaggctggagtgcagtagtgcgatctcagctcactgcaccctccgcctcctgtgttgaagcgattctcctgcctcagcctctcgagtagctgggagtacaggcaccctccaccacacctggttaatcgtttgttttgttttgagacagagtctcactctgtcgcccaggctggagtgcagtagtgcgatctcagctcactgcaccctccgcctcctgtgttgaagcgattctcctgcctcagcctctcgagtagctgggagtacaggcatgcgccaccacacctggttaatcgtttgttttgttttgagacagagtctcactctgtcgcccaggctggagtgcagtagtgcgatctcagctcactgcaacctctgcctcctgtgttgaagcgattctcctgcctcagcctctcaagtagctgggattacaggcatgtgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctcccgagtagctgggattacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctctccagtagctgggattacaggcatgcgccaccacacctggttaatcgtttgttttgttttgagacagagtctcactctgtcgcccaggctggagtgcagtagtgcgatctcagctcactgcaacctccgcctcctgtgttgaagcgattctcctgcctcagcctcccgagtagctgggattacaggcatgcgccaccacacctggttaatcgtttgttttgttttgagacagagtctcactctgtcgcccaggctggagtgcagtagtgcgatctcagctcactgcaacctccgcctcctgtgttgaagcgattctcctgcctcagcctctcgagtagctgggagtacaggcatgcgccaccacacctggttaatcgtttgttttgttttgagacagagtctcactctgtcgcccaggctggagtgcagtggtgcgatctcagctcactgcaccctccgcctcctgtgttgaagcgattctcctgcctcagcctctcgagtagctgggagtacaggcatgcgccaccacacctggttaatcgtttgttttgttttgagacagagtctcactctgtcgcccaggctggagtgcagtagtgcgatctcagctcactgcaacctccgcctcctgtgttgaagcgattctcctgcctcagcctctcaagtagctgggattacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctctccagtagctgggattacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctcccgagtagctgggagtacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctcccgagtagctgggagtacaggcaccctccaccacacccggctaattttttttatactctttttgttttttgttttctgtttttttttttttgttttttttttttttagtagagatgaagttttgccatgttgcccaggctggtcttgaactcctcagctcagacagtctgtccccctcagcctcctttcaaagcgccaggattgcaggcacgagcccggccggtttgagggttttcgcagcatcctggtgaccgtgagtttggtttgcaaacctgcaggagagtcggctgtagccgtcagttctcgggggagaactcccccctgcccagctcgtaccagcagctccaggtgaaggctgctactttcattcctggggccggaggcgcgctggggatttacttggagctcattcttcccactgaaggtgacgcgttctgggagcttccccggaggaccctgcgttttgcctcctcttccccagagctctgcaaggctgtgagagatttcgggtgagcccgctcggcccacgcttctgaaggcagagcctgttcaggctccacgggcttccccgggttcttccttccaggcagctgtggcctgaggtgtcctcctttcctgccagcctgtgggcgccgtctagaagacgtttgtcaactattctgtccagggttcttggcagttttcatcaggaaggttggtttgtgtacccaggtcattgctatattgccaaacacaggagcccgagagctcactgcagaatattcgcggggtcagttccgtaccccaaatagcagagctgtgtgaacccagcgtgatgaaggaggaagagccgcaggctccacagtgggacccccacagcgagagacgggaaggcgccgctgcgggaatgcgttgtgggctcgggaagatgcactgtgggatcgcgggcttggggagatgcattgtgggatggtgggcacagggagatgactgtgggatggtgggctcggggagatgcattgtgggattgcgggcacggggagatgcattgtgggatcgtggactcatggagatgcactgcgggatcgcgggctcggggagatgcactgcgggatcgcgggctcggggagatgcattgtgggatgctgggctcggggagatgcattgtgggatggtgggctcggggagatgcattgtgggatcgcgggctcggggagatgcactgtgggattgcgggctcggggagatgcactgtgggatggtgggctcggagagatgcactgcgggatggtgggctcggggagatgcactgtgggatggtgggctcggggagatgcactgcgggatcgtgggctcggggagatgcactgcgggatcatgggctcggggagatgcactgtgggatcgcgggctcggggagatgcagggacctcctgccccaggacacagaggtcacgttctgaatcacagggaaggggtgtgcccttaggtaaagctgtgctgaaggagcactcagtcggcagctactgcgggaagcctgctctgccccaggtcacggaggcggcctctgttcctcctacatggggatcagagaaaaacaactgagtctcaccgtgggtgagggtcctgcagcgacagcagggtgggcacagttgaggcgctgtcagtgggacccttgtgacctggggtgagggtcctgtgggagtagcagggtggggacagttggggcgctgtgggacccttgtgacctgcggtgaggatactgtggcagtagcagggtggggacagttggggtgctgtctgtgggacccttgtgacctggggtgagggtcctgtgggagtagcagggcgggctgttttctctgtgtggacactggagcttggacccagtcctggattgatccaggcagtcaggattgtgggtgcaaaggccctgagctgtggtccactggtatgcggacttcctccctggacccctcctccatggcagttggttgaggaggacacagccccgtcccctgagtagttgatggaggaggaggaggacgcagccccattccctaggtagttggtcaaggaggacacagccctgtcccctgagtagttgatgggggaggacgaagcctcgtcccgagtagttgatggggaaggacacagccccgttccctgggtagttggaggaggaggaggacgcagccccgtcccttcagtagttgatggtgggggaggacgcagcaccgtcccttgggcagttgatggaggaggacgcagtacggttgctgatgctgttaactgtttcagatggtgttttaacatcacgggatgagatcaaatgtccacctcgcaggttgtgtagagatgcaagcaggagactcttgagtgagtgttctggggcctgcagatatactgggtgaggagagtgctggtgctgagtggggccaagagcccgtgggcgtgggctgtgcaccgggtgaggggctgaggcgtgtccgcagcagtacctggtggtcgaccccttctcctggctgtgtggttgcctgccctgcctctgcctctcagaatgtgagtcttccgggctccagggacagggttgcctgtggacggcacctgtgcctctccacgtctgagctctcaggcgtctggggtgcgtggctgcccttttccccaggtccctgccaggtgtggtggggtcagtggtgtggctcatgggaatcgggagtgggtcctggctgggctctcaggtgcctggggcacgtagctgcccttgtccccagggccctgctcggtgtgatgggggctcagtggcgcagagccgccacccagagtggggtccatggcagcatggtgtggcctcctgggtgaaggtgggccctgcagtggagtacgtgtgtggtcccccgcagggattgcagtgtgtcctctcccggctgggatcaggtggcctcagcactgtcggccctagagaggccccgtgtgttgtccgggtgaagaaggcgttcgatgctcccaggttctaactgagcgctgtctgtcgactcttcaggttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggtacgtgtcacgcgtgggacgtggagcagccgaggtggtactgcgggcatgtgagggtgaggcggagcggccgtggtgggtgcgtgtcacacgagcgtgagtgaggcggcacggccgaggagggtgcgtttcacacgtgtgcgggagcggcccaggttttctctgaggttatagttgtggtctgaggtttgctgtctggttgctgctgtgtgaattcttaagcatctgaaatgcgagtgggaattccgtctgcattctcatcctgatgctgtgaagagcgcaggcccgccctgtgccaccctccccttctctcccctccggggccagtggcgccagctctcgtggctctcggaggccgttctgcaccctcctggccttgcccctttctgcccgaggagcggccatcccaggctgggcagctgtggacccgtctcctggcagcagccccatgggcccatttctagactcaccctgagtgctgcggcgcggcgtgcatcattcgccgcctgctttccttctcagctgcatgctctccaggctgaccgcctggacgcccacagatggagcacactcagtttagtgtctgtccgttaccaaggcaaggcctacaccagagatgcgtgtctggacccctggtgggtggttgtgtttccagggacctgtgcccgcatctccagcctcctaccctccaggtggagtcgctggccagtggatgctcccacccctccaagtcagagccccagagcctcggtgcacggtacatgtgagcccctcacggtgagacccctgccccccagccctctccagctctgcagctgtgaagggggtcctcgggagtgagcaggtttttgttttttgggtttgcttgtttgagacaaagtcttgctctgtcacccaggctggagtgcagtggtgtaatctcggctcactgcaacctccaccttctgggttcaagtgattctcctgcctcagcctcccaagtagctgggactataggcatgcaccaccatgcctggctaatttttatatttttagtagacatggggtttcaccatattggccaggctggtcttgaactcctgacttcaagtgatccgcctgcctcggcctcccaaagtgctgggattacaggcatgagccactgcacctggccgggttttgtttttttaacttattaatacagtctattaaatgagttggttttgggatgttaaaccaaccttgcattcctgggataaattccgcatggtcgctgtgtctcatcttttttatatgttgctggattccaataattttgcaactggattcacagagaagacagtgcttggtagttttcttgtgagtcctttgtctggttttggttttagggcaatacgggtctgaaagaacacattaagtgtccccgccctttttctattagggattgtgtttttaaagtattttaaaaagttttgttttataaatatgtaaaaacctccatggttacaaagtgagcactaacaaactagacacattcaggtaagtccaggttctgtccctgtctgtgctgtttctaccccagaggtaatagtttccatagctttggtttatcctcttattgttattttagcttttaatatgagcaattatgtacaaatatgtgtatgagtatgaacatacatacttcttgcatttcttagagaaaaattagcatgctgttgtacacttgcatatttgtttttgctaagtcactccgtatttgtagaggtgtccctgtcttgtacggcagtgtggggccatgaaaggaccagataagtcacaaccatgcaaaaccatcttccagtaaaaattaggatcattctataatcatttttgttgaaatattagaaactttcttacagtcggttgcaaacatgtagtgaatgaaaagaactaatatttacctagtatgctgtaacttaaaacaccagaagcattaagaattgtttcatctctcagtaaaaacttgccaaaagtagttacagcagtgccatctccttgtcccgtgtggagtgagcacctgctccgtgccctggcagactcactcgacttaacacgccttgctcagcttccgcgttttatccttggtgctcttgaagttgtggggtatctctgagagttccttcactgggaggtctctttgctggcattccgtctgctgggacaccttcatccttttcagtacagcctccgttgtgtggagaactcaccctcgcggagtgcgcccggccccacccacagggtctctgcgcgcctcgggctgggtcagacacctcttttgcagctcacgcgctgcgtccgcttcgggtcctacaaagccgctcgcgcagcccagtgaggttcctgcatgggacccatgtattcccctcagtgcttccccgccacgatgcccctccccggccgcggtgcttccccgccagggcgccgccccgccctcccctacccccgccgcggtgcttccccgccagggcgcccgtccccacggtgcttccccgccacagcgcccctccccacgcggtgcttcatccccacggtgcttctccccaacggcgcctccccccaccgtggtgccgccccccacagcggccaccccccctccgcggtgcttccccgcctcggcgcctggttctcatgtgcgcgtttcatgtcattttccttccaggactcagttctcggtgtcacctcgcttccacgcacagcggcactggccttggtggccgtctaaggtagtgaggctttaagacttgaaagaacctggtccgttggctggatgtcacgtttggtggtaaaaagcaagttttgtcgttgtcttcgacgccccagagaagcagggtgacctgggtgtgacccagcggggcaggggagagctctgagactgaagttgtgtcgcttgcagcgtctgcaccgctgggagtccgagagacacctccacaggccccactgtgcctgcacgcaccgacccggccctgcaggcggagagcatggtgctcgagcacccaccgtgactgtgggcagaggccagcagggtgtgcgctgtcgcgacttaatccacctgcgctgtggcggcagaaccctgtgagcgtcccgcgtgtgtgggggccgcaggcaaacttcagcttccccgccaaggctgctgagcctgtctcggtggcgcccagctcgccgccacctgcagatgtccgtccacgtctccatcgtgtgcctttgggacggttttctgtgagccgggcccccggcccaggggacgaacgagtaggggtgtcactgccgtttcgagttctccccgtcgcgtgagtgactgaatgagggcctggagtcacagctccacacgcgtgttgtcaggcgggtggactttggccggcggctgcttgagaactcacgtctgaggggactttgagtttgatgaggggggtccccccgtggatcttagccgtggccgtgcagcgaggtccgtgtgtgccttctcctggcccggttcttcctgtctgtgtgagtcagggctgatctcatacatcatttcctccctttcatcattgtcactcctctgtgttttctctgaagccgtttgagacagagtcatcagctccttcacctccaccaaactccaccccctcagctgcccccacaggaaaacacacttttctctttgttaatttccttcaaacgttgttggctaattcagggttttcatttatggagactattttgatgatttacattttttctaaaaattttttgcgtaacttagaaatttcttgctctaaagcttttccttgtcttgtacgatttacaaaatcttgatcgtatctgcatcatacatagacactttcttgacagaatcatttatttccggttcctttcttgatccgtcatgctacacactaacgtatatctctttcagtaaagcagctgtcagtgttacagattatttcagttctttctctcatgaatatctatggtcatcttttttacatacacttccttctgtcattttttttagtttattgaatagttttttgtttggccagctgtattgtcatataattacacaccctaagattcaccaattttaagtgtacaatttgatccattttggtaaagcacacacctgggtatccatcctcataggcaggaccggccgtttgtcacctgccgcgggtgtcccacgtgcctccttttgcacctcatcattcccctcttttctccctggcccgggccagctgcagatgtgcttccggtcgctgtagctttgcctctcttagaatttcacatgaggactcttggagcattttgtctgtggtttctaacttcttcctggcagcatctttattttaaattttattttgaatggacaagtaatatttgtgtatacagggtacagcaagatgtttcgctatgtgtgtgtgttgaggactgattaagtcctgtggtgtggatactgtggggctcgctgtgtggctggcgaaggcgtggttaccgtggggctcgctgtgtggctggcggggtgtggatactgtggggctcgctgtgtggctggccaaggcgtggttaccgtggggctcccgtgtggctggccagggtgtggatactgtggggctcactatgtgtccctggccgtatgggcagtttcttttctatcactgagtagcttctgctgtgtgtgtgctccatctctcccctgttccagggttgatagacgtctggttgctttggtttttgcttcttgtgagtaaagctgctgtgtgtctgtgcactgatttacgcagacatgcttgcattttcctgaggtgattaataccgcagaggtgagctctgcctcatctggtggccacatgtttagttttgtaagaagctataaaactgcttccagggcccaggagtggtggctcactccactaatcccagcacttcgggaggctgaggtaggcagatcacctgaggtcaggagttcgaggccagcctggccaacatgatgaaaccacatctctactaaaaatacaaaaattagccaggtatggtggcgggcacctgtcattccagctactcgggaggctgagacaggaaaatcgcttgaacctgggaggtggaggttgcagtgagccaagatcgcaccactgcactccagcctgggcgactgagcaagactgtgtctctacgcaaaaaaacaaaaaacaaaaaaccctgcttccggggtggccctgagtgacgcatttccaggcagcagcgttgacccctgcgggcacgtggccacacgctttgcctttagccgttctgtgcgtgtgcaggcgtcccgtcctggctgcactcctcatttccctgatgtacgtgttgaccaccttacgtgtttctttctcatcagtttgcctttttttcattttggggcagctgtgttgagatataactgatgtgggatgcatggtgcgtgtggaaggtacaattcaatgagctttgacgtctgtacccacccatgaaactatccacagcaccaagacaataggcgtccctgcatccttgcgcttgagcgggcacgtgcgctggacttttctctgctgctttctgacgcgcacctgccctcatcccacgctacctcaggcctcctttctgtcaatatagattagccggaattttctggaattttatgtaaacagaatcagacagcaggcacttttttttattatgggaaaattcacacaacagaattcaccaccgtaaccatttggagcacagaactcggagacgtttgtggcatatacagcacggtgttccatgtgcgtgtgtggagggccggatcgcgtggtgttccgtgtgcgcgtgcagttccacttccggctttctggggaacctgcacgctgtcttcccgagtggctgcaccgttgttcgttcccaccgtgtgaattttagagccggtccctccgttgctacgacagcctgctgggattacatgggcatcctgttgactccagatgaacttggaagaatcttgaccatattgaggcttccgtctcatgaacgcggtccagctctcccttatttcaggcatctttcacttctttcagtacgccttgtagtttggtcttgttcacggttcatcacattgatacccaagcatttcctgtttctgatgacactgtacgtggtatttttttactttaatatgattgtcaattgtgaatgttgagaagcactgttaggttttatatgtggactttgcattttctgaccaagtttaactcagtcatcggctctaccagctcaacctttaagtccggcagagtctctaacgcacggtcaggtcatcttcaggtgagcacagttcagcctttctcttctcgtctgcatcggtgtctcctccctgactttctgtacacaggctcggcctgccagtgcagtgctggagagccgtggagagcacgccccttcccgcctcgggctcaagtcgtccgtgacgcagcggccctgcctggcgtccttcatcagactcaggaggccccttcccttttggtttcttgtttgctgggagctcttgtgttttttttgagacaggttctcattctgcccccgggctggagtgcagtggcatgatctcagctcactgcagcctcgacctcctgggctccagtgatccacccacctcagccctcccgagtagccgtgactactggcacccgccaccacacctggctgattttttcttttttggtagagacagggttctgctatgttgcccaggctggtctggaactcctgggctggaaggatcctcttgcctcagcctctcatggtgctgggatgatgacaggcatgagccatcacgcctggcctcagtttactttttaaaattataaaagtgccttgaagtttgtccgggatgctaaatgtgtatttctgcgtgtattgagagggcagtgaggttttcctttggtcctgtaaaaggtgaatggacctgactgacgtctgagtgtgaaggcagccccggtccttgggtgagcccccggtccctgttccaccgcagcgtgcattgcccggccacgcaggggtagcgtctgtggtcatgaaggactggtcttgacctgactgacgtctgagtgtgaaggcagccccggtgtttgggtgagcccctggtgtttgggtgagcccccagtgtttgggtgagcccccggtccctgggtgagcccccggtccctgggtgagcccccggtgtttgggtgagcccctagtccctgggtgagcccccggtgtttgggtgagcccccagtctttgggtgagccccctgtgtttgggcgagcccctggtccctgggtgagccccggtctttgggcgagccccggtctttgggtgagcccctggtccctgggcgagcccctgctccctgggtgagccccggtctttggatgagccctggtctttgggtgagccctggtctttgggtgagcccctgctccctgggtgagcccccggtccctgggcgagccccagtctttgggtgagcccccggtctttgggtgagccctggtctttgggtgagcccccggtccctgggcgagccccggtctttgggcgagcccctgctccttgggtgagccccagtctttgggtgagccccggtctttgggtgagcccccggtctttgggtgagcccccagcccccggtccctggtccaccacacagtgtcacacttctcctatgtgttgggtccacattgccaggcctcgcaggggttgcgtctgcgctcgtgaaggactggcctgcggtctccttttcttgtgatagcttggtctggtttagcatcggggggatgctggcctcggagagttgcttggaaaatgtcctttagaattcacttttctggagccatttgtttagaatgggtgttatttttatttgaatgtttggtagaactcatcagtgaagccatttgggatagttttctctgtgggaaggtttttaatgacagcatgaattgtttcaataaacacaggctgtctgtatcatcttttctcttttttttttggagacagagtcttgctctgtcacccaagctggagtgcaatggcaccatctcacctcactgcaacctccgcctcctgggttcaagccattctcctgcctcagcctcctgggtagctgggattacaggcatgcgccaccacacccggctaatttgtgtatttttaggagagatggggtttcaccatgttggccatgctggtctcgaactcttgacctcgggtgatccacccgccttggcgtctcaaagtgctgggatgacaggcctgagccaccgcacccggccactgccacccacttttagaccatcggatctcacaagaactcaggattacgagaccagcaagggggctgtccaccctcatcacccagtcaccccccagcagagccctgctccaacactcaggatcacagttccccgtgagacttgggtgggggctccgagccacagcccaccactggttcatgtgaccctgaagactcctccggctccgcgatgtcactcgctcacatagcttggcagcgttttcacatctttacgtgtctgcagatcgtcctcttgtcccgtcacccgccgaggaacgcgtgctgaacttgccggccgtggttgtggcgtcctcctttctcctctcacacctgtcggttggtgtcggcgtgccctgtgcgactgtagacgctcgggactttgtctgcctcgcgagtccccctcagcagcaccatcacgtgggccttggggccggcggtgtttcctgctcagggagctactctgaggtcagcagagccataatggaatagggttcagcagtacacaggcagacgatccacacagagcaaggtgggcagacgatccacacagagcaaggtgtgtgagtcccacacgcatgtgctgagcgagggaagccaggtctaaaagtccgcagatggccgggtcccgttgccgtgtcctggaaaaggtgaactggagccacggggaggaggcctgggggccgtcgccgtagcggactgcggaggggccgaagggactgtcagggctggcggcctcgttccctgtcctggccgtgcgggtgggcgtgccgccgcgttgccgggccccacaaggagtcggtctttctgtgtgtcgatcacgaaaagacttttaaaagtcagatcagggtatctgatgttttattccctttcccataaggattttgtgacattcaggtaaaactgctttcctttgtatcttttgcattttagagttgattatctccatttactttaggattattttaaattatgagctaattcatttggaggtaattttcgggtttggtgtggtggggggactgtgtgcccagcactctcccgctcagttctcatcccccagacgccgggggtgcagctgtctctggttgcagtgtcatccctgtagtcccagcactttgagaggccaaggcgggaggatggcttgcggccaagggttccagaccagcctcggcaacatagtgagacttcactgtagaaattaaaaaaattacccaggcatgatagcgcgcacctgtggtcccagctacttgggaggctaaggtgggaggattgcttgagcccgtgaagttgagactgcactgagctgtgatcacacactgcactccagcctgggcaacagcaagaccgtgtctcgaaaaacaagtagaataaaaatggatcacgctgtgatcacacactgcactccagcctgggcaacagcaagaccgtgtctcgaaaaacaagtagaataaaaatggatcacgctgtgatcacacactgcactccagcctgggcaacagcaagaccgtgtctcgaaaaacaagtagaataaaaatggatcacgctgtgatcacacactgcactccagcctgcaggtctggacacatgagacgctatatcctgcacggctggatagatctgatgctccatccctgccaccgggtcatgacggtgtgtcttgcacgcggtgaggagcacagatgtgaaggctcacacatccccccatccctgggtgttgagcgcttggggtttgaaacctgcacggcctgtgagccagaatggtctcatgaggtcaaaagcgtgggactagcactagcccaaggacccggtgctgcacccggctcgttccctcccaccgcaccgggacgcccttccaggtggccagggctgagctccgtcaggatcctcatcacgggagccggcacgtgcctgtgcgtcctgcggggcccggcccctccagccgcacacggctgccttcaagtcatccacaggtgcgccagccggagcgcgtcctttcccatagcagcactgcaatccccgctgtggcgcgcagccccctctgcagtcccccacgcccccccgtggtcactcccgccctgcacctgtcaggacgactctgccacagtttattcctccagtccctgctctggcgtccggctcctctcgcctggggcaccgtgaaccaagcagccgacgtccccatctgtgcaggctctcacgggcacgggccctcttcccactggtgtgcttctgggaggacagatgtcctggccgggccacggggctttacgctcagccgccccgtgggccgctttcccggcagctgcgtggcgtcccagttcccccagcaacgcggaggacacccagctgcctggcagcctcgcgggacctggcgtcttcagtcctttttgtctcagccgcgcgtgtcatgttcttgttgccacctctccatgccctgtgaaccctgccctcgccggcgccagtgctgggcgcttccccttgtctacggccaccgtgcacccctctccggagggcagtgcatgtccactcggtcgtgttcgggcctctttctcactgatgcttaaaattctgcctctgagtccctcgtcagaatctcgccttgcagagacatttctccctctgtgtcatgtcctgtcatggtgttcaccgtgccggtagctgaccctgagtcctgcgctggggcggtgcagcggtgctcccttccttcagggagcgcacgtgtggcccgtgaaagaaaccttggccgcggcagagccgtgcagcgtccctcgtttccttccaggaggggccgctgtttggcctttcacccttcgggctgggatcccctggtattcagtttgtgtgaagtgtctttgcctgtggatattccacggggctctgtcccaactcacttccttcccttgctctcttaggccaccggtgcccgacagagactgactgagtcttcattactctgactttacaggaagggttgaaaccgggcagtgggactcatatccaccaacttggtccccctgtgagttcttttgtgttccctggtaagttttcacatgagcctgtccgtgtatactacaaaccccaaaacaacaggccctcggtgcatgtggatggggattgctggactctgtgggtggggatcgcgtggactctgggtcaacagagtcgtctggaggaaactgcagtctgtgaactcagcagtgaggtccacctcaccacgttgaggtcgtctttgatttcacccagccgtgccctgcagtttgctttgtagacactgtgtgtgatttttgttccatttttcgtaggttgatttttcatgctcttgatagatggcattattgaagattttatttttagttgtttgttgccagtatattgaaataatttatttttgcatatagtccttggatccagcaactttgctgaagatacttattaattcccgtatttggtaagcatttggattgtctacacagtgtgttgcttgtgaatcatgacggttctgcctcttcttacccgtcgtcgtatctttcggtctttcccttgcctgctgccctggctcggccgtccaggcggccttggtggtgacactgtcctcttgttcccagcacagggaagaagtgttcatgtgtcatcgctgtctgagcagctggggtgtttcgtagaggccctttgtctgagcattcaggctgctgtcaagaaacaccatagcccgggcagcttgtcaccagcaagacatttactgttcacaggtctgcaggctggaagatctcggtgtggcagagtggtgcctggttcatcgacggcgccttcccgctgcgtcctcacggggtggaaggggtgagggagctctctggggtccctcagaaggggactcatcgcattcatgaggccccacctcccaacaccatcgcctcgggggagaggatttcagcacgtggatcttggggacccaggcattcaggccatagcaccctttatgagaataagagtgtccctcctgattctggtttcctggtctattattattattagatattcctgttctattattgccgagttggacttgctactgtgtgttctgtgtgggatttctgcctctgctctccagtgataactggcctgtgacttcctgtgtccctgaccgcgtccaggctgtgccagcctcggaacaggcactgggaaacgcccctcgtttttcttctccaggggaacgcatgtgtgatttcttccttcaatgtttggtcgactcatgggagcagcctttgggggctggaattttcttggtgggacagttttaaattatggacacaatttcttgcagaaacagctctttcagattttctattgtagtttattttttgacttgttcatcggggagtctgtttcagcagtcatctgacttacaggcataaagtgattcatgagcatccactatctgatgtttgtaggatctgtagttacagctgacatggctaatctgtatttgctctttttttgagacagagtctctctctgtcacccaggctggagtgcagtggtgtgatcgtggcttactgcaacctccacctcccaggatcaagtgattctcctgcctcagcctcccgagtagctgggattacaggcgcccgccaccatgccaggctaatttttgtgtttttagtagagacgaggtttcaccatgttggccaggctggtctcgaactcctgacctcaggtgatccacccccctcggcctcctaaagtgctgggattacaggcatgagccaccacgcccagccagccagggttaattaatttttaagaaatctttcaaatcatcgagttttgattttgttgattttctgttactatttactttgcgttccatctctgccatgtatttgttcctttggggtagaagtgtagacgatcgattttaaactttccttcctcacgcgtgtatttaaggctgtgaacctgccatgggtcgctgctgtaggtgcgtcccacacattccatgagatgtttctgtcgccgtccgattcaccgcgttgcctggctgacggggccatttattcccgtacttactggttcttagtacgtgccgcttgatttccagacgctggggatgcagccgcctctggttacagtgcccacgcgtggtctgtggtcaggggatactgcgtgcccggcactcccacgctcagctctcatgactgattgaaggctggagcgaaagccacgttgagtttgcagatgcccagacaggccgcgctgagcgtgctgtgtctttctgcagcagagggtctctgggcggcgtcggtcaggcgcgaggtacgcagcaggagcgccggcgtccaggccctgctgactgcccactcctgccctctctgccccaggcctgcggctgccccctctactggaaggggccgctcttctatggcgccggcggggagcgcacgggctccgtgtccgtccacaagttcgtcgccatgtggagaaagtgagtcctgggctgggcagggggctgtgtcgggagggcggaggcgtccccgggtccccgtggtgccaggacgggtgccccctgaggctgccgcagtgagaggagaaacccttgtacgggcacaggcctggccgtcgtgtgtggccacctgccacgcaccacgtggaacaccacacacgtgttccaccctgcgtctgcggggtcgaaagccacccccctgtgagggtggtgcccagtcatcctgtccttccagaatcctccagaactgccacgacgacgcggccaagttcgtccatctgctcatgagccccggctgcaactacctggtgcaggaggactttgtccccttcttgcaggtgagagcctgcgtctacaccacaggccttatccttcacgggagggcccgcgtctacaccgcatgcctcatgggagggccggcgtctacaccacacgcctcatccctcacgggagggtccgcgtctacaccgcacacctcatgggagggcccgcgtctacaccacatgcctcatccctcatgggagggtccgcgtctacaccgcacacctcatcgctcacgggagggtccgcgtctacactgcacacctcacgggagggcccgcgtctacaccacatgcctcatccctcacgggagggccggcgtctacaccatacgcctcatccctcacgggagggccggcgtctacaccgcacacctcatcgctcacgggagggtccgcgtctgcagcgtccacaccgcacacctcacgggagggccggcgtctacaccacgcgcctcgtgtcttcccacccgcaggacgtggtgaacacgcacccggggctgtcgttcctgaaggaggcgtccgagttccactcgcgctacatcaccacggtgggtccccagcggaggggccgtcggttccagcgcggggcgcgggtgtttctgcagcggccgccgcggggcttctgcggacggggcgggcggggcccggggttcctgagcttccggaggaggcggccgcgctctgggagagtctccacccgcccgggagcccggtgttggggggactctggttttccggggtggccgcacccccttcccacctgtcctgggcccgtgtagctccggggcgtccccggccagaccctccccgctttccgcggcctggggcggcgcctcccgcagggcccttccctctgcccccgcctgtgccctggcggccccgtgcggctgagaccaagggcgcgcccctctcccggctcccggtctccgtgcggggcgaggctcctgggggtctctgcgcacccaccgcactgacagcgcccccgcaggtcatccagcggatcttctacgccgtgaaccggtcctggtccggcaggatcacctgcgccgagctgcggaggagctccttcctgcaggtgcggagcggccccctgtcccctgccccctgccttgtccctacccctcctacctccactcccttcccttccctcctcccccctccctcctcccctcccaccccctctcccacccccacccccacccccacctccaccgcgctcccagcccacccccaggcctgtgagcactggaaccccgccgcctgcggttgggggtccacggttgatctaggaggcgggtggggccgtactgggcaccaccctgagggggagccgagccctgactcccccagagctgcccccacccccacacccgcctagggagccacccccatgctggagctccccccaccgcagagttgcccccactcggagtgccccccggccccagctgcccagtcccccccacccacggagcggccccgaccctcccagccttccctgccccgcccgcagccaggcggacttggggcatccccgcagaggccccgcgctcaggccgcctgggtcctttggcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacggtgcgtgggggcacaggggcgggcgggccgcgcggacaccgagcacacccttctctcagggcctgcgggtctgcagctgcctctccttccgcactcccagctctgtgtctgcagctgcctctccttcgcactcgccgctctgtgtctgcagctgcctctccttccccagtcgctgccccgtgtctgggtccccgcgtgcgcctctgcccgaggcctctgcctgggggcgtctacagggtcagtgtgggccgctggtcctgaagctcctggcccgagggccagcagcgctgtggggcttccttgttaacacccgagcaagggcgggcaggccacacgccttccctcaggagctccaggttccagcccccaaggcctggagcagtttccatccaatcccgggctaggtggagccccaggcttagcggtcgttcatatacctccgcgggagccggtgccgcccaggtgtcctcacagcagccactgcctcccggcccctctaagagtcatccacacttgcaggaactcaaagcggcctgtggcctgtggggcttgagttttctaaaggattcctttaagtgtgctttttaccccaaaaaaccatatgaccaagactgtttccgaattacggtggcatctgttgtgtgtggtcgactcataatacgcctggttccccgaacgtgagctgcacccgtctgcgtctcccggggctggtcctgggtcgcgtggccgcagtagatccctgcgtcggacgcgcacctgagcagacgtagcattccctggatttgtcctgcgctcagttcagggagccacctgcgccctgggcccctaactagccacgaggagagcacagctccacagcgccggcccgtgtggcctgggccagcacctgcacagctgggaatcggcccagaaccaggcgctcactgtccctgtgaacccccggcccggcgcggccccagctttccgcgttcctctggagcccactctcggtcccagggcaggatgccgtgtgcggccgggctgcgctgtttctcacgcactgcggcctgaagcggggggcggcaccttggctcgtgcgtcccagggacaccggtgaccgcagggatggccgcccaggctgcgggaccttctcgtggcccaagctgacggcgacggtgctttcactcctgcctcccgttggtgaggtctccctcccgcctcccgttggtgaggtctcactccggcctcccgttggtgaggtctcactcccgcctctccttggtgaggtctcactccggcctcccgttggtgaggtctcaatcccgcctcccgttgctgaggtctcactcccgcctcccgttggtgaggtctccctcccgcctcccgttgctgaggtctccctcccgcctcccgttggtgaggtctcactcccgcctcccgttggtgaggtctccctcccgcctcccgttggcgacgtctccctcccgcctcccgttggcgacgtctccctcccgcctctccttggcgacgtctccctcccgcctcccgttgctgaggtctccctcccgcctcccgttgctgaggtctccctcccgcctcccgttgctgaggtctccctcccgcctctccttggtgaggtctccctcccgcctcccgttgctgaggtctcactcccgcgtctccttggtgaggtctccctaccgcctcccgttgctgaggtctcactcccgcgtctccttggtgaggtctccctccccccctcccgttgctgaggtctcactcccgcgtctccttggtgaggtctcactcccgcctcccgttgctgaggtctcactcccgcctcccgttggcgaggtctccctcccgcctcccgttggcgaggtctcactcccgcctcccgttggcgaggtctcactcccgcctcccgttggcgaggtctcactcccgcctcccgttggcgaggtctcactcccgcctcccgttggcgaggtctcactcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctccctcccgcctcccgttggcgaggtctcactcccgcctctccttggcgaggtctcactcccgcctcccgttgctgaggtctcactcccgcctcccgttgctgaggtctcactcccgcctcccgttggcgaggtctcactcccgcctcccgttggcgaggtctcactcccgcctctccttggcgaggtctccctcccgcctcccgttgctgaggtctccctcccgcctcccgttgctgaggtctccctcccgcctcccgttgctgaggtctccctcccgcctcccgttgctgaggtctccctcccgcctcccgttgctgaggtctccctcccgcctcccgttggcgaggtctcactcccgcctcccgttggcgaggtctcactcccgcctcccgttggcgaggtctcactcccgcctcccgttggcgaggtctcactcccgcctcccgttggcgaggtctcactcccgcctcccgttggcgaggtctcactcccgcctcccgttggcgaggtctcactcccgcctcccgttggcgaggtctcactcccgcctcccgttggcgaggtctccctcccgcctcccgttggcgaggtctccctcccgcctcccgttggcgaggtctccctcccgcctcccgttgctgaggtctccctcccgcctcccgttgctgaggtctccctcccgcctcccgttgctgaggtctcactcccgcctcccgttgctgaggtctcactcccgcctcccgttgctgaggtctcactcccgcctcccgttgctgaggtctcactcccgcctcccgttgctgaggtctcactcccgtctcccgttggtgaacctttggttgaaacgtgtttgtttccgtgatcacactcgaggtctctctctccgtctgaaagctgtacctttgaggcctgaatattctgctctttacaagtcggtcttggagccgcggtcagctttgcgctctgtggatttcatgctggacttggctctgctcgacgggaaagcgtggtgggcccctaggatgggccgtgcaggggcatcggggccccggggctctcccagacccaggcgtcctctcagcttttcggtccccaccgcatccagtctcggctccggggggtggtgacgtcggggccgaggcacggtgcgggctgcccatcaaccgcattcctttccagccctttctaccaagatgatagacaggatcttctcaggagcagtcacacggtacgtacggctcaggcgcctgacggcagccattgcccctgcgaggaccccggtccctctcctcatcgttgcctgacgtgagctttttgtgccccgacagcgagtggttgtcaccccaggccctggcgaggggggcacgtgtctctgtcacgtgaatccctagtgggggggggtggcacaagactgtcacgcgaagtctgaggaagggggtggcccaggccccaggtcgggggttcttgtcgggcgctgggcctgagtgagcagtaacgaaggtgcactcctgaccctgcctggatctggggaaaaccctctggccacggggcctccacctcctccccggagaggcaggaggaggggcaggaggggggcaggaggagggccgggcccggggggctcccctcaccgaggcgcgtggacaggggctccgttcctgtgaagctctccctgacatgcatcttcgtctctccatcctggctttcgatctagaggcagaaaagtgcagaaggaagggaagatcagctatgccgactttgtctggtttttgatctctgaggaagacaaaaaaacaccgaccaggtgggttcctgctgcggcatgcgtttgtcccagtggaggggccgggagccgcccatgtgacatgtgtccccaggcggatgcctgcacgcctggtgggggctgcacggcacagggggacatgtgcacgcccggtgggggctgcacggcacagggggacatgtgcacgcctggtgggggctgcacggcacagggggacgcgtgcgcgcccggtgggggcggcagggggcaggggatgcctgcacgcccggtgggggctgcaaggcacagcggggacgcgtgcacccccggtgggggctgcctcaggggctgcaggtcacgggctgggagggcccagggcaggggctgacagagctcgccgtgccgcagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaaggtgatgccccgtgagggcatggcccagggtgaggggacggacgggcgagaggacggcccagggtgaggggacggacgggcgagaggacggcccagggagaggggacggatgacagcccagggagaggggacggacgggagggaggacggcccagggagaggggacggacgggagggaggacggcccagggtgaggggacggacgggaggggggacggcccagggtgaggggacggacgggaggggggacggcccagggtgaggggacggacgggaggggggacggcccagggtgaggggacagacgggaggggggacggaccagggtgaggggacgtccctgtgaggcgctgtcctactgagtttgtgaggagggccagcaccacaggtgcctagtctcacagtgcaagaacctcctattcggggcgtcgacaccccccgaggggtgacctagagaacctagggccggagctcaccggggacgttggcactgggctgagggagcagttgccacgttcgtgctgatgccgcacaaggcggtcctcccctcaccccccccccccccgtctcctcccctctcaccccgccccccccgtctcctcccttctcaccccccccggctcctccccccctctcgccccccccatctcctcccctctcaccccccccatctcctcccctctcacccccccatctcctcccctctcaccccccccatctcctcccctctcaccccccccatctcctcccctctcaccccccccatctcctcccctctcacccccccggctcctcccctctcacccccccggctcctcccctctcacccccccggctcctcccctctcaccccccccagctcctcccctctcacccccccccggctcctcccctctcacccccccccggctcctcccctctcacccccccccggctcctcccctctcaccccctccggctcctcccttctcaccccccccggctcctcccctctcaccccccccggctcctcccctctcaccccccccggctcctcccctctcaccccccccccggctcctcccctctcacccccccccggctcctcccctctcacccccccccggctcctcccctctcacccccccggctcctcccctctcacccccccggctcctcccctctcatccccccccggctcctcccctctcaccccccccggctcctcccctctcacccccccccggctcctcccctctcaccccccccggctcctcccctctcacccccccggctcctcccctctcacccccccccggctcctcccctcacccctgttccccccacaccatctccccagctcctcccacccacccccgtgccctctaaggcaaaggggagccccaccgtccacgccgcctggcttccttctgcatctcagaatccagctctgggactttcactttggaaatggctctgaggcccgggcaccgccctgcagccctgccccccccggccatggggcgcctcctgctgctcagtgtccccgggacaccctctggcctctgcctgcacggggagctccgttctctgtaatttcagatccagcagcgcccctgctggccgcgcctccctgcgctagtcccagtccacgcatccttggggcaccggtggcccctagtcgcctccgcatcacggcctcccacgcctcagtccccacccagaaccaggacactcgcgtgtccgcctttcacgtcaaacacgtggcgtgagagcccggagcttcgtgccgcgtccttaagcacgtgtgacaggacgcgcgcaccccacacccaggccccgaaggtgagaccgggctcacgcgccttggacgcactcccctccccgcagggaagatcacgctgcaggacctgaagcgctgcaagctggctaacgtcttcttcgacaccttcttcaacatcgagaagtacctcgaccacgagcagaaagagcagatctccctgctcagggtgagtgcggcgggcacgcgggccgggccgcgccacgccgtgtacgtaacccgtgtgcttcctccaggacggtgacagcggcggccccgagctctcggactgggagaagtacgcggccgaggagtacgacatcctggtggccgaggagactgcgggagagccctgggaggacgggtgagtggggaggacgggtgagtggggggacgggtcagtgggaggacgggtgagtggggaggacgggtgagtgggaggacgggtgtgtgtgcagccgggggatgcggggtcagtcaggtggggtgcgcggacacagaggggcggggtgagacctgacacggggccggtgaggtaaggacagccgatgacagggccgggcctcggtgcagtctgcccgtcattccccgcgtggggttctgtgatcctgggcgcgaggcttcgcacatcaggcccagcacggggaggccgagtcgtgtttcgccaacgacgtctgtccttatcccacggctggcacctgctgggcaggctgcagggcccgtggccattccagcctccgcttcggccttccagccttggaggccctgagaggccctgggctggttgctttctcacggagcgtgagggttcttcgtgtcttcagcatacaaaccctttatttgcgacgtgttcgcctttttcccagtttgtgacgtatgttttcaccccctcttcacgtggtgtctcagagatgttctgaatttggaggaggagacactgactggttatttttacagcggtgtttctggtgtcatatctaagaattcatttctgaatccaaagccacgaagattttcctctgcgatgttttgtgttttggtctggggtcctcttgagtaaccttccctgtggggtgtgaagctcggattgaggttccccttgtggtacgtgggtgtccgggtgtccgactgtcccagcatcagctttgcaggccgcagcgttgcctcggcgtcgtgactgtgccgtgtgcgggctccgttccggaaccttcctccgtcccactgctgcacgcgtctgtccgttcccgcggcagagctggctgtggtgagaagcctccgacttgggcgccgtgtggaactgtcggggccattctggtgttgggctgcctgtgtgtgaatcttagactcagcccgtccttgctctgccgtcctgtgggaacgtgtgttggactctgacgtggtggtgagtgctggtcccgggaccacgtggactgtggcccccaccggcctcccgtggtgcacgctggagcgacgtggtcacttttgccatcccgtgctgagcttctcagttctgcttctgtcccgcgctacgttggctattctggtttctttgcctttgtatgaaaacacataagaataggctccttctggccgggcgcggtggctcacgcctgtcatcccagcactttgggaggctgaggagggcggatcacgaggtcaggagatcgagaccatcctggccaacatggtgaaaccccgtctctactaaacaaaaaaaaaattagccaggcgtggtggcgggcgcctgtagtcccagctactcgggaggctgaggcaagagaatggcgtgaatctgggaggcggagcttgcagtgagccgagatcgcgccaccacactccagcctgggtgacagagcgagactccgtctccaaaaaaaaaaagccagggatggtggcacacgtctgtaatcccagctactcgggaggtgcaggttgcagtgagccaagatcgcgccactgcactccagcccgggcaacgagagcaaaactccatttccaaaacaaaaacaaacaatctgaacttttgagtgagatctcgctgagtgaatggatccctgtgggcccagctgccgccttcataaccgcaggaggcccagtccatgggcgccgtccgtgtctctcggcaggatttttgtagctttccgtgtacgcttgatgcgaatgttgtgagacttctgagtgtttcctgatgttttcctgttgtcagcggtgcttttaaggttcccgtttccagttgttcgttggtagcatatagaatttattgaccttgtgttttgcaccttcatgaaactcacttactggatctcaaagctctgtcggttctttggggttttctgcgtggacagcccatgtctgtcagtgggtccgtctctcgtcttccttttcacctctctgtgtacgttacttcctttctcttgcctgctgcatggcctggaacccgcagggagatgtggtggatgtcagggcagaccacggccagccttgagtgagccctgctggtttgtgtgccgtcctcgttcccagtcctgggggacgtctcccctcacgcagcggtaagcacgctcattggcgaggatgttctccctcttcctggtctgcgggggctttctcgcagtgggggccgaatttctcagatgctttcgctccgtggttcctctgtgtgtccatacagcgagttacaccgagtcattttcagccagcctcgtgttcccaggatagatcttgccgagtcatgtgttatcctcacatattactggattctctttgcagagattatctgtagtattttattatttttttggagacagggtctggctgtgtcacgcaggctggagggcattggcgcaatctcagctcactgcaccctccacctgctgggcttaaggaatcctcgcacctgagccccccgagtagctgggcttccaggcacgcaccaccacacccggctacttttttgtatttttttgtagagatggggtttcaccgtgttgcccaggttggtcttggatgcctgagctcgagggttctccccgcctcggtcccccaacgtgccggaattacaggtgtgagcccctgcccagccttgagtgagctttgctggtttgtgtgtttcggaaacttgcccgttcccatcagtgggttattgttggtatttcctgctcgtgactctgatgtctgcagaatccagtgatagcgtctctcacgctcctgatactgactttgtgtgtgatcagtgaggcgaggggccgacgaggttcactcctcttcccagggaaccacgggtgtttctcccctttgttctgctgttttccttgagtatcttcaggcagcgacgtgggccatggacaccgcagcccgcggccttctgattttggtgcagctcaaaatactttctggttaccgttgggttcccgacccatgggttccatggacgtgcattttaacccctgctcccccatcagccgccccgtccgattcctgccaagcagcacagggcccctgcggcccaccctgggccgtctgtcctgtgtgtccgtcctcctcgtggtcattgtttgcacggtggctctgacctggcagccaacctctgggtccccacaacttcccagtctctgccttctcctgtcggacaccctaaggcagctgtggcccccagacctagcctggatgggtgtgcgcctgtccccaccaccgtctgtcacctctgctccccacctgaccagtgtccacccccacggctgcccggctttgtgtctgcggcacagccagcagcacgctggggtcgactgccttcaccgtgtccacgcctgctccggcagtgggagctcaggtccgtgggggtgaccgcggggagctcagtgccaggctgtcgggggcgtcttggaaagcagaggtgtccccacaggatctctgagagtctgtgtggtccgtggccgcgctgggttccccggagcagcgcccgacgtcactgccgagaccttaagggaaggcgcgcgtccagtcctcgcactgctgcgtgttctggtcagaacggaagtggtagcctccactgggagcttctgtgctttgggagaatgtgtctaaactgtggtcctgtttgttctccagtcctgtgtggacaccacgacccagttgtaaacacaggtcccgtgcagctcgctttggggaagaggcgcgcccgcccaggtcctctgtgtgtagctcacgcccggggctccgtcccgtcctgggtgggttttcacctgcaccgcaggcccctcccccgggagcattcgtggagccggcgtcctcagccaggagcgcgttgctggctcagcggctggagctcaaggtcggctcaggggactgtctcgtgctggaggttggcggccgagcagcctgtgtttcccggaaaacggcccagggcctgctccgcgctgctggccacgtcttcgccatcccctcgttgcaggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacagaagcgtgttgattgccgctgtgggttcgtggctggacctgcccagagctctgtgccagggggacacgtagggccgcgcgtgaatgggacgggttcccacacggacaccctctggcgcttgccgttcccgacccagcctgggttccggggcctgcgtctgtggaaagggtccgtgtgcgcacaacggtgaccggcggctcccgggcgcctcagtcctggacaggagcctccaccacaggctgtgtgaatgttttgtgtaaacgtacaaaaccgt

SEQ ID NO: 5431 - DNA, 42059 bp, human
gtgaacgcgggcgcccttgtttgggagcgcggccggcgcgcccgttttgaagctgccctgagcagcgcgggccggaccgcgccccctcctcggtccccgcgccccgcgagtccgcgcagttcccgaggcgcgggccctgttccctgcgccgcgccccctcagcgggccgtgctcgcatcaccgaggtcggtccggggcggaccgaagcccccggggcggggcggggcgcgggcgtccgggggcgccgcgggcccagcccccgccatgccgcccggcaaagtgctgcagccggtcctgaagatgaaggtggacgagctgttcctgtactggctcagcgaggccagcacgcagcggatgctgcaggactgcctgcgccggatcaaggcgcccgggcgggaccagccgaccccgggggacggggagcagcccggggcctggcccacagccccgctcgccgccccccggcccagcgggctcgaacccccgggaacccccgggccgggccctgcgctgcccctgggcgccgcctccagccccaggaacgcgccccacgttcgaggcacccgtagatccgcagggacgagagtagtaagttactcttccttctgctaacaactgcgcaggtggctctggtcgcatagtgggcgtgtggctgcgcgatggaggctggtgggcgagcgtcagaccccaaaacggtttcatattgagtctgttccccgccccgaccccccccaccacacacatacagacaagaaagtcccacgtactgaacattccgtcattgacagttgttaacctaaaaatcacacaatttataaaggtagaaaggcttcctattttattttattttattattttaatttgttttaattttgagacagagttttgctctgttgcccaggctggagtacgatggcgcgatcttggctcactgcaacctctgcctcccaggttcaagcgattctcctgcctcaggctcccgaggagctgggacttacaggcacgtgccaccacgcctggctgatgttgtatttttagtagagactgggtttcccccatgtgggccaggctggtctcgaactcctgacctcaagtgatcctcccgccttggcctcccaaagtgctgggatttcagacgtgagtcactgcgcctggtccgttttttatttattttacaattctttggagacagggtcttgctctgtctcctaggctggagtgcagtggcgcaaacacagttggacttcctgcctcagcctccccagtagctgggattacaggcgtgcaccatcacgccaggctaatttttgtttatttatttatttatttatttttgcagagacgaggtcttgctatgttacctagagtgctctggaattcctgggtccaagcaatcctcccgcttcggcctcccaaaatcccactgtatttcttagaagaaacgccatttatttcatagaaggtgattatacaccgcaggtgagaagcgcagcctctggctaatgtacctgtaatctcagctacccgggaggctgaggcaggagaatcactggaacccaggaggcagaggctgcactccagcctgggcaccagagcaagactccatctcaaaaaaaaaaaaaaaaaaaaaaaaaagaaaactaaaaacaagcacttggagggaagaaaagatgagacgggaatttatgctgagtgggttggccaagtgtatatattcaagaagttataggaagagctatggatattcaccaagggtgtcctgacgcatgggtattgaacaaacatgcatgttacctactcccgagttcaccttggagcggagacttaacatttaaatgcattatggttaggccccctaggtcaaaaggtgaagcaactctgcagcctctgtcaaccggccagaaccagtccgtggtgagtagttaccaggataaagtgattgcaatcagttttttttttttttttttttttttgagacagattctcactctcacccaggctgagatgcaatggtgcaatctcagctcactgcaacctccgcctcccgggttcaagcgattctcctccctcagcctcccgagtagctgtgattacaggcgcacaccaccacccccggctaatttttgtatttttagtagaggcaggctttcaccttgttggctagactggtctcaaactcctgacctcaggtgatccacccgcctcagcctctcaaagtgctgggatgacaggcgtgagccaccacacctggcctggaatcagtcttttcccagtcaaagctgtagttacggctggtggaacagaggggtctgttcatcaggatctgacaggaagctgcaggtgttttaatattgtttatattggtcaggcatggtgactcacgcctgtgattccagcatttgggagttggaggcaggcagatcacttgagttcaggagttcgagaccagcctgggcaacatggcgaaaccccatctctgctaaaaatacacaaattagccaggcgtggtggcgcacctgaagtctcagctactcaggaggctgaggcaggagaaatgcttgaagctgggagtcggagattactgtgagctgagattgcaccactgctcaccagcctgagcaacagaggaaggccctgtctcaaaaaaaaaaaaaaagtatatatatatatatagagagagagagagagagagagtcttcttgcgtgcgcgagcttgaggccaagataagcaatagagaaaaagaaaaacatcctttatttacttcttgaatctcaaaaacgagtttctgcagaggtctctagtgaataacctaaaaggacatttagctgctggagaaaaagaaatgctttggcagttggaactgtagtttattctttaagtgtaggcggtgtgtgacttaaccctcacctcaggtggcccttggtcttgtttgccacagagtctgttctgtcagtcttacgatgttgattttaacctttttgctggttggttgtgtttaaactgccaaagcaggaggggtataataaggtgtgtccaaactcccatccagtcatgactgggaacttagttgtttttttgtttttttggttttttttttttttttttttttttttttttgagacggagtctcgctctgtcccccaggctggagtgcagtggcgcgatctcggctcactgcaagctccgcctcccgggttcacgccattctcctgcctcagcctcccaagtagctgggactacaggcgcccgccaccacgcccggctaatttttttgtatttttagtagagacggggtttcaccgtgttagccgggatggtcttgatctcctgacctcgtgatccgcccgcctcggcctcccaaagttttgggattacaggtgtgagccaccgtgcccgccgacagccgtgtatttttaaaaatgctttctgtcgttttatactatgcagtttaaagcgataaaacattgcttccagatgttatagaaacacgtatggctggtgcgtctggtgtcccgagaatactacggaagcctgaaatattcagaatgttccgtcggaacttgtttataccatttgaaaattttcagctgaacaccagctttccatcagcagcactaataagcatgtcacaaagtgatatttacgtagcaccacagttttccagccaaaatggaccagcctctctacttgctgagtgagaggtgggtggcaatctgaggtgagctccttgcgttctaaattaccggtggttgtccgatgtcttctgatggatctagaacattttccaaaagtacgtgtcgatgaaaatgtgaactagagctagaggcagcttggagaccgtctggctcaggccctccagatcccgatccaggaggggactcagggccccaggacgcatctcttgagctccggcccagtgcactttcccagtgagctgcaaaacctgaagcaccttaggaactcttgcccaaatccctcatttactgaggaggttgagaggagggccaggactcaagaagcatgtgctagtaatgatggttcccctccatgacttgctttctcagtgggatcgctaatgagctgccattttgtccttaaacgtgttgaatgacagccagacgctaaggtaaatgcttgaattgtgtgactttgcaagaattctcctagggctgggactattgtgactttgcatgaattctcctagggctgggaatattgacggaaggtcaggtctgtgcaaacgaggccatttgggtgcatgtgagaggatgatatattctgtaaatcaggcaagaagcctctaacaagtggaaattaagttccaaaggtgttcaaagcagggagacatcatttctctcctggagaaagttttgaggaggaagtgagtagtggaacttgagaaatgcactgagtttattgggtatagggggcaggaccaagggaggcggtgaaaatgagaccaggctcagtcgctcacacctgaattcctagcactttgggaggctgaggtggacggatcacctgaggtcaggagttcgagatcaacctggccaacatggtgaaaccctgtctctactaaaaatacaaaaattagctgggtgtggtggtgggcacctgtaatcccagctactctggaggctgaggcaggagaatcacttgaacctgggaggcggagattgcagtgagctgaaattgtgccactgcactccagcctgggtgacaagagtgagacactctgtctcaaaaaaaaaaaaaaaagaaaaaaaaagatgagatgttcaggtcacgttgagggactggagtggtctgaccggagaagcagaaggaaggatgcgtgtggaccgtgggcatggcggccagggtgtgcagggtgcaggattctgcacttaggagatggcaagaattttcaaaaagcagtgactgaccttgtttgggactaaaagtttaccttaaacatgtctacgtgtttggaacctatggcttacttcagctgaatctcaagaagtgaataacttagaaagatgtgtctgttcattgggacaaaaaagatgagcttgggctgggcacggtggctcatgcctgtgatcccagcactttgggaggccgaggcgggcggatcacaaggtcaggagatagagaccatcttggctaacacagtgaaaccctgtctctactaaagatacagaaaattagccgggcgtggtggcgggtgcctgtagtcccagctactccggaggctgaggcaggagaatggcatgaacctgggtggcagagcttgcagtgagctgagatcgcgccactgcactccagcctgggtgacagagcaagactctgtctcaaaaaaaaaaaaaaaaaaaaaaagatgagcttgttcctgtccatcccatatacagaatacgcgaggccacgttaacagtgaaggatgcagttccatgctacaaactctggctggggaggggcgatgctggggtcagaggaagagattttcataaataaagcagctttttctcacccacacatgtacagaatggagtatgagctgtcaggagggttcacgctaggtccattgaactccccagccaagggtgaaaggaacggcattgttttacgttacctacgccttcatcgttactgagcagagagattgcattctgtgtttgaaaggggtgcttgcagtggctccttcccgtctttggggaagagaaactggtacaaattagaaaatgtgagcattggccgggtgcagtggctcaatcccagcactttgggaggccaaggagggaggatcccttgaggccaggagtttgagcccagcctgggcaacatagcgagactcccccatctctgtaaaatagtaaaatcagccaggcatggtggttcatgcctgaagtctcagctgcttgtgaggctgaggcaggaagatcccaggagttcgaggctgcagtgagctatgtttgtgccagtgcactcccgccggggcaacaaagtgagactctgtctctaaaaaaaaaaaaaagaaagaaaacgccagtatcgatgggctgatgctgcaagccagggtgcttctgctaggggggaccctaaatgcatctttaaagtaagttcttacaaggggaattaagaacctcatgtggatgagctgctttttttttttttttttttttttttgagatggagtttcactcttgttgcccaggctgcagtgcaatgacgcaatttcggctcactacaacctccacctcctgcagttcaagtgagtctcctgcctcagcctcccgagtagctgggattacaggcacccgccaccacgcccggctagttttgtatttttagtagagatggggtttcactatgttggtcaggctggtcttgaactcctgacctcaggtgatccacccgccccagcctcccagagtgctgggatgacagacgagggcaaccacacccggccagtactgcacgattttgattgcatttccctgcggcctggtgacgccgaggaattttcaggtgcttatttgccattcatgtggttcccactgtcgagcgtctgttcaggtcgtgtgtttgctttttaaattgggttatgttatcactgagttgcgagagctctttacatacaactgttggcaagtccttggtaagacaatgtggtgtgtgcatatgtctcttgagtctggcttgctttttgttttcttcagtgtctcaaagagcaaaagtgtttagtttttcaacttttttcttttatgactcttattttttgtgtcttattacaaaatgtttgcataccacaaggtgtcaaatattttctcctatttatcttgagaaagcagtgtggttttaggtttgcgtttcggcctgtgatccagttcaggtcagtttttctgcgtggtatgaggtgaggtatctggatgaccccagcaccgtatattgaacagtcttttctccccccgtggaattgtgttgttgaaagtcagttgagtacgtacgtctgttttattattatttccatcccattgctgtatgtgcatcccctcaccttcatggcactttccagattagtgtaactttctagcaaattttgaaagcagatactgtgagtccaagcctgttctttaaaaattgctttccagcaagaaaagcctgttggaattttgattgggattgctttgaatctgtggatcaatttaggataattgataccttaacagtattttccaatccacaaacaaaggactttccattcatttaggttttgttcagcaacgttgtgtacttccccgggtacacctcttgcacctccttgattaagtttctatctgtttatttagttcttctctaatttctggaagctactcagttttggtgtccacctaacctgtgatttttatcagaccgggtgccagcattctagaacattagaacagggtatttggagataaacacgggcgtgcgtgtgcatcacacacacaggtgcatacacacaaacacacaggtgcatacacacacacaggtgcatatgcacaaacacaggtgcatacacacataggtgcatacacacataggtgcatacacaggtacatacacacataggtgcatacacacaggtgcataacaggtgcatacacacgcatacacacatacataggtccatacacacagatacatacacacaggtgcatacacatacataggtccatacacacacacacacataggtgcatacacacaggtgcatacacaggtgcatacacacgcatacacacatacataggtccatacacacaggtacatgcacacataggtgcatacacacacataggtgcatacacacaggtgcacacacaggtgcatacacacacacgtaggtgcatacacacacacaggtgcatacacacaaacacacaggtgcatacacacacacaggtgcatgtacatacaggtgtggttatcttaacgtttcattagaagttcttaacaaacatgttgtaagacaaaagcacctagaaccctcagggcaggagctcagggtttctgaaggtttcgtgcgggagccttgagcttgcccagggactgtagcttttgtacaggtgcgtgcctgtctgcgttcagttctcactgccttcgtaacaacgacctattcacgttttcatagtgggcaccgatgagagtctcgttgtgaggaggaaggaaggtgtcgaaaacccttcttgcaacctccgagaatctgcaaccatggaaactgtgtaaagagcttcatccctccctccccttctgttgacagagagaaccatgccgtttcctgagatgaggtggacgggttttgaatccgctggagcctgtcctctcagggcctttgaaacagggaggaagccgtgctctgcagacggcacctgcagggtgaggacaggattctgggccatcttcctgtctcataggcttgcctgttactagctatgcttttagctttggatgttcagaaaaactttttctcacaaagggcaggtcgccttcgtaagcctttcaaatctgggatttcagaaaagccattatgtttgctcatggaagacacatttttatcctaaaacaagccgtctgaacaaatgtatgtttagtgagaatgaaaagtgaagagatttttatgaaaattttgcataaaggtcttctgggcattttaggagcctttagaggttgatggtaagattgtgtcccgacagcagagggacggtggagattcgggtgccgtgaggggcttcatcggcccagatggcaatgttgtctcttcagagtaggaatttggggggaacaggctgaaaacaggcctcgcagattccgtgctggcctgtggtgcaaaaacaatgctatgacggccccgtccctgtacacagtagtgtatagacagccctgtggtggtcctgtcaagtgtggacggcccgtccctgtacacagtagtgtatagacagccccatggcggccccactgtagacggcccgtccctgcatacagtagtgtatagacagccccatggtggccccactgggtgtggatggcccgtccctgtacacagtagtgtatagacagccccacggcggacccactgggtgtggacggcccgtccctgcatacagtagtgtatagacagccccatggtggccccactgggtgtggacggcccgtccctgtacacagtagtgtatagacagccccatggtggccccactgggtgtggacggcccgtccctgtacacagtagtgtatagacagccccatggcggccccactgggtgtggacggcccgtccctgcatacagtagtgtatagacagccccatggcggccccactgtagacggcccgtccctgtacacagtagtgtatagacagccccatggtggccccactgggtgtggacggcccgtccctgtacacagtagtgtatagacagccccatggcggccccactgtggacggcccgtccctgtacacagtagtgtatagacagccccatggtggccccactgggtgtggacggcccgtccctgtacacagtagtgtatagacagccccatggcggccccactgtggacggcccgtccctgcatacagtagtgtatagacagccccatggcggccccactgggtgtggacggcccgtccctgtacacagtagtgtatagacagccccatggcggccccactgtggacggcccgtccctgcatacagtagtgtatagacagccccatggtggccccactgggtgtggacggcccgtccctgtacacagtagtgtatagacagccccatggcggccccactgtggacggcccgtccctgcatacagtagtgtatagacagccccatggtggccccactgggtgtggacggcccgtccctgtacacagtagtgtatagacagccccatggcggccccactgggtgtggacggcccgtccctgcatacagtagtgtatagacagccccatggcggccccactgggtgtggacggcccgtccctgcatacagtagtgtatagacagccccatggcggccccactgggtgtggacggcccgtccctgcatacagtagtgtatagacagccccatggcggccccactgtggacggcccgtccctgtatacagtagtgtatagacagccccatggcggccccactgtggacggcccgtccctgtacacagtagtgtatagacagccccatggtggccccactgggtgtggacggcccgtccctgtacacagtagtgtatagacagccccatggtggccccactgggtgtggatggcccgtccctgcatacagtagtgtatagacagccccatggcggccccactgggtgtggacggcccgtccctgcatacagtagtgtatagacagccccatggcggccccactgggtgtggacggcccgtccctgcatacagtagtgtatagacagccccatggcggccccactgtggacggcccgtccctgtacacggtagtggatggccccatgggggctctgtcgagtgtggacagccctgtccctcccccatccggtgtagacagccctgtggctgcactgggggcgggtggtgcgggttctgcatcgggacaggacgcaagggctccaggggggcagtgggactgcatccagaggtggttcgagggctccaggtcagagtctaaatctctgcctatgtgtgcacttcaggattttgaggctgttttccaaaagtcttttttttttttttttcctttttgagacgaagtctcgctcttgtcccccaggctgcagtgcagtggcgcaatctcggctcactgcaacctctgccttctgagttcaagcgattcttctccctcagcctcccaagtagctgggatgacaggcacccgccaccatgcccagctaattttgtatttttagtagagacagggtttcaccatgttggcctggctggtctcgaactcctgacctcatgatctgcctgccttgacctcccaaagtgctgggattacaggcatgagccactgtgcctggctgtgttccaaaagtcttgtacggaaagaggaaacctggcagtaaagtccacaggggtgtgtgtcacccgccgtggcaggacagggcgtgtgtcacctggcgtggcaggacagggcatgttgcctgagtgtgaggatcgcgcccgttggctcgcttcccccgcattttgggtttgatctttgactttcggagggagatcacaggaggttggctcccaatctggttcccctagctgcgtttgggaggccgtccgtgtgtagtgctgatatgaactgaaggggcggcacctctgccctgtgagtttgcgccccacatcgtgggtgactgggcggcacctctgtcctgtgagtttgcgccccgcatcgtgggtgacgggacggcacctctgccctgtgagtttgtgccccacatcatgggttactgggccgcacctctgccctgtgagtttgcatcctgcatcgtgggtgactgggcggcacctctgccctgtgagtttgcatcctgcatcgtgggtgactgggcagcacctctgccctgtgagtttgcgccccgcatcgtgggtgactgggcggcacctctgccctgtgagtttgcgccccgcatcgtgggttactgggtgcacttgtttaaatcgtctcctggtggtttgagcacattccctctggtgctgtcttaaagcttccctttggagacttaccgggggtcagaggccgacttctgaatcctcaaggacagtaaggaagtgagaaggatggagggatccgaggatggctggagaagggaaggaggtggaagagaaggaagtggagaggggcgtacccctaagaagagttggaaggggccttgcgggtggggggctgtggtgggcgtcagaggtggtgtggaaggttgcaggagaagaaaaggccagtctgagatggctgcagacttctggttccaagtctaggacactcggaaaaaggaaaacgatggagacaggaaacagatcggggcttgcgggggttgggtgcgtcagtgccacacagacgtttttcagggcagggaaactcctctgcgtgaccccacagtggtagatccgtgtcatcctgcgtttttccagactcaacagagcgtgcggcagcgggagagcccagtgcacgctgttgactcggggtgatagtgacccgtccaaggaggtttattgactgtaacagatgcaggcggtcacgcaggaccttcctgatcggggacccgggaggctttctgctgacagcgttcagcctggcagggatgtggccagtttctgaccctcagcccgaaggtatcctgtctccttcccggtgggatcgaggtgcaggcccccggaatgtcagctcaccctcatttaaagttgcccgtcccccttttccaccgcccctcttttcttgttctaaatacgattgcaaacaagcgcagttatcacagtgagcagtggcagagaagacgagatcctggatgcccactgcagcttagctgtattctagaaactcctgaagtttggggaggggcggagatgccggcgcgctttgatgccgggctgccgggatgtctgggctgccgtgcgtgtttgtggaggcgcagctgcacctggcgtgccctgtgctctggaggggcaagccggagtcggcaccgagcctgcagccagctctggtgttgtcgtggaggggggggacctcacttctcgcggggagcgccttcgcctgggtccccgaggccgtccccaggctctcttctcggggacctgttgatgcgcgttccgcccaggctctcctctcggggacctgttgatgcgcgttccgcccaggctctcctctcggggacctgttgatgcgcgctccagggcgagccacgtgacggctgccgcggtgcagaaagcgcccccttgcccggccggacggcccagcccggagcgaacggggagaggagagaagaggaccggagggagcggagggcagtgcagggagcggagaaggaggagaggagagcagcgccgggagcagccgggtctgcacagtcgcgggtcgggagaggcggccgcccccacccccggcgccatgcgccctcctcagcctgaggaatgcgcgcggcgcgggccccggccccagagcgcctggcgggcgacgcatggagcgcgctgagcccgggccacgcctgcagcgccccgccggccccggcccggccctgccccgagagcgcggcgcccggcccggcccgcggagagccctgcgcgccggcggcatgcgactccgcgagcgctcgctgcgccaggaccccgacctgcgccaggagctggcctcactggcccgcggctgcgacttcgtgctgccctctcggttcaagaagcggctgaaggccttccagcaggtcagccccgcgcgccccgcggctgcccgacaccgggcgaggcctcccggcccggcgagccctgccctcccggccccgcgtgggcccccgctcgccgctgctggccgtgcacccgttgttgcgtggcggggcccaaacgccagatttacagggccagttgtgggcgcaggggacccgctcgggccgcacgccgccgaaaaccgggtgctgctctgtgggaagcggtgccaagcttgttaggaaaaccgggctttgaaaagagcactcgctcctttcccgggagttttggctgtgagtgcgcgccttgctgtgatcaaccaaggcgggtgagagccgtcagcgcctgggagtgttcgctgcagacagatttttaatttaaatataccttgcattgctggtaataaacatcgggaaactccttcacccttcgtaaaggcgtcgggtgggtgaaactttcccggcgttattgcaatacccagcattccttcccactggctaacttaagagtcggttgagatatcactcacataccggactatttatgcagcgtggttttattcagtaactcagtggctttgaaatttatttatttatatttatttatttgagacgaagcctctctgtttcccaggctggagtgcagcggcgctatctcggctcactgcaacctccacctcctgggttcaagtgattttcctgcttcagcctcccgagtagggctaatttttgcatttttagtagggacggggtttcaccatgttggccaggctggtcttgaactcctgacctcaggtgatcgcccacctgggccttccaaagtgctgggagtaggggcgtgagcctccaccccagctggctttgaaatttaatctcagttctcataagtgctcagggaagtaaaatttgtgtctgtaccccgtgtatattgtatgagttagttttacgagtaccatgtgatttaaacgtgtaagagtcttcctgtgacaatcccagtataatttgagaatttagggtttggctgcggccgaatctgatccgaatttcatccagacagggtgtgcgtggcgggcgcctcacacccacgtggcacatcagacgcgcttttcaaactcagttccaggagtctggaactagtggcctaacatcaaggtgaaccaaggcatcctgcttgaagggggaggaagacccacttctttctgttgatattttaattgaaattttttctgtaagatctcacatcaacttttgcactccttcggagtttttgacctctgtcttccaggttttgacattttgcctgtaagtgggtaagggcgaggctggtgtctttaaaatcctcttaacctgcgaagagcgagatcagcctcgtgcgggatttgctctagatggtgggaggtgctgggcggtgcgggctcgctggtcgcagagtcaatgaggtgattagctcgcacgtggctggatgaggaagcccttcagccctgcagtggggccctggctcttctgtggggggctgtggtgacgatgcacctgtgaggactgtttatttttaaaaagtcagtttctgggaaatcatgaattccgtttacagaagtttgcttcattttacagaaaataggtttccacgtttttagggagtgaggacagacgtgtgaaatgcatgttgtctgaggggtggtggaggaattacaggcatatttgggggtatttgtgggggtggtgttgggggagaaggggacgtttcctggctgctttcactccgcgcatgagtgtgggctctgtctgttgggtccaccccacttggacacaccctcagggttgtcagggagcacccgtgttggagccactggacgtgttggggtgccgcacctccgccttcggacgctcccggccgggcagcacggtactgttttcaggggtcctctgacgggcacagccttccacggccaacgttggccgcacccacgagcccctggcgggtgctcctgagcttgatcttctgactgtgcgacgtcccacctgggcttctgttcccactaaccccctggcgggtgctgcctgccccgatggtgaacccaagctcctcctcctccctgccactgcccacttccctgtcaccggcatccttgacaaaccaaactcggggggtgggggcgttcagcgaccgccggccttgggaacggaacagcatgcgttcacgccgtgggtccggggaggctcccgtgtgacgatggcgtgttacacgtactctcaccgtgggtccggggaggctcccgtgtgacgatggcgtgttacacggctcatgctctcactgtaggacccagcatgtacctggagtggggccgtgcagctgcttggctgagctcttcttgccggagccactgcctgcgcctcctgcccagggattctcgggccttctgtccccgggcaacagcaggacagctcagaccttgttcccagcccaggacagctgtgctgcctagcctggccctccccgcctggggagtgactctcccgctccccacacactgactcagcacacagacgcccctcttcacctgtcctggtcacacagacactgtccggcgtccccacggggtccttcgggtggacgcacagaccctacacggcaccacgcatggctgaaagcgccgtcccctacgcggcagccccgctgtacttggaactgacttcagcgtggtgacagcctgggctctgggcgtccctgacgcacctcctgctctcaccgccagggcacgtgccgttcccctcccaaggccagtggtcaccaaaacccttgcagcctttggtttggccaggacgctgcccaggatgccactccctgggcagtggcagggagaaggcagggcttgggttccccacctggcagggagctgcagcaaggggggttaacgggaaacagaagcccgggtgggaacgtccacacagaagaccaagctcaggagcatccgccaggggcttgtggacgcagggagggtgccggatcctcccctcgctgtgttgcgcggcatccaccgtcaccccttggctggtggacagaatgatccccacgtcccccagcccagccttccgagctctgtggagactcacgcctcgctgcagccgtggctgcaggcgccagtgcctgggctgcaggtgtgggtgcaggccccagccgacgtctctcagcgtccgttgaggcccggttgctcggctgcagtcatgtgtctgagtgaatgttagcccacgtgagctctggcctactcagacacctgcacctgctgcgtttctgtgttgacccctccacaccagttctccctctttgctagagaggggatttttaaacccacacgtggggcctctcatctccgtgttcggctcctctgtgtaaacaccgacctttttgactcctgtgtttagccgtccagcgtgcggtttgcaggtgtagctggcagccctctaccagccctctcagagggtccctgggagtcaagtgctgggccgagaagaatgctcagagcttgcagcaggccctgccttccagggggtggccgtcatctgggtgggcgaggggctcagctggaatccatgagtgtgcgtcccggccaaaccccccgtccctgattccataccacagcctcccgtgcttccgcctcccgctgcagagtgggggccgctgcagagcgggggctcctgggggcacggctgtgcgttgcagcccgtactgagcgtcccttccgccggccccctgctgctccggcacctcctctgtggctttgatcgtggtgtccggtcctgctgccgtgggggcgagggtcatttctgctggtcaccgcgccctgcctgctgtgcgcaccctctgcacatgcgggggtctgcccgaggctggtgtcgcgagaggatgtgtcacggtgcacgtggcctgtgttctcggggtacactcacctgcacccatcaagcgcacgcacttctacgcaaaaacaggcagcctcagtgttaggctcagcctttgtttttggtcgtatatggacgtgttttgcaaaactgtgggtgtactctggaagggcgacacatgtatctgtgacttctggaattgtgatgagtcagggagctgccttctcagtgccctcaacagaaatagcttgttgggagtcagggtgtcgcctttatcagtgcgctttgggtgacgggctctttacgaagttctttttaaagtacacgtactgaggaggatttaaagtggatgacctggccgccacaggcccctctggtttgtctgaactttttaatgaacaggcggctggctttagaattcttcttccacatacatgcagctgtttttgctccttctgtgtttaccgtagatgcctggcctcaccggctacgtttggggcagggcagcagtccctgtgattccttcagaaccccctgagacctgcagctcagcccgagaggtggccagttcccaagtgagctgtgtgtgttgaaaagaatgtgtgctctgcagctgtgctggggccgagtctatttctgtccatgagattaagcttgtaaatcttctgtgcccgcatggggtggttgtgttgtttgttccatctctcgtctattagtgcccatggtgggtggtcccggctttccccccgtcggtgcccagggtgggtggtcctggccttcccccggtcggtgcccaaggtgggtggtcccggccttccccccgtcagtgcccggggtgggtggtcccggccttccccgtgtcggtgcccaaggtgggtggtcccggccttccccccgtcggtgcccaaggtgggtggtcccggccttccccccgtcggtgcccagggtgggtggtcccggccttcccccggtcggtgcccagggtgggtggtcccggccttccccccgtcggtgcccagggtgggtggtcccggccttcccccggtcggtgcccggggtgggtggtcccggccttccccccgtcggtgcccggggtgggtggtcccgtccttccccccgtcggtgcccaaggtgggtggtcccggccttccccccgtcggtgcccggggtgggtggtcccggccttcccccccgtcagtgcccggggtgggtggtcccggccttccccgtgtcggtgcccaaggtgggtggtcccggccttccccccgtcggtgcccggggtgggtggtcccggccttccccgtgtcggtgcccaaggtgggtggtcccggccttccccccgtcggtgcccaaggtgggtggtcccggccttccccgtgtctgtgcccggggtgggtggtcccggccttccccccgtcagtgcccggggtgggtgatcccggccttccccccgtcagtgcccaaggtgggtggtcccggccttccccgtgtctgtgcccagggtgggtggtcccggccttccctgtgtctgtgcccggggtgggtgggctccgccttgcctagcgggctcagtttgtgtccagtggtgtttacttgatcagtgccgaggctgcgttgtcaggcatggataaagttagcatcagcctgtcttcccctgactgacctcttcagcgttccttggtggcctgtctgtctccaggtctgtccatcaccttgtgtcacttcatggatgttaatacagcgacaccagctttctctactgtctgcctgctctttttccatctcaaaaaaaaatgtgtagcctctgggtccttaagtcacatatatctcctgtctttctgtcctctgtgtctcccatgtacgtgaatgctgttttctttctgcagtcagacctttgtcttgtaactagagcactcggtgcattgaggtcgatgttgcctgctcatccgtgtgatggactgtgaccgtctcatcctgcacctctgtctcctgctctttttcagcttggtcgccttttctctcgtttggagtacacgcttcctactagctcactgtttatcctacaaatgtcaatggctggccgggcacggggcctcacacctgtgatcccagcgccttgggaggctgaggcaggagaatcgctggaggccaggagttcaagaccagccagcacaacatagcgagaccccgtctctataaagaaaaaaaaaaggaacgtcgactaaatttttcaaagcccaatattaatcagtatcttttcctccaactcacaaaccgtctcacactcatccagtcagcatgtcactgacaggctgttgtattgactttttttttttaattgaacatacgttgttttcactgatttatgttttttaaattgaacatacattgttatcactgatttatgtggtcagctgccgaggttttcccactcattaccgctgacctgctcttcatcccttctttcaattccaaccttccctttgggagctcttggcttctccctgctgcatttcctcagcttttgccccgtagagtgtctgttaatggggtgcatgctctgtaaatttggggctaaaaatgtccaagtattcatctcacttttttttttttgagacagagtctcactctgtcacccaggctggaggacagtggtgcgacctcagctcaccgcaccctccgcctcccgggtttaagcgattctcctgcctcagcctctcaagtagctgggattacaggcatgcgccaccacacctggttaatcgtttgttttgttttgagacagagtctcactctgtcgcccaggctggagtgcagtagtgcgatctcagctcactgcaacctctgcctcctgtgttgaagcgattctcctgcctcagcctctcaagtagctgggattacaggcatgcgccaccacacctggttaatcgtttgttttgttttgagacagagtctcactctgtcgcccaggctggagtgcagtggtgcgatctcagctcactgcaacctctgcctcctgtgttgaagcgattctcctgcctcagcctcccgagtagctgggagtacaggcaccctccaccacacctggttaatcgtttgttttgttttgagacagagtctcactctgtcgcccaggctggagtgcagtagtgcgatctcagctcactgcaccctccgcctcctgtgttgaagcgattctcctgcctcagcctctcgagtagctgggagtacaggcaccctccaccacacctggttaatcgtttgttttgttttgagacagagtctcactctgtcgcccaggctggagtgcagtagtgcgatctcagctcactgcaccctccgcctcctgtgttgaagcgattctcctgcctcagcctctcgagtagctgggagtacaggcatgcgccaccacacctggttaatcgtttgttttgttttgagacagagtctcactctgtcgcccaggctggagtgcagtagtgcgatctcagctcactgcaacctctgcctcctgtgttgaagcgattctcctgcctcagcctctcaagtagctgggattacaggcatgtgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctcccgagtagctgggattacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctctccagtagctgggattacaggcatgcgccaccacacctggttaatcgtttgttttgttttgagacagagtctcactctgtcgcccaggctggagtgcagtagtgcgatctcagctcactgcaacctccgcctcctgtgttgaagcgattctcctgcctcagcctcccgagtagctgggattacaggcatgcgccaccacacctggttaatcgtttgttttgttttgagacagagtctcactctgtcgcccaggctggagtgcagtagtgcgatctcagctcactgcaacctccgcctcctgtgttgaagcgattctcctgcctcagcctctcgagtagctgggagtacaggcatgcgccaccacacctggttaatcgtttgttttgttttgagacagagtctcactctgtcgcccaggctggagtgcagtggtgcgatctcagctcactgcaccctccgcctcctgtgttgaagcgattctcctgcctcagcctctcgagtagctgggagtacaggcatgcgccaccacacctggttaatcgtttgttttgttttgagacagagtctcactctgtcgcccaggctggagtgcagtagtgcgatctcagctcactgcaacctccgcctcctgtgttgaagcgattctcctgcctcagcctctcaagtagctgggattacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctctccagtagctgggattacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctcccgagtagctgggagtacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctcccgagtagctgggagtacaggcaccctccaccacacccggctaattttttttatactctttttgttttttgttttctgtttttttttttttgttttttttttttttagtagagatgaagttttgccatgttgcccaggctggtcttgaactcctcagctcagacagtctgtccccctcagcctcctttcaaagcgccaggattgcaggcacgagcccggccggtttgagggttttcgcagcatcctggtgaccgtgagtttggtttgcaaacctgcaggagagtcggctgtagccgtcagttctcgggggagaactcccccctgcccagctcgtaccagcagctccaggtgaaggctgctactttcattcctggggccggaggcgcgctggggatttacttggagctcattcttcccactgaaggtgacgcgttctgggagcttccccggaggaccctgcgttttgcctcctcttccccagagctctgcaaggctgtgagagatttcgggtgagcccgctcggcccacgcttctgaaggcagagcctgttcaggctccacgggcttccccgggttcttccttccaggcagctgtggcctgaggtgtcctcctttcctgccagcctgtgggcgccgtctagaagacgtttgtcaactattctgtccagggttcttggcagttttcatcaggaaggttggtttgtgtacccaggtcattgctatattgccaaacacaggagcccgagagctcactgcagaatattcgcggggtcagttccgtaccccaaatagcagagctgtgtgaacccagcgtgatgaaggaggaagagccgcaggctccacagtgggacccccacagcgagagacgggaaggcgccgctgcgggaatgcgttgtgggctcgggaagatgcactgtgggatcgcgggcttggggagatgcattgtgggatggtgggcacagggagatgactgtgggatggtgggctcggggagatgcattgtgggattgcgggcacggggagatgcattgtgggatcgtggactcatggagatgcactgcgggatcgcgggctcggggagatgcactgcgggatcgcgggctcggggagatgcattgtgggatgctgggctcggggagatgcattgtgggatggtgggctcggggagatgcattgtgggatcgcgggctcggggagatgcactgtgggattgcgggctcggggagatgcactgtgggatggtgggctcggagagatgcactgcgggatggtgggctcggggagatgcactgtgggatggtgggctcggggagatgcactgcgggatcgtgggctcggggagatgcactgcgggatcatgggctcggggagatgcactgtgggatcgcgggctcggggagatgcagggacctcctgccccaggacacagaggtcacgttctgaatcacagggaaggggtgtgcccttaggtaaagctgtgctgaaggagcactcagtcggcagctactgcgggaagcctgctctgccccaggtcacggaggcggcctctgttcctcctacatggggatcagagaaaaacaactgagtctcaccgtgggtgagggtcctgcagcgacagcagggtgggcacagttgaggcgctgtcagtgggacccttgtgacctggggtgagggtcctgtgggagtagcagggtggggacagttggggcgctgtgggacccttgtgacctgcggtgaggatactgtggcagtagcagggtggggacagttggggtgctgtctgtgggacccttgtgacctggggtgagggtcctgtgggagtagcagggcgggctgttttctctgtgtggacactggagcttggacccagtcctggattgatccaggcagtcaggattgtgggtgcaaaggccctgagctgtggtccactggtatgcggacttcctccctggacccctcctccatggcagttggttgaggaggacacagccccgtcccctgagtagttgatggaggaggaggaggacgcagccccattccctaggtagttggtcaaggaggacacagccctgtcccctgagtagttgatgggggaggacgaagcctcgtcccgagtagttgatggggaaggacacagccccgttccctgggtagttggaggaggaggaggacgcagccccgtcccttcagtagttgatggtgggggaggacgcagcaccgtcccttgggcagttgatggaggaggacgcagtacggttgctgatgctgttaactgtttcagatggtgttttaacatcacgggatgagatcaaatgtccacctcgcaggttgtgtagagatgcaagcaggagactcttgagtgagtgttctggggcctgcagatatactgggtgaggagagtgctggtgctgagtggggccaagagcccgtgggcgtgggctgtgcaccgggtgaggggctgaggcgtgtccgcagcagtacctggtggtcgaccccttctcctggctgtgtggttgcctgccctgcctctgcctctcagaatgtgagtcttccgggctccagggacagggttgcctgtggacggcacctgtgcctctccacgtctgagctctcaggcgtctggggtgcgtggctgcccttttccccaggtccctgccaggtgtggtggggtcagtggtgtggctcatgggaatcgggagtgggtcctggctgggctctcaggtgcctggggcacgtagctgcccttgtccccagggccctgctcggtgtgatgggggctcagtggcgcagagccgccacccagagtggggtccatggcagcatggtgtggcctcctgggtgaaggtgggccctgcagtggagtacgtgtgtggtcccccgcagggattgcagtgtgtcctctcccggctgggatcaggtggcctcagcactgtcggccctagagaggccccgtgtgttgtccgggtgaagaaggcgttcgatgctcccaggttctaactgagcgctgtctgtcgactcttcaggttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggtacgtgtcacgcgtgggacgtggagcagccgaggtggtactgcgggcatgtgagggtgaggcggagcggccgtggtgggtgcgtgtcacacgagcgtgagtgaggcggcacggccgaggagggtgcgtttcacacgtgtgcgggagcggcccaggttttctctgaggttatagttgtggtctgaggtttgctgtctggttgctgctgtgtgaattcttaagcatctgaaatgcgagtgggaattccgtctgcattctcatcctgatgctgtgaagagcgcaggcccgccctgtgccaccctccccttctctcccctccggggccagtggcgccagctctcgtggctctcggaggccgttctgcaccctcctggccttgcccctttctgcccgaggagcggccatcccaggctgggcagctgtggacccgtctcctggcagcagccccatgggcccatttctagactcaccctgagtgctgcggcgcggcgtgcatcattcgccgcctgctttccttctcagctgcatgctctccaggctgaccgcctggacgcccacagatggagcacactcagtttagtgtctgtccgttaccaaggcaaggcctacaccagagatgcgtgtctggacccctggtgggtggttgtgtttccagggacctgtgcccgcatctccagcctcctaccctccaggtggagtcgctggccagtggatgctcccacccctccaagtcagagccccagagcctcggtgcacggtacatgtgagcccctcacggtgagacccctgccccccagccctctccagctctgcagctgtgaagggggtcctcgggagtgagcaggtttttgttttttgggtttgcttgtttgagacaaagtcttgctctgtcacccaggctggagtgcagtggtgtaatctcggctcactgcaacctccaccttctgggttcaagtgattctcctgcctcagcctcccaagtagctgggactataggcatgcaccaccatgcctggctaatttttatatttttagtagacatggggtttcaccatattggccaggctggtcttgaactcctgacttcaagtgatccgcctgcctcggcctcccaaagtgctgggattacaggcatgagccactgcacctggccgggttttgtttttttaacttattaatacagtctattaaatgagttggttttgggatgttaaaccaaccttgcattcctgggataaattccgcatggtcgctgtgtctcatcttttttatatgttgctggattccaataattttgcaactggattcacagagaagacagtgcttggtagttttcttgtgagtcctttgtctggttttggttttagggcaatacgggtctgaaagaacacattaagtgtccccgccctttttctattagggattgtgtttttaaagtattttaaaaagttttgttttataaatatgtaaaaacctccatggttacaaagtgagcactaacaaactagacacattcaggtaagtccaggttctgtccctgtctgtgctgtttctaccccagaggtaatagtttccatagctttggtttatcctcttattgttattttagcttttaatatgagcaattatgtacaaatatgtgtatgagtatgaacatacatacttcttgcatttcttagagaaaaattagcatgctgttgtacacttgcatatttgtttttgctaagtcactccgtatttgtagaggtgtccctgtcttgtacggcagtgtggggccatgaaaggaccagataagtcacaaccatgcaaaaccatcttccagtaaaaattaggatcattctataatcatttttgttgaaatattagaaactttcttacagtcggttgcaaacatgtagtgaatgaaaagaactaatatttacctagtatgctgtaacttaaaacaccagaagcattaagaattgtttcatctctcagtaaaaacttgccaaaagtagttacagcagtgccatctccttgtcccgtgtggagtgagcacctgctccgtgccctggcagactcactcgacttaacacgccttgctcagcttccgcgttttatccttggtgctcttgaagttgtggggtatctctgagagttccttcactgggaggtctctttgctggcattccgtctgctgggacaccttcatccttttcagtacagcctccgttgtgtggagaactcaccctcgcggagtgcgcccggccccacccacagggtctctgcgcgcctcgggctgggtcagacacctcttttgcagctcacgcgctgcgtccgcttcgggtcctacaaagccgctcgcgcagcccagtgaggttcctgcatgggacccatgtattcccctcagtgcttccccgccacgatgcccctccccggccgcggtgcttccccgccagggcgccgccccgccctcccctacccccgccgcggtgcttccccgccagggcgcccgtccccacggtgcttccccgccacagcgcccctccccacgcggtgcttcatccccacggtgcttctccccaacggcgcctccccccaccgtggtgccgccccccacagcggccaccccccctccgcggtgcttccccgcctcggcgcctggttctcatgtgcgcgtttcatgtcattttccttccaggactcagttctcggtgtcacctcgcttccacgcacagcggcactggccttggtggccgtctaaggtagtgaggctttaagacttgaaagaacctggtccgttggctggatgtcacgtttggtggtaaaaagcaagttttgtcgttgtcttcgacgccccagagaagcagggtgacctgggtgtgacccagcggggcaggggagagctctgagactgaagttgtgtcgcttgcagcgtctgcaccgctgggagtccgagagacacctccacaggccccactgtgcctgcacgcaccgacccggccctgcaggcggagagcatggtgctcgagcacccaccgtgactgtgggcagaggccagcagggtgtgcgctgtcgcgacttaatccacctgcgctgtggcggcagaaccctgtgagcgtcccgcgtgtgtgggggccgcaggcaaacttcagcttccccgccaaggctgctgagcctgtctcggtggcgcccagctcgccgccacctgcagatgtccgtccacgtctccatcgtgtgcctttgggacggttttctgtgagccgggcccccggcccaggggacgaacgagtaggggtgtcactgccgtttcgagttctccccgtcgcgtgagtgactgaatgagggcctggagtcacagctccacacgcgtgttgtcaggcgggtggactttggccggcggctgcttgagaactcacgtctgaggggactttgagtttgatgaggggggtccccccgtggatcttagccgtggccgtgcagcgaggtccgtgtgtgccttctcctggcccggttcttcctgtctgtgtgagtcagggctgatctcatacatcatttcctccctttcatcattgtcactcctctgtgttttctctgaagccgtttgagacagagtcatcagctccttcacctccaccaaactccaccccctcagctgcccccacaggaaaacacacttttctctttgttaatttccttcaaacgttgttggctaattcagggttttcatttatggagactattttgatgatttacattttttctaaaaattttttgcgtaacttagaaatttcttgctctaaagcttttccttgtcttgtacgatttacaaaatcttgatcgtatctgcatcatacatagacactttcttgacagaatcatttatttccggttcctttcttgatccgtcatgctacacactaacgtatatctctttcagtaaagcagctgtcagtgttacagattatttcagttctttctctcatgaatatctatggtcatcttttttacatacacttccttctgtcattttttttagtttattgaatagttttttgtttggccagctgtattgtcatataattacacaccctaagattcaccaattttaagtgtacaatttgatccattttggtaaagcacacacctgggtatccatcctcataggcaggaccggccgtttgtcacctgccgcgggtgtcccacgtgcctccttttgcacctcatcattcccctcttttctccctggcccgggccagctgcagatgtgcttccggtcgctgtagctttgcctctcttagaatttcacatgaggactcttggagcattttgtctgtggtttctaacttcttcctggcagcatctttattttaaattttattttgaatggacaagtaatatttgtgtatacagggtacagcaagatgtttcgctatgtgtgtgtgttgaggactgattaagtcctgtggtgtggatactgtggggctcgctgtgtggctggcgaaggcgtggttaccgtggggctcgctgtgtggctggcggggtgtggatactgtggggctcgctgtgtggctggccaaggcgtggttaccgtggggctcccgtgtggctggccagggtgtggatactgtggggctcactatgtgtccctggccgtatgggcagtttcttttctatcactgagtagcttctgctgtgtgtgtgctccatctctcccctgttccagggttgatagacgtctggttgctttggtttttgcttcttgtgagtaaagctgctgtgtgtctgtgcactgatttacgcagacatgcttgcattttcctgaggtgattaataccgcagaggtgagctctgcctcatctggtggccacatgtttagttttgtaagaagctataaaactgcttccagggcccaggagtggtggctcactccactaatcccagcacttcgggaggctgaggtaggcagatcacctgaggtcaggagttcgaggccagcctggccaacatgatgaaaccacatctctactaaaaatacaaaaattagccaggtatggtggcgggcacctgtcattccagctactcgggaggctgagacaggaaaatcgcttgaacctgggaggtggaggttgcagtgagccaagatcgcaccactgcactccagcctgggcgactgagcaagactgtgtctctacgcaaaaaaacaaaaaacaaaaaaccctgcttccggggtggccctgagtgacgcatttccaggcagcagcgttgacccctgcgggcacgtggccacacgctttgcctttagccgttctgtgcgtgtgcaggcgtcccgtcctggctgcactcctcatttccctgatgtacgtgttgaccaccttacgtgtttctttctcatcagtttgcctttttttcattttggggcagctgtgttgagatataactgatgtgggatgcatggtgcgtgtggaaggtacaattcaatgagctttgacgtctgtacccacccatgaaactatccacagcaccaagacaataggcgtccctgcatccttgcgcttgagcgggcacgtgcgctggacttttctctgctgctttctgacgcgcacctgccctcatcccacgctacctcaggcctcctttctgtcaatatagattagccggaattttctggaattttatgtaaacagaatcagacagcaggcacttttttttattatgggaaaattcacacaacagaattcaccaccgtaaccatttggagcacagaactcggagacgtttgtggcatatacagcacggtgttccatgtgcgtgtgtggagggccggatcgcgtggtgttccgtgtgcgcgtgcagttccacttccggctttctggggaacctgcacgctgtcttcccgagtggctgcaccgttgttcgttcccaccgtgtgaattttagagccggtccctccgttgctacgacagcctgctgggattacatgggcatcctgttgactccagatgaacttggaagaatcttgaccatattgaggcttccgtctcatgaacgcggtccagctctcccttatttcaggcatctttcacttctttcagtacgccttgtagtttggtcttgttcacggttcatcacattgatacccaagcatttcctgtttctgatgacactgtacgtggtatttttttactttaatatgattgtcaattgtgaatgttgagaagcactgttaggttttatatgtggactttgcattttctgaccaagtttaactcagtcatcggctctaccagctcaacctttaagtccggcagagtctctaacgcacggtcaggtcatcttcaggtgagcacagttcagcctttctcttctcgtctgcatcggtgtctcctccctgactttctgtacacaggctcggcctgccagtgcagtgctggagagccgtggagagcacgccccttcccgcctcgggctcaagtcgtccgtgacgcagcggccctgcctggcgtccttcatcagactcaggaggccccttcccttttggtttcttgtttgctgggagctcttgtgttttttttgagacaggttctcattctgcccccgggctggagtgcagtggcatgatctcagctcactgcagcctcgacctcctgggctccagtgatccacccacctcagccctcccgagtagccgtgactactggcacccgccaccacacctggctgattttttcttttttggtagagacagggttctgctatgttgcccaggctggtctggaactcctgggctggaaggatcctcttgcctcagcctctcatggtgctgggatgatgacaggcatgagccatcacgcctggcctcagtttactttttaaaattataaaagtgccttgaagtttgtccgggatgctaaatgtgtatttctgcgtgtattgagagggcagtgaggttttcctttggtcctgtaaaaggtgaatggacctgactgacgtctgagtgtgaaggcagccccggtccttgggtgagcccccggtccctgttccaccgcagcgtgcattgcccggccacgcaggggtagcgtctgtggtcatgaaggactggtcttgacctgactgacgtctgagtgtgaaggcagccccggtgtttgggtgagcccctggtgtttgggtgagcccccagtgtttgggtgagcccccggtccctgggtgagcccccggtccctgggtgagcccccggtgtttgggtgagcccctagtccctgggtgagcccccggtgtttgggtgagcccccagtctttgggtgagccccctgtgtttgggcgagcccctggtccctgggtgagccccggtctttgggcgagccccggtctttgggtgagcccctggtccctgggcgagcccctgctccctgggtgagccccggtctttggatgagccctggtctttgggtgagccctggtctttgggtgagcccctgctccctgggtgagcccccggtccctgggcgagccccagtctttgggtgagcccccggtctttgggtgagccctggtctttgggtgagcccccggtccctgggcgagccccggtctttgggcgagcccctgctccttgggtgagccccagtctttgggtgagccccggtctttgggtgagcccccggtctttgggtgagcccccagcccccggtccctggtccaccacacagtgtcacacttctcctatgtgttgggtccacattgccaggcctcgcaggggttgcgtctgcgctcgtgaaggactggcctgcggtctccttttcttgtgatagcttggtctggtttagcatcggggggatgctggcctcggagagttgcttggaaaatgtcctttagaattcacttttctggagccatttgtttagaatgggtgttatttttatttgaatgtttggtagaactcatcagtgaagccatttgggatagttttctctgtgggaaggtttttaatgacagcatgaattgtttcaataaacacaggctgtctgtatcatcttttctcttttttttttggagacagagtcttgctctgtcacccaagctggagtgcaatggcaccatctcacctcactgcaacctccgcctcctgggttcaagccattctcctgcctcagcctcctgggtagctgggattacaggcatgcgccaccacacccggctaatttgtgtatttttaggagagatggggtttcaccatgttggccatgctggtctcgaactcttgacctcgggtgatccacccgccttggcgtctcaaagtgctgggatgacaggcctgagccaccgcacccggccactgccacccacttttagaccatcggatctcacaagaactcaggattacgagaccagcaagggggctgtccaccctcatcacccagtcaccccccagcagagccctgctccaacactcaggatcacagttccccgtgagacttgggtgggggctccgagccacagcccaccactggttcatgtgaccctgaagactcctccggctccgcgatgtcactcgctcacatagcttggcagcgttttcacatctttacgtgtctgcagatcgtcctcttgtcccgtcacccgccgaggaacgcgtgctgaacttgccggccgtggttgtggcgtcctcctttctcctctcacacctgtcggttggtgtcggcgtgccctgtgcgactgtagacgctcgggactttgtctgcctcgcgagtccccctcagcagcaccatcacgtgggccttggggccggcggtgtttcctgctcagggagctactctgaggtcagcagagccataatggaatagggttcagcagtacacaggcagacgatccacacagagcaaggtgggcagacgatccacacagagcaaggtgtgtgagtcccacacgcatgtgctgagcgagggaagccaggtctaaaagtccgcagatggccgggtcccgttgccgtgtcctggaaaaggtgaactggagccacggggaggaggcctgggggccgtcgccgtagcggactgcggaggggccgaagggactgtcagggctggcggcctcgttccctgtcctggccgtgcgggtgggcgtgccgccgcgttgccgggccccacaaggagtcggtctttctgtgtgtcgatcacgaaaagacttttaaaagtcagatcagggtatctgatgttttattccctttcccataaggattttgtgacattcaggtaaaactgctttcctttgtatcttttgcattttagagttgattatctccatttactttaggattattttaaattatgagctaattcatttggaggtaattttcgggtttggtgtggtggggggactgtgtgcccagcactctcccgctcagttctcatcccccagacgccgggggtgcagctgtctctggttgcagtgtcatccctgtagtcccagcactttgagaggccaaggcgggaggatggcttgcggccaagggttccagaccagcctcggcaacatagtgagacttcactgtagaaattaaaaaaattacccaggcatgatagcgcgcacctgtggtcccagctacttgggaggctaaggtgggaggattgcttgagcccgtgaagttgagactgcactgagctgtgatcacacactgcactccagcctgggcaacagcaagaccgtgtctcgaaaaacaagtagaataaaaatggatcacgctgtgatcacacactgcactccagcctgggcaacagcaagaccgtgtctcgaaaaacaagtagaataaaaatggatcacgctgtgatcacacactgcactccagcctgggcaacagcaagaccgtgtctcgaaaaacaagtagaataaaaatggatcacgctgtgatcacacactgcactccagcctgcaggtctggacacatgagacgctatatcctgcacggctggatagatctgatgctccatccctgccaccgggtcatgacggtgtgtcttgcacgcggtgaggagcacagatgtgaaggctcacacatccccccatccctgggtgttgagcgcttggggtttgaaacctgcacggcctgtgagccagaatggtctcatgaggtcaaaagcgtgggactagcactagcccaaggacccggtgctgcacccggctcgttccctcccaccgcaccgggacgcccttccaggtggccagggctgagctccgtcaggatcctcatcacgggagccggcacgtgcctgtgcgtcctgcggggcccggcccctccagccgcacacggctgccttcaagtcatccacaggtgcgccagccggagcgcgtcctttcccatagcagcactgcaatccccgctgtggcgcgcagccccctctgcagtcccccacgcccccccgtggtcactcccgccctgcacctgtcaggacgactctgccacagtttattcctccagtccctgctctggcgtccggctcctctcgcctggggcaccgtgaaccaagcagccgacgtccccatctgtgcaggctctcacgggcacgggccctcttcccactggtgtgcttctgggaggacagatgtcctggccgggccacggggctttacgctcagccgccccgtgggccgctttcccggcagctgcgtggcgtcccagttcccccagcaacgcggaggacacccagctgcctggcagcctcgcgggacctggcgtcttcagtcctttttgtctcagccgcgcgtgtcatgttcttgttgccacctctccatgccctgtgaaccctgccctcgccggcgccagtgctgggcgcttccccttgtctacggccaccgtgcacccctctccggagggcagtgcatgtccactcggtcgtgttcgggcctctttctcactgatgcttaaaattctgcctctgagtccctcgtcagaatctcgccttgcagagacatttctccctctgtgtcatgtcctgtcatggtgttcaccgtgccggtagctgaccctgagtcctgcgctggggcggtgcagcggtgctcccttccttcagggagcgcacgtgtggcccgtgaaagaaaccttggccgcggcagagccgtgcagcgtccctcgtttccttccaggaggggccgctgtttggcctttcacccttcgggctgggatcccctggtattcagtttgtgtgaagtgtctttgcctgtggatattccacggggctctgtcccaactcacttccttcccttgctctcttaggccaccggtgcccgacagagactgactgagtcttcattactctgactttacaggaagggttgaaaccgggcagtgggactcatatccaccaacttggtccccctgtgagttcttttgtgttccctggtaagttttcacatgagcctgtccgtgtatactacaaaccccaaaacaacaggccctcggtgcatgtggatggggattgctggactctgtgggtggggatcgcgtggactctgggtcaacagagtcgtctggaggaaactgcagtctgtgaactcagcagtgaggtccacctcaccacgttgaggtcgtctttgatttcacccagccgtgccctgcagtttgctttgtagacactgtgtgtgatttttgttccatttttcgtaggttgatttttcatgctcttgatagatggcattattgaagattttatttttagttgtttgttgccagtatattgaaataatttatttttgcatatagtccttggatccagcaactttgctgaagatacttattaattcccgtatttggtaagcatttggattgtctacacagtgtgttgcttgtgaatcatgacggttctgcctcttcttacccgtcgtcgtatctttcggtctttcccttgcctgctgccctggctcggccgtccaggcggccttggtggtgacactgtcctcttgttcccagcacagggaagaagtgttcatgtgtcatcgctgtctgagcagctggggtgtttcgtagaggccctttgtctgagcattcaggctgctgtcaagaaacaccatagcccgggcagcttgtcaccagcaagacatttactgttcacaggtctgcaggctggaagatctcggtgtggcagagtggtgcctggttcatcgacggcgccttcccgctgcgtcctcacggggtggaaggggtgagggagctctctggggtccctcagaaggggactcatcgcattcatgaggccccacctcccaacaccatcgcctcgggggagaggatttcagcacgtggatcttggggacccaggcattcaggccatagcaccctttatgagaataagagtgtccctcctgattctggtttcctggtctattattattattagatattcctgttctattattgccgagttggacttgctactgtgtgttctgtgtgggatttctgcctctgctctccagtgataactggcctgtgacttcctgtgtccctgaccgcgtccaggctgtgccagcctcggaacaggcactgggaaacgcccctcgtttttcttctccaggggaacgcatgtgtgatttcttccttcaatgtttggtcgactcatgggagcagcctttgggggctggaattttcttggtgggacagttttaaattatggacacaatttcttgcagaaacagctctttcagattttctattgtagtttattttttgacttgttcatcggggagtctgtttcagcagtcatctgacttacaggcataaagtgattcatgagcatccactatctgatgtttgtaggatctgtagttacagctgacatggctaatctgtatttgctctttttttgagacagagtctctctctgtcacccaggctggagtgcagtggtgtgatcgtggcttactgcaacctccacctcccaggatcaagtgattctcctgcctcagcctcccgagtagctgggattacaggcgcccgccaccatgccaggctaatttttgtgtttttagtagagacgaggtttcaccatgttggccaggctggtctcgaactcctgacctcaggtgatccacccccctcggcctcctaaagtgctgggattacaggcatgagccaccacgcccagccagccagggttaattaatttttaagaaatctttcaaatcatcgagttttgattttgttgattttctgttactatttactttgcgttccatctctgccatgtatttgttcctttggggtagaagtgtagacgatcgattttaaactttccttcctcacgcgtgtatttaaggctgtgaacctgccatgggtcgctgctgtaggtgcgtcccacacattccatgagatgtttctgtcgccgtccgattcaccgcgttgcctggctgacggggccatttattcccgtacttactggttcttagtacgtgccgcttgatttccagacgctggggatgcagccgcctctggttacagtgcccacgcgtggtctgtggtcaggggatactgcgtgcccggcactcccacgctcagctctcatgactgattgaaggctggagcgaaagccacgttgagtttgcagatgcccagacaggccgcgctgagcgtgctgtgtctttctgcagcagagggtctctgggcggcgtcggtcaggcgcgaggtacgcagcaggagcgccggcgtccaggccctgctgactgcccactcctgccctctctgccccaggcctgcggctgccccctctactggaaggggccgctcttctatggcgccggcggggagcgcacgggctccgtgtccgtccacaagttcgtcgccatgtggagaaagtgagtcctgggctgggcagggggctgtgtcgggagggcggaggcgtccccgggtccccgtggtgccaggacgggtgccccctgaggctgccgcagtgagaggagaaacccttgtacgggcacaggcctggccgtcgtgtgtggccacctgccacgcaccacgtggaacaccacacacgtgttccaccctgcgtctgcggggtcgaaagccacccccctgtgagggtggtgcccagtcatcctgtccttccagaatcctccagaactgccacgacgacgcggccaagttcgtccatctgctcatgagccccggctgcaactacctggtgcaggaggactttgtccccttcttgcaggtgagagcctgcgtctacaccacaggccttatccttcacgggagggcccgcgtctacaccgcatgcctcatgggagggccggcgtctacaccacacgcctcatccctcacgggagggtccgcgtctacaccgcacacctcatgggagggcccgcgtctacaccacatgcctcatccctcatgggagggtccgcgtctacaccgcacacctcatcgctcacgggagggtccgcgtctacactgcacacctcacgggagggcccgcgtctacaccacatgcctcatccctcacgggagggccggcgtctacaccatacgcctcatccctcacgggagggccggcgtctacaccgcacacctcatcgctcacgggagggtccgcgtctgcagcgtccacaccgcacacctcacgggagggccggcgtctacaccacgcgcctcgtgtcttcccacccgcaggacgtggtgaacacgcacccggggctgtcgttcctgaaggaggcgtccgagttccactcgcgctacatcaccacggtgggtccccagcggaggggccgtcggttccagcgcggggcgcgggtgtttctgcagcggccgccgcggggcttctgcggacggggcgggcggggcccggggttcctgagcttccggaggaggcggccgcgctctgggagagtctccacccgcccgggagcccggtgttggggggactctggttttccggggtggccgcacccccttcccacctgtcctgggcccgtgtagctccggggcgtccccggccagaccctccccgctttccgcggcctggggcggcgcctcccgcagggcccttccctctgcccccgcctgtgccctggcggccccgtgcggctgagaccaagggcgcgcccctctcccggctcccggtctccgtgcggggcgaggctcctgggggtctctgcgcacccaccgcactgacagcgcccccgcaggtcatccagcggatcttctacgccgtgaaccggtcctggtccggcaggatcacctgcgccgagctgcggaggagctccttcctgcaggtgcggagcggccccctgtcccctgccccctgccttgtccctacccctcctacctccactcccttcccttccctcctcccccctccctcctcccctcccaccccctctcccacccccacccccacccccacctccaccgcgctcccagcccacccccaggcctgtgagcactggaaccccgccgcctgcggttgggggtccacggttgatctaggaggcgggtggggccgtactgggcaccaccctgagggggagccgagccctgactcccccagagctgcccccacccccacacccgcctagggagccacccccatgctggagctccccccaccgcagagttgcccccactcggagtgccccccggccccagctgcccagtcccccccacccacggagcggccccgaccctcccagccttccctgccccgcccgcagccaggcggacttggggcatccccgcagaggccccgcgctcaggccgcctgggtcctttggcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacggtgcgtgggggcacaggggcgggcgggccgcgcggacaccgagcacacccttctctcagggcctgcgggtctgcagctgcctctccttccgcactcccagctctgtgtctgcagctgcctctccttcgcactcgccgctctgtgtctgcagctgcctctccttccccagtcgctgccccgtgtctgggtccccgcgtgcgcctctgcccgaggcctctgcctgggggcgtctacagggtcagtgtgggccgctggtcctgaagctcctggcccgagggccagcagcgctgtggggcttccttgttaacacccgagcaagggcgggcaggccacacgccttccctcaggagctccaggttccagcccccaaggcctggagcagtttccatccaatcccgggctaggtggagccccaggcttagcggtcgttcatatacctccgcgggagccggtgccgcccaggtgtcctcacagcagccactgcctcccggcccctctaagagtcatccacacttgcaggaactcaaagcggcctgtggcctgtggggcttgagttttctaaaggattcctttaagtgtgctttttaccccaaaaaaccatatgaccaagactgtttcc

SEQ ID NO: 5432 - DNA, 26433 bp, human
tgacggctgccgcggtgcagaaagcgcccccttgcccggccggacggcccagcccggagcgaacggggagaggagagaagaggaccggagggagcggagggcagtgcagggagcggagaaggaggagaggagagcagcgccgggagcagccgggtctgcacagtcgcgggtcgggagaggcggccgcccccacccccggcgccatgcgccctcctcagcctgaggaatgcgcgcggcgcgggccccggccccagagcgcctggcgggcgacgcatggagcgcgctgagcccgggccacgcctgcagcgccccgccggccccggcccggccctgccccgagagcgcggcgcccggcccggcccgcggagagccctgcgcgccggcggcatgcgactccgcgagcgctcgctgcgccaggaccccgacctgcgccaggagctggcctcactggcccgcggctgcgacttcgtgctgccctctcggttcaagaagcggctgaaggccttccagcaggtcagccccgcgcgccccgcggctgcccgacaccgggcgaggcctcccggcccggcgagccctgccctcccggccccgcgtgggcccccgctcgccgctgctggccgtgcacccgttgttgcgtggcggggcccaaacgccagatttacagggccagttgtgggcgcaggggacccgctcgggccgcacgccgccgaaaaccgggtgctgctctgtgggaagcggtgccaagcttgttaggaaaaccgggctttgaaaagagcactcgctcctttcccgggagttttggctgtgagtgcgcgccttgctgtgatcaaccaaggcgggtgagagccgtcagcgcctgggagtgttcgctgcagacagatttttaatttaaatataccttgcattgctggtaataaacatcgggaaactccttcacccttcgtaaaggcgtcgggtgggtgaaactttcccggcgttattgcaatacccagcattccttcccactggctaacttaagagtcggttgagatatcactcacataccggactatttatgcagcgtggttttattcagtaactcagtggctttgaaatttatttatttatatttatttatttgagacgaagcctctctgtttcccaggctggagtgcagcggcgctatctcggctcactgcaacctccacctcctgggttcaagtgattttcctgcttcagcctcccgagtagggctaatttttgcatttttagtagggacggggtttcaccatgttggccaggctggtcttgaactcctgacctcaggtgatcgcccacctgggccttccaaagtgctgggagtaggggcgtgagcctccaccccagctggctttgaaatttaatctcagttctcataagtgctcagggaagtaaaatttgtgtctgtaccccgtgtatattgtatgagttagttttacgagtaccatgtgatttaaacgtgtaagagtcttcctgtgacaatcccagtataatttgagaatttagggtttggctgcggccgaatctgatccgaatttcatccagacagggtgtgcgtggcgggcgcctcacacccacgtggcacatcagacgcgcttttcaaactcagttccaggagtctggaactagtggcctaacatcaaggtgaaccaaggcatcctgcttgaagggggaggaagacccacttctttctgttgatattttaattgaaattttttctgtaagatctcacatcaacttttgcactccttcggagtttttgacctctgtcttccaggttttgacattttgcctgtaagtgggtaagggcgaggctggtgtctttaaaatcctcttaacctgcgaagagcgagatcagcctcgtgcgggatttgctctagatggtgggaggtgctgggcggtgcgggctcgctggtcgcagagtcaatgaggtgattagctcgcacgtggctggatgaggaagcccttcagccctgcagtggggccctggctcttctgtggggggctgtggtgacgatgcacctgtgaggactgtttatttttaaaaagtcagtttctgggaaatcatgaattccgtttacagaagtttgcttcattttacagaaaataggtttccacgtttttagggagtgaggacagacgtgtgaaatgcatgttgtctgaggggtggtggaggaattacaggcatatttgggggtatttgtgggggtggtgttgggggagaaggggacgtttcctggctgctttcactccgcgcatgagtgtgggctctgtctgttgggtccaccccacttggacacaccctcagggttgtcagggagcacccgtgttggagccactggacgtgttggggtgccgcacctccgccttcggacgctcccggccgggcagcacggtactgttttcaggggtcctctgacgggcacagccttccacggccaacgttggccgcacccacgagcccctggcgggtgctcctgagcttgatcttctgactgtgcgacgtcccacctgggcttctgttcccactaaccccctggcgggtgctgcctgccccgatggtgaacccaagctcctcctcctccctgccactgcccacttccctgtcaccggcatccttgacaaaccaaactcggggggtgggggcgttcagcgaccgccggccttgggaacggaacagcatgcgttcacgccgtgggtccggggaggctcccgtgtgacgatggcgtgttacacgtactctcaccgtgggtccggggaggctcccgtgtgacgatggcgtgttacacggctcatgctctcactgtaggacccagcatgtacctggagtggggccgtgcagctgcttggctgagctcttcttgccggagccactgcctgcgcctcctgcccagggattctcgggccttctgtccccgggcaacagcaggacagctcagaccttgttcccagcccaggacagctgtgctgcctagcctggccctccccgcctggggagtgactctcccgctccccacacactgactcagcacacagacgcccctcttcacctgtcctggtcacacagacactgtccggcgtccccacggggtccttcgggtggacgcacagaccctacacggcaccacgcatggctgaaagcgccgtcccctacgcggcagccccgctgtacttggaactgacttcagcgtggtgacagcctgggctctgggcgtccctgacgcacctcctgctctcaccgccagggcacgtgccgttcccctcccaaggccagtggtcaccaaaacccttgcagcctttggtttggccaggacgctgcccaggatgccactccctgggcagtggcagggagaaggcagggcttgggttccccacctggcagggagctgcagcaaggggggttaacgggaaacagaagcccgggtgggaacgtccacacagaagaccaagctcaggagcatccgccaggggcttgtggacgcagggagggtgccggatcctcccctcgctgtgttgcgcggcatccaccgtcaccccttggctggtggacagaatgatccccacgtcccccagcccagccttccgagctctgtggagactcacgcctcgctgcagccgtggctgcaggcgccagtgcctgggctgcaggtgtgggtgcaggccccagccgacgtctctcagcgtccgttgaggcccggttgctcggctgcagtcatgtgtctgagtgaatgttagcccacgtgagctctggcctactcagacacctgcacctgctgcgtttctgtgttgacccctccacaccagttctccctctttgctagagaggggatttttaaacccacacgtggggcctctcatctccgtgttcggctcctctgtgtaaacaccgacctttttgactcctgtgtttagccgtccagcgtgcggtttgcaggtgtagctggcagccctctaccagccctctcagagggtccctgggagtcaagtgctgggccgagaagaatgctcagagcttgcagcaggccctgccttccagggggtggccgtcatctgggtgggcgaggggctcagctggaatccatgagtgtgcgtcccggccaaaccccccgtccctgattccataccacagcctcccgtgcttccgcctcccgctgcagagtgggggccgctgcagagcgggggctcctgggggcacggctgtgcgttgcagcccgtactgagcgtcccttccgccggccccctgctgctccggcacctcctctgtggctttgatcgtggtgtccggtcctgctgccgtgggggcgagggtcatttctgctggtcaccgcgccctgcctgctgtgcgcaccctctgcacatgcgggggtctgcccgaggctggtgtcgcgagaggatgtgtcacggtgcacgtggcctgtgttctcggggtacactcacctgcacccatcaagcgcacgcacttctacgcaaaaacaggcagcctcagtgttaggctcagcctttgtttttggtcgtatatggacgtgttttgcaaaactgtgggtgtactctggaagggcgacacatgtatctgtgacttctggaattgtgatgagtcagggagctgccttctcagtgccctcaacagaaatagcttgttgggagtcagggtgtcgcctttatcagtgcgctttgggtgacgggctctttacgaagttctttttaaagtacacgtactgaggaggatttaaagtggatgacctggccgccacaggcccctctggtttgtctgaactttttaatgaacaggcggctggctttagaattcttcttccacatacatgcagctgtttttgctccttctgtgtttaccgtagatgcctggcctcaccggctacgtttggggcagggcagcagtccctgtgattccttcagaaccccctgagacctgcagctcagcccgagaggtggccagttcccaagtgagctgtgtgtgttgaaaagaatgtgtgctctgcagctgtgctggggccgagtctatttctgtccatgagattaagcttgtaaatcttctgtgcccgcatggggtggttgtgttgtttgttccatctctcgtctattagtgcccatggtgggtggtcccggctttccccccgtcggtgcccagggtgggtggtcctggccttcccccggtcggtgcccaaggtgggtggtcccggccttccccccgtcagtgcccggggtgggtggtcccggccttccccgtgtcggtgcccaaggtgggtggtcccggccttccccccgtcggtgcccaaggtgggtggtcccggccttccccccgtcggtgcccagggtgggtggtcccggccttcccccggtcggtgcccagggtgggtggtcccggccttccccccgtcggtgcccagggtgggtggtcccggccttcccccggtcggtgcccggggtgggtggtcccggccttccccccgtcggtgcccggggtgggtggtcccgtccttccccccgtcggtgcccaaggtgggtggtcccggccttccccccgtcggtgcccggggtgggtggtcccggccttcccccccgtcagtgcccggggtgggtggtcccggccttccccgtgtcggtgcccaaggtgggtggtcccggccttccccccgtcggtgcccggggtgggtggtcccggccttccccgtgtcggtgcccaaggtgggtggtcccggccttccccccgtcggtgcccaaggtgggtggtcccggccttccccgtgtctgtgcccggggtgggtggtcccggccttccccccgtcagtgcccggggtgggtgatcccggccttccccccgtcagtgcccaaggtgggtggtcccggccttccccgtgtctgtgcccagggtgggtggtcccggccttccctgtgtctgtgcccggggtgggtgggctccgccttgcctagcgggctcagtttgtgtccagtggtgtttacttgatcagtgccgaggctgcgttgtcaggcatggataaagttagcatcagcctgtcttcccctgactgacctcttcagcgttccttggtggcctgtctgtctccaggtctgtccatcaccttgtgtcacttcatggatgttaatacagcgacaccagctttctctactgtctgcctgctctttttccatctcaaaaaaaaatgtgtagcctctgggtccttaagtcacatatatctcctgtctttctgtcctctgtgtctcccatgtacgtgaatgctgttttctttctgcagtcagacctttgtcttgtaactagagcactcggtgcattgaggtcgatgttgcctgctcatccgtgtgatggactgtgaccgtctcatcctgcacctctgtctcctgctctttttcagcttggtcgccttttctctcgtttggagtacacgcttcctactagctcactgtttatcctacaaatgtcaatggctggccgggcacggggcctcacacctgtgatcccagcgccttgggaggctgaggcaggagaatcgctggaggccaggagttcaagaccagccagcacaacatagcgagaccccgtctctataaagaaaaaaaaaaggaacgtcgactaaatttttcaaagcccaatattaatcagtatcttttcctccaactcacaaaccgtctcacactcatccagtcagcatgtcactgacaggctgttgtattgactttttttttttaattgaacatacgttgttttcactgatttatgttttttaaattgaacatacattgttatcactgatttatgtggtcagctgccgaggttttcccactcattaccgctgacctgctcttcatcccttctttcaattccaaccttccctttgggagctcttggcttctccctgctgcatttcctcagcttttgccccgtagagtgtctgttaatggggtgcatgctctgtaaatttggggctaaaaatgtccaagtattcatctcacttttttttttttgagacagagtctcactctgtcacccaggctggaggacagtggtgcgacctcagctcaccgcaccctccgcctcccgggtttaagcgattctcctgcctcagcctctcaagtagctgggattacaggcatgcgccaccacacctggttaatcgtttgttttgttttgagacagagtctcactctgtcgcccaggctggagtgcagtagtgcgatctcagctcactgcaacctctgcctcctgtgttgaagcgattctcctgcctcagcctctcaagtagctgggattacaggcatgcgccaccacacctggttaatcgtttgttttgttttgagacagagtctcactctgtcgcccaggctggagtgcagtggtgcgatctcagctcactgcaacctctgcctcctgtgttgaagcgattctcctgcctcagcctcccgagtagctgggagtacaggcaccctccaccacacctggttaatcgtttgttttgttttgagacagagtctcactctgtcgcccaggctggagtgcagtagtgcgatctcagctcactgcaccctccgcctcctgtgttgaagcgattctcctgcctcagcctctcgagtagctgggagtacaggcaccctccaccacacctggttaatcgtttgttttgttttgagacagagtctcactctgtcgcccaggctggagtgcagtagtgcgatctcagctcactgcaccctccgcctcctgtgttgaagcgattctcctgcctcagcctctcgagtagctgggagtacaggcatgcgccaccacacctggttaatcgtttgttttgttttgagacagagtctcactctgtcgcccaggctggagtgcagtagtgcgatctcagctcactgcaacctctgcctcctgtgttgaagcgattctcctgcctcagcctctcaagtagctgggattacaggcatgtgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctcccgagtagctgggattacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctctccagtagctgggattacaggcatgcgccaccacacctggttaatcgtttgttttgttttgagacagagtctcactctgtcgcccaggctggagtgcagtagtgcgatctcagctcactgcaacctccgcctcctgtgttgaagcgattctcctgcctcagcctcccgagtagctgggattacaggcatgcgccaccacacctggttaatcgtttgttttgttttgagacagagtctcactctgtcgcccaggctggagtgcagtagtgcgatctcagctcactgcaacctccgcctcctgtgttgaagcgattctcctgcctcagcctctcgagtagctgggagtacaggcatgcgccaccacacctggttaatcgtttgttttgttttgagacagagtctcactctgtcgcccaggctggagtgcagtggtgcgatctcagctcactgcaccctccgcctcctgtgttgaagcgattctcctgcctcagcctctcgagtagctgggagtacaggcatgcgccaccacacctggttaatcgtttgttttgttttgagacagagtctcactctgtcgcccaggctggagtgcagtagtgcgatctcagctcactgcaacctccgcctcctgtgttgaagcgattctcctgcctcagcctctcaagtagctgggattacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctctccagtagctgggattacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctcccgagtagctgggagtacaggcatgcgccaccacacctggttaatcgtttgttttgttttgagacagagtctcactctgtcgcccaggctggagtgcagtggtgcgatctcagctcactgcaacctccgcctcctgtgttgaagcgattctcctgcctcagcctcccgagtagctgggagtacaggcaccctccaccacacccggctaattttttttatactctttttgttttttgttttctgtttttttttttttgttttttttttttttagtagagatgaagttttgccatgttgcccaggctggtcttgaactcctcagctcagacagtctgtccccctcagcctcctttcaaagcgccaggattgcaggcacgagcccggccggtttgagggttttcgcagcatcctggtgaccgtgagtttggtttgcaaacctgcaggagagtcggctgtagccgtcagttctcgggggagaactcccccctgcccagctcgtaccagcagctccaggtgaaggctgctactttcattcctggggccggaggcgcgctggggatttacttggagctcattcttcccactgaaggtgacgcgttctgggagcttccccggaggaccctgcgttttgcctcctcttccccagagctctgcaaggctgtgagagatttcgggtgagcccgctcggcccacgcttctgaaggcagagcctgttcaggctccacgggcttccccgggttcttccttccaggcagctgtggcctgaggtgtcctcctttcctgccagcctgtgggcgccgtctagaagacgtttgtcaactattctgtccagggttcttggcagttttcatcaggaaggttggtttgtgtacccaggtcattgctatattgccaaacacaggagcccgagagctcactgcagaatattcgcggggtcagttccgtaccccaaatagcagagctgtgtgaacccagcgtgatgaaggaggaagagccgcaggctccacagtgggacccccacagcgagagacgggaaggcgccgctgcgggaatgcgttgtgggctcgggaagatgcactgtgggatcgcgggcttggggagatgcattgtgggatggtgggcacagggagatgactgtgggatggtgggctcggggagatgcattgtgggattgcgggcacggggagatgcattgtgggatcgtggactcatggagatgcactgcgggatcgcgggctcggggagatgcactgcgggatcgcgggctcggggagatgcattgtgggatgctgggctcggggagatgcattgtgggatggtgggctcggggagatgcattgtgggatcgcgggctcggggagatgcactgtgggattgcgggctcggggagatgcactgtgggatggtgggctcggagagatgcactgcgggatggtgggctcggggagatgcactgtgggatggtgggctcggggagatgcactgcgggatcgtgggctcggggagatgcactgcgggatcatgggctcggggagatgcactgtgggatcgcgggctcggggagatgcagggacctcctgccccaggacacagaggtcacgttctgaatcacagggaaggggtgtgcccttaggtaaagctgtgctgaaggagcactcagtcggcagctactgcgggaagcctgctctgccccaggtcacggaggcggcctctgttcctcctacatggggatcagagaaaaacaactgagtctcaccgtgggtgagggtcctgcagcgacagcagggtgggcacagttgaggcgctgtcagtgggacccttgtgacctggggtgagggtcctgtgggagtagcagggtggggacagttggggcgctgtgggacccttgtgacctgcggtgaggatactgtggcagtagcagggtggggacagttggggtgctgtctgtgggacccttgtgacctggggtgagggtcctgtgggagtagcagggcgggctgttttctctgtgtggacactggagcttggacccagtcctggattgatccaggcagtcaggattgtgggtgcaaaggccctgagctgtggtccactggtatgcggacttcctccctggacccctcctccatggcagttggttgaggaggacacagccccgtcccctgagtagttgatggaggaggaggaggacgcagccccattccctaggtagttggtcaaggaggacacagccctgtcccctgagtagttgatgggggaggacgaagcctcgtcccgagtagttgatggggaaggacacagccccgttccctgggtagttggaggaggaggaggacgcagccccgtcccttcagtagttgatggtgggggaggacgcagcaccgtcccttgggcagttgatggaggaggacgcagtacggttgctgatgctgttaactgtttcagatggtgttttaacatcacgggatgagatcaaatgtccacctcgcaggttgtgtagagatgcaagcaggagactcttgagtgagtgttctggggcctgcagatatactgggtgaggagagtgctggtgctgagtggggccaagagcccgtgggcgtgggctgtgcaccgggtgaggggctgaggcgtgtccgcagcagtacctggtggtcgaccccttctcctggctgtgtggttgcctgccctgcctctgcctctcagaatgtgagtcttccgggctccagggacagggttgcctgtggacggcacctgtgcctctccacgtctgagctctcaggcgtctggggtgcgtggctgcccttttccccaggtccctgccaggtgtggtggggtcagtggtgtggctcatgggaatcgggagtgggtcctggctgggctctcaggtgcctggggcacgtagctgcccttgtccccagggccctgctcggtgtgatgggggctcagtggcgcagagccgccacccagagtggggtccatggcagcatggtgtggcctcctgggtgaaggtgggccctgcagtggagtacgtgtgtggtcccccgcagggattgcagtgtgtcctctcccggctgggatcaggtggcctcagcactgtcggccctagagaggccccgtgtgttgtccgggtgaagaaggcgttcgatgctcccaggttctaactgagcgctgtctgtcgactcttcaggttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggtacgtgtcacgcgtgggacgtggagcagccgaggtggtactgcgggcatgtgagggtgaggcggagcggccgtggtgggtgcgtgtcacacgagcgtgagtgaggcggcacggccgaggagggtgcgtttcacacgtgtgcgggagcggcccaggttttctctgaggttatagttgtggtctgaggtttgctgtctggttgctgctgtgtgaattcttaagcatctgaaatgcgagtgggaattccgtctgcattctcatcctgatgctgtgaagagcgcaggcccgccctgtgccaccctccccttctctcccctccggggccagtggcgccagctctcgtggctctcggaggccgttctgcaccctcctggccttgcccctttctgcccgaggagcggccatcccaggctgggcagctgtggacccgtctcctggcagcagccccatgggcccatttctagactcaccctgagtgctgcggcgcggcgtgcatcattcgccgcctgctttccttctcagctgcatgctctccaggctgaccgcctggacgcccacagatggagcacactcagtttagtgtctgtccgttaccaaggcaaggcctacaccagagatgcgtgtctggacccctggtgggtggttgtgtttccagggacctgtgcccgcatctccagcctcctaccctccaggtggagtcgctggccagtggatgctcccacccctccaagtcagagccccagagcctcggtgcacggtacatgtgagcccctcacggtgagacccctgccccccagccctctccagctctgcagctgtgaagggggtcctcgggagtgagcaggtttttgttttttgggtttgcttgtttgagacaaagtcttgctctgtcacccaggctggagtgcagtggtgtaatctcggctcactgcaacctccaccttctgggttcaagtgattctcctgcctcagcctcccaagtagctgggactataggcatgcaccaccatgcctggctaatttttatatttttagtagacatggggtttcaccatattggccaggctggtcttgaactcctgacttcaagtgatccgcctgcctcggcctcccaaagtgctgggattacaggcatgagccactgcacctggccgggttttgtttttttaacttattaatacagtctattaaatgagttggttttgggatgttaaaccaaccttgcattcctgggataaattccgcatggtcgctgtgtctcatcttttttatatgttgctggattccaataattttgcaactggattcacagagaagacagtgcttggtagttttcttgtgagtcctttgtctggttttggttttagggcaatacgggtctgaaagaacacattaagtgtccccgccctttttctattagggattgtgtttttaaagtattttaaaaagttttgttttataaatatgtaaaaacctccatggttacaaagtgagcactaacaaactagacacattcaggtaagtccaggttctgtccctgtctgtgctgtttctaccccagaggtaatagtttccatagctttggtttatcctcttattgttattttagcttttaatatgagcaattatgtacaaatatgtgtatgagtatgaacatacatacttcttgcatttcttagagaaaaattagcatgctgttgtacacttgcatatttgtttttgctaagtcactccgtatttgtagaggtgtccctgtcttgtacggcagtgtggggccatgaaaggaccagataagtcacaaccatgcaaaaccatcttccagtaaaaattaggatcattctataatcatttttgttgaaatattagaaactttcttacagtcggttgcaaacatgtagtgaatgaaaagaactaatatttacctagtatgctgtaacttaaaacaccagaagcattaagaattgtttcatctctcagtaaaaacttgccaaaagtagttacagcagtgccatctccttgtcccgtgtggagtgagcacctgctccgtgccctggcagactcactcgacttaacacgccttgctcagcttccgcgttttatccttggtgctcttgaagttgtggggtatctctgagagttccttcactgggaggtctctttgctggcattccgtctgctgggacaccttcatccttttcagtacagcctccgttgtgtggagaactcaccctcgcggagtgcgcccggccccacccacagggtctctgcgcgcctcgggctgggtcagacacctcttttgcagctcacgcgctgcgtccgcttcgggtcctacaaagccgctcgcgcagcccagtgaggttcctgcatgggacccatgtattcccctcagtgcttccccgccacgatgcccctccccggccgcggtgcttccccgccagggcgccgccccgccctcccctacccccgccgcggtgcttccccgccagggcgcccgtccccacggtgcttccccgccacagcgcccctccccacgcggtgcttcatccccacggtgcttctccccaacggcgcctccccccaccgtggtgccgccccccacagcggccaccccccctccgcggtgcttccccgcctcggcgcctggttctcatgtgcgcgtttcatgtcattttccttccaggactcagttctcggtgtcacctcgcttccacgcacagcggcactggccttggtggccgtctaaggtagtgaggctttaagacttgaaagaacctggtccgttggctggatgtcacgtttggtggtaaaaagcaagttttgtcgttgtcttcgacgccccagagaagcagggtgacctgggtgtgacccagcggggcaggggagagctctgagactgaagttgtgtcgcttgcagcgtctgcaccgctgggagtccgagagacacctccacaggccccactgtgcctgcacgcaccgacccggccctgcaggcggagagcatggtgctcgagcacccaccgtgactgtgggcagaggccagcagggtgtgcgctgtcgcgacttaatccacctgcgctgtggcggcagaaccctgtgagcgtcccgcgtgtgtgggggccgcaggcaaacttcagcttccccgccaaggctgctgagcctgtctcggtggcgcccagctcgccgccacctgcagatgtccgtccacgtctccatcgtgtgcctttgggacggttttctgtgagccgggcccccggcccaggggacgaacgagtaggggtgtcactgccgtttcgagttctccccgtcgcgtgagtgactgaatgagggcctggagtcacagctccacacgcgtgttgtcaggcgggtggactttggccggcggctgcttgagaactcacgtctgaggggactttgagtttgatgaggggggtccccccgtggatcttagccgtggccgtgcagcgaggtccgtgtgtgccttctcctggcccggttcttcctgtctgtgtgagtcagggctgatctcatacatcatttcctccctttcatcattgtcactcctctgtgttttctctgaagccgtttgagacagagtcatcagctccttcacctccaccaaactccaccccctcagctgcccccacaggaaaacacacttttctctttgttaatttccttcaaacgttgttggctaattcagggttttcatttatggagactattttgatgatttacattttttctaaaaattttttgcgtaacttagaaatttcttgctctaaagcttttccttgtcttgtacgatttacaaaatcttgatcgtatctgcatcatacatagacactttcttgacagaatcatttatttccggttcctttcttgatccgtcatgctacacactaacgtatatctctttcagtaaagcagctgtcagtgttacagattatttcagttctttctctcatgaatatctatggtcatcttttttacatacacttccttctgtcattttttttagtttattgaatagttttttgtttggccagctgtattgtcatataattacacaccctaagattcaccaattttaagtgtacaatttgatccattttggtaaagcacacacctgggtatccatcctcataggcaggaccggccgtttgtcacctgccgcgggtgtcccacgtgcctccttttgcacctcatcattcccctcttttctccctggcccgggccagctgcagatgtgcttccggtcgctgtagctttgcctctcttagaatttcacatgaggactcttggagcattttgtctgtggtttctaacttcttcctggcagcatctttattttaaattttattttgaatggacaagtaatatttgtgtatacagggtacagcaagatgtttcgctatgtgtgtgtgttgaggactgattaagtcctgtggtgtggatactgtggggctcgctgtgtggctggcgaaggcgtggttaccgtggggctcgctgtgtggctggcggggtgtggatactgtggggctcgctgtgtggctggccaaggcgtggttaccgtggggctcccgtgtggctggccagggtgtggatactgtggggctcactatgtgtccctggccgtatgggcagtttcttttctatcactgagtagcttctgctgtgtgtgtgctccatctctcccctgttccagggttgatagacgtctggttgctttggtttttgcttcttgtgagtaaagctgctgtgtgtctgtgcactgatttacgcagacatgcttgcattttcctgaggtgattaataccgcagaggtgagctctgcctcatctggtggccacatgtttagttttgtaagaagctataaaactgcttccagggcccaggagtggtggctcactccactaatcccagcacttcgggaggctgaggtaggcagatcacctgaggtcaggagttcgaggccagcctggccaacatgatgaaaccacatctctactaaaaatacaaaaattagccaggtatggtggcgggcacctgtcattccagctactcgggaggctgagacaggaaaatcgcttgaacctgggaggtggaggttgcagtgagccaagatcgcaccactgcactccagcctgggcgactgagcaagactgtgtctctacgcaaaaaaacaaaaaacaaaaaaccctgcttccggggtggccctgagtgacgcatttccaggcagcagcgttgacccctgcgggcacgtggccacacgctttgcctttagccgttctgtgcgtgtgcaggcgtcccgtcctggctgcactcctcatttccctgatgtacgtgttgaccaccttacgtgtttctttctcatcagtttgcctttttttcattttggggcagctgtgttgagatataactgatgtgggatgcatggtgcgtgtggaaggtacaattcaatgagctttgacgtctgtacccacccatgaaactatccacagcaccaagacaataggcgtccctgcatccttgcgcttgagcgggcacgtgcgctggacttttctctgctgctttctgacgcgcacctgccctcatcccacgctacctcaggcctcctttctgtcaatatagattagccggaattttctggaattttatgtaaacagaatcagacagcaggcacttttttttattatgggaaaattcacacaacagaattcaccaccgtaaccatttggagcacagaactcggagacgtttgtggcatatacagcacggtgttccatgtgcgtgtgtggagggccggatcgcgtggtgttccgtgtgcgcgtgcagttccacttccggctttctggggaacctgcacgctgtcttcccgagtggctgcaccgttgttcgttcccaccgtgtgaattttagagccggtccctccgttgctacgacagcctgctgggattacatgggcatcctgttgactccagatgaacttggaagaatcttgaccatattgaggcttccgtctcatgaacgcggtccagctctcccttatttcaggcatctttcacttctttcagtacgccttgtagtttggtcttgttcacggttcatcacattgatacccaagcatttcctgtttctgatgacactgtacgtggtatttttttactttaatatgattgtcaattgtgaatgttgagaagcactgttaggttttatatgtggactttgcattttctgaccaagtttaactcagtcatcggctctaccagctcaacctttaagtccggcagagtctctaacgcacggtcaggtcatcttcaggtgagcacagttcagcctttctcttctcgtctgcatcggtgtctcctccctgactttctgtacacaggctcggcctgccagtgcagtgctggagagccgtggagagcacgccccttcccgcctcgggctcaagtcgtccgtgacgcagcggccctgcctggcgtccttcatcagactcaggaggccccttcccttttggtttcttgtttgctgggagctcttgtgttttttttgagacaggttctcattctgcccccgggctggagtgcagtggcatgatctcagctcactgcagcctcgacctcctgggctccagtgatccacccacctcagccctcccgagtagccgtgactactggcacccgccaccacacctggctgattttttcttttttggtagagacagggttctgctatgttgcccaggctggtctggaactcctgggctggaaggatcctcttgcctcagcctctcatggtgctgggatgatgacaggcatgagccatcacgcctggcctcagtttactttttaaaattataaaagtgccttgaagtttgtccgggatgctaaatgtgtatttctgcgtgtattgagagggcagtgaggttttcctttggtcctgtaaaaggtgaatggacctgactgacgtctgagtgtgaaggcagccccggtccttgggtgagcccccggtccctgttccaccgcagcgtgcattgcccggccacgcaggggtagcgtctgtggtcatgaaggactggtcttgacctgactgacgtctgagtgtgaaggcagccccggtgtttgggtgagcccctggtgtttgggtgagcccccagtgtttgggtgagcccccggtccctgggtgagcccccggtccctgggtgagcccccggtgtttgggtgagcccctagtccctgggtgagcccccggtgtttgggtgagcccccagtctttgggtgagccccctgtgtttgggcgagcccctggtccctgggtgagccccggtctttgggcgagccccggtctttgggtgagcccctggtccctgggcgagcccctgctccctgggtgagccccggtctttggatgagccctggtctttgggtgagccctggtctttgggtgagcccctgctccctgggtgagcccccggtccctgggcgagccccagtctttgggtgagcccccggtctttgggtgagccctggtctttgggtgagcccccggtccctgggcgagccccggtctttgggcgagcccctgctccttgggtgagccccagtctttgggtgagccccggtctttgggtgagcccccggtctttgggtgagcccccagcccccggtccctggtccaccacacagtgtcacacttctcctatgtgttgggtccacattgccaggcctcgcaggggttgcgtctgcgctcgtgaaggactggcctgcggtctccttttcttgtgatagcttggtctggtttagcatcggggggatgctggcctcggagagttgcttggaaaatgtcctttagaattcacttttctggagccatttgtttagaatgggtgttatttttatttgaatgtttggtagaactcatcagtgaagccatttgggatagttttctctgtgggaaggtttttaatgacagcatgaattgtttcaataaacacaggctgtctgtatcatcttttctcttttttttttggagacagagtcttgctctgtcacccaagctggagtgcaatggcaccatctcacctcactgcaacctccgcctcctgggttcaagccattctcctgcctcagcctcctgggtagctgggattacaggcatgcgccaccacacccggctaatttgtgtatttttaggagagatggggtttcaccatgttggccatgctggtctcgaactcttgacctcgggtgatccacccgccttggcgtctcaaagtgctgggatgacaggcctgagccaccgcacccggccactgccacccacttttagaccatcggatctcacaagaactcaggattacgagaccagcaagggggctgtccaccctcatcacccagtcaccccccagcagagccctgctccaacactcaggatcacagttccccgtgagacttgggtgggggctccgagccacagcccaccactggttcatgtgaccctgaagactcctccggctccgcgatgtcactcgctcacatagcttggcagcgttttcacatctttacgtgtctgcagatcgtcctcttgtcccgtcacccgccgaggaacgcgtgctgaacttgccggccgtggttgtggcgtcctcctttctcctctcacacctgtcggttggtgtcggcgtgccctgtgcgactgtagacgctcgggactttgtctgcctcgcgagtccccctcagcagcaccatcacgtgggccttggggccggcggtgtttcctgctcagggagctactctgaggtcagcagagccataatggaatagggttcagcagtacacaggcagacgatccacacagagcaaggtgggcagacgatccacacagagcaaggtgtgtgagtcccacacgcatgtgctgagcgagggaagccaggtctaaaagtccgcagatggccgggtcccgttgccgtgtcctggaaaaggtgaactggagccacggggaggaggcctgggggccgtcgccgtagcggactgcggaggggccgaagggactgtcagggctggcggcctcgttccctgtcctggccgtgcgggtgggcgtgccgccgcgttgccgggccccacaaggagtcggtctttctgtgtgtcgatcacgaaaagacttttaaaagtcagatcagggtatctgatgttttattccctttcccataaggattttgtgacattcaggtaaaactgctttcctttgtatcttttgcattttagagttgattatctccatttactttaggattattttaaattatgagctaattcatttggaggtaattttcgggtttggtgtggtggggggactgtgtgcccagcactctcccgctcagttctcatcccccagacgccgggggtgcagctgtctctggttgcagtgtcatccctgtagtcccagcactttgagaggccaaggcgggaggatggcttgcggccaagggttccagaccagcctcggcaacatagtgagacttcactgtagaaattaaaaaaattacccaggcatgatagcgcgcacctgtggtcccagctacttgggaggctaaggtgggaggattgcttgagcccgtgaagttgagactgcactgagctgtgatcacacactgcactccagcctgggcaacagcaagaccgtgtctcgaaaaacaagtagaataaaaatggatcacgctgtgatcacacactgcactccagcctgggcaacagcaagaccgtgtctcgaaaaacaagtagaataaaaatggatcacgctgtgatcacacactgcactccagcctgggcaacagcaagaccgtgtctcgaaaaacaagtagaataaaaatggatcacgctgtgatcacacactgcactccagcctgcaggtctggacacatgagacgctatatcctgcacggctggatagatctgatgctccatccctgccaccgggtcatgacggtgtgtcttgcacgcggtgaggagcacagatgtgaaggctcacacatccccccatccctgggtgttgagcgcttggggtttgaaacctgcacggcctgtgagccagaatggtctcatgaggtcaaaagcgtgggactagcactagcccaaggacccggtgctgcacccggctcgttccctcccaccgcaccgggacgcccttccaggtggccagggctgagctccgtcaggatcctcatcacgggagccggcacgtgcctgtgcgtcctgcggggcccggcccctccagccgcacacggctgccttcaagtcatccacaggtgcgccagccggagcgcgtcctttcccatagcagcactgcaatccccgctgtggcgcgcagccccctctgcagtcccccacgcccccccgtggtcactcccgccctgcacctgtcaggacgactctgccacagtttattcctccagtccctgctctggcgtccggctcctctcgcctggggcaccgtgaaccaagcagccgacgtccccatctgtgcaggctctcacgggcacgggccctcttcccactggtgtgcttctgggaggacagatgtcctggccgggccacggggctttacgctcagccgccccgtgggccgctttcccggcagctgcgtggcgtcccagttcccccagcaacgcggaggacacccagctgcctggcagcctcgcgggacctggcgtcttcagtcctttttgtctcagccgcgcgtgtcatgttcttgttgccacctctccatgccctgtgaaccctgccctcgccggcgccagtgctgggcgcttccccttgtctacggccaccgtgcacccctctccggagggcagtgcatgtccactcggtcgtgttcgggcctctttctcactgatgcttaaaattctgcctctgagtccctcgtcagaatctcgccttgcagagacatttctccctctgtgtcatgtcctgtcatggtgttcaccgtgccggtagctgaccctgagtcctgcgctggggcggtgcagcggtgctcccttccttcagggagcgcacgtgtggcccgtgaaagaaaccttggccgcggcagagccgtgcagcgtccctcgtttccttccaggaggggccgctgtttggcctttcacccttcgggctgggatcccctggtattcagtttgtgtgaagtgtctttgcctgtggatattccacggggctctgtcccaactcacttccttcccttgctctcttaggccaccggtgcccgacagagactgactgagtcttcattactctgactttacaggaagggttgaaaccgggcagtgggactcatatccaccaacttggtccccctgtgagttcttttgtgttccctggtaagttttcacatgagcctgtccgtgtatactacaaaccccaaaacaacaggccctcggtgcatgtggatggggattgctggactctgtgggtggggatcgcgtggactctgggtcaacagagtcgtctggaggaaactgcagtctgtgaactcagcagtgaggtccacctcaccacgttgaggtcgtctttgatttcacccagccgtgccctgcagtttgctttgtagacactgtgtgtgatttttgttccatttttcgtaggttgatttttcatgctcttgatagatggcattattgaagattttatttttagttgtttgttgccagtatattgaaataatttatttttgcatatagtccttggatccagcaactttgctgaagatacttattaattcccgtatttggtaagcatttggattgtctacacagtgtgttgcttgtgaatcatgacggttctgcctcttcttacccgtcgtcgtatctttcggtctttcccttgcctgctgccctggctcggccgtccaggcggccttggtggtgacactgtcctcttgttcccagcacagggaagaagtgttcatgtgtcatcgctgtctgagcagctggggtgtttcgtagaggccctttgtctgagcattcaggctgctgtcaagaaacaccatagcccgggcagcttgtcaccagcaagacatttactgttcacaggtctgcaggctggaagatctcggtgtggcagagtggtgcctggttcatcgacggcgccttcccgctgcgtcctcacggggtggaaggggtgagggagctctctggggtccctcagaaggggactcatcgcattcatgaggccccacctcccaacaccatcgcctcgggggagaggatttcagcacgtggatcttggggacccaggcattcaggccatagcaccctttatgagaataagagtgtccctcctgattctggtttcctggtctattattattattagatattcctgttctattattgccgagttggacttgctactgtgtgttctgtgtgggatttctgcctctgctctccagtgataactggcctgtgacttcctgtgtccctgaccgcgtccaggctgtgccagcctcggaacaggcactgggaaacgcccctcgtttttcttctccaggggaacgcatgtgtgatttcttccttcaatgtttggtcgactcatgggagcagcctttgggggctggaattttcttggtgggacagttttaaattatggacacaatttcttgcagaaacagctctttcagattttctattgtagtttattttttgacttgttcatcggggagtctgtttcagcagtcatctgacttacaggcataaagtgattcatgagcatccactatctgatgtttgtaggatctgtagttacagctgacatggctaatctgtatttgctctttttttgagacagagtctctctctgtcacccaggctggagtgcagtggtgtgatcgtggcttactgcaacctccacctcccaggatcaagtgattctcctgcctcagcctcccgagtagctgggattacaggcgcccgccaccatgccaggctaatttttgtgtttttagtagagacgaggtttcaccatgttggccaggctggtctcgaactcctgacctcaggtgatccacccccctcggcctcctaaagtgctgggattacaggcatgagccaccacgcccagccagccagggttaattaatttttaagaaatctttcaaatcatcgagttttgattttgttgattttctgttactatttactttgcgttccatctctgccatgtatttgttcctttggggtagaagtgtagacgatcgattttaaactttccttcctcacgcgtgtatttaaggctgtgaacctgccatgggtcgctgctgtaggtgcgtcccacacattccatgagatgtttctgtcgccgtccgattcaccgcgttgcctggctgacggggccatttattcccgtacttactggttcttagtacgtgccgcttgatttccagacgctggggatgcagccgcctctggttacagtgcccacgcgtggtctgtggtcaggggatactgcgtgcccggcactcccacgctcagctctcatgactgattgaaggctggagcgaaagccacgttgagtttgcagatgcccagacaggccgcgctgagcgtgctgtgtctttctgcagcagagggtctctgggcggcgtcggtcaggcgcgaggtacgcagcaggagcgccggcgtccaggccctgctgactgcccactcctgccctctctgccccaggcctgcggctgccccctctactggaaggggccgctcttctatggcgccggcggggagcgcacgggctccgtgtccgtccaca

SEQ ID NO: 5433 - DNA, 16637 bp, human; identical to SEQ ID NO: 2841

SEQ ID NO: 5434 - DNA, 16636 bp, human; identical to SEQ ID NO: 2843

SEQ ID NO: 5435 - DNA, 16722 bp, human; identical to SEQ ID NO: 2842

SEQ ID NO: 5436 - DNA, 13737 bp, human; identical to SEQ ID NO: 2840

SEQ ID NO: 5437 - DNA, 74535 bp, human; identical to SEQ ID NO: 4161

SEQ ID NO: 5438 - DNA, 74535 bp, human; identical to SEQ ID NO: 4161

SEQ ID NO: 5439 - DNA, 27916 bp, human; identical to SEQ ID NO: 4162

SEQ ID NO: 5440 - DNA, 63877 bp, human; identical to SEQ ID NO: 2915

SEQ ID NO: 5441 - DNA, 62496 bp, human; identical to SEQ ID NO: 2917

SEQ ID NO: 5442 - DNA, 64446 bp, human; identical to SEQ ID NO: 2913

SEQ ID NO: 5443 - DNA, 62350 bp, human; identical to SEQ ID NO: 2914

SEQ ID NO: 5444 - DNA, 99270 bp, human
ctcagtgcgcgtgcgcggggcgggcgggtgcgcgcgcacttcctcctcgcccccacccagacccagaaggcgccaccatggcggcgcccccgcagcccgtcacccacctcatctttgacatggacggacttcttctgggtgggtagtgtgcagccgccgcctccagtaagggcggtcttgtgtgggcgtggggacggtcggcgcggggtacgtcacggcctgggggccgcggcggggcggtgttcatgcagggacgctcgggctcccgcgcgctctgcccccggctggccccgaagtcgggcggcggccaggagcgcccgcgggcccatgtccgggctggcgggcgcgcgtggccgcggcgtctacgcggccccagcacccgcttccggtcggcggcccgcgcgtggggccggagcacgtgggagcagtccctggggtccaccgggcgggcgcgcggctccgcgtcctctcctcagagcgaggcgcggcgggacctccgcgctctcttttcggttacgcatgcgtgcgaccttgagcggtgcccagcctcagcttccccgtctgcaaagtagcctggaggatacttgcctgcctgctccaaggttgctgctgtgggcgcactttgatggtagcatcctgcatggtagcggttctctacctggcggttttgcagccctgagggcatctggcaatggcgatgtcaggagacattttggctgtcacagctggcgaggagtgatggggtcactggcatctagtggagtccagaccagtgatactgttaaacttcccgcagtgcacaggagtgccctatgcaaccataaggaattatcccgcgccgtcaacagtgtagaggcacagaaggtccgtcaagtggcctggctgcctagggtgaccagcaccggggacatcacctgtgggctacttgtaaatgtagaagctggggccccaccctacccctgcccaatcagaatctgcattttaagcgcgtgaacgtttgagaacagctgctctatcaatccgaggcattaagaaacccttggcagtgtactaaggtagtcagtcttagcacatgtgaacttcaccagccaagaggaattcaagtagaattcaaagaataaaaccctgtttttaactcaagacagaactatgctgagctctaccgaaagccttgacacagttaacactatgacacataatcaccaggaggcttcatatatctataaacatgtctgcatactctttgtagacagctgacctgcttggttacgtatatcattccttcatttcaaaaccctgcaagttaggaggaagtatttgcatgtcactaattaaaaaaaaaaaaaaaaaaaaaaccctgcagctcagagaggtaaagctacttgcccaaggtcacacagctaataagccaagctgagaaacgattctggattgatccagttctaaatataaatgatgttgagctcatcttaaattgtgaatgtgaccttgtttctgctcatcatattgctgggtaattccctagcagtgtttccttttaaaaaggcatgcagaaaccattctcttcattttatgaacacagaggtgtaaactgatgaattccaaaggaaaaaaaaaatccccgtagaggtcactaattggagccaacggtgtatgcagctactaaatttgaaatgactcaatttcagaaagcttgtgggatacataggtatagtttgtagacatgaattttcctactccggtggtcaaaaagttaaattgtcaaataaatttcttatcctctaataaaggtccagagaacctgttctgggagtctcatgaattttaataccaaacaagatgtctcattaaaattaaatttattaaacttctaaatgagcttggtgcctaattctgattctagattcacacatagccatgccctgaagtgatgaatgtgacttaaatggcattacaagcattgacctcacattgttacccaatcctctgatctagtcagataaccaagaattagtgctatttggaaaaataagccctgcttctttttattcccccccctcattttctgcccatttcctcctttcctgccctacctcttctttgaggtggtaaggccttgcaaaactttcttggaaatatacctttgtttatcccattctttcaccaaatgtgtaaatataaaacacagctttccaagatgtgccactttaatttaatctaccagattatgcctgctgtcattctttagcacctcacttcagtgtatctgttgtttgcataacaatatactatcaatttataatgagttattttacaataggtctgtttttcgggaattttgaatgcatttttctaggaagttctgtttgtctatgtagccccaatacttgcatacttggggaagtaaaattgaaaacgaatagtttcatggaggattgttaacattagaggagaagattgtttaatcagaggagaatgaggaagtaaatggagattttagaggaaatgttgaccaggaagaaagccaggacactttcccatgcttttgacatgcacgatgctgttagttgtcctttaaaaaaaaaaaaaaatacacttcggtttctgtttctcatgaccaaggtaagagtcagttatgatttaggtaatattaataattttggctctcaaatgccattcagagaaagagagtaggggagtgggattagttaaaaactgggatgattttgaaataagaagatgacaattattaaacagtatctcagcagctggacagggaagattattctgtttgtaaataactgaaattaggaacacaaaagatggtcccaatttctttaaaagagaagacagtttgttgtccagagcagttctgtctcatagaattgagccaggtaaaaattttggggagcaatttttaataagtaaaaagatacagatgacattgatttggatgatgtatgttatgtaacctaatgtatcaaaaatattatttaatacaaagtcagtataagaaaatctttgaagtgtttgacattaattttgatactaggtcctcaaaatctgtgtgtgttttatacatacaacacatcttagtttgaactagcctcatttcaggcactctgtagcctcatttggtgggtggctactggcttggacagcatgggtctaggtctttgtggagcaacccaagatgtctgttgataatggctatgctgggagggtcaggcagagggtgggtgttaagaatattcagaattaggagttttggtgtatgtaaaatgtggtatgtgtaaaatgtgttttcttggagtctaatacagaattatttaaaatccttttaaaatcaaaggaaaataagcttatttccagtttcttaaatatcgtaaaataataaggtagatctgcgaagggtaataagaacatttgcagtgttgaccataatataccatatctttataaatccagattgcaggattttaatgagtgacttctacttcacctttagtaaaatgaagacctcttctgtgcctttttgcactcccgtagcttcctccttgccaaataatagcacttgagactataagtgcctgcctcactgtctggggcccaggagaccctaaaaggtcatggaggtagggtctctgtggggattaccaagcccagtactgatgggattgtgggctgcctgagacagttgacagtcatgtccactgtgtggccaaaattccacagacatagcgtgagtgtgttttgcgctgtcattctttgttaacttcatgtaggctgtttctttagacaccagaacatctatatagctgatgacaaaaatagatttttcttacgtaatattagcgcatgccctaggtggattgtcagaagaatctatgtatgttgtcatttgaccccatgaaatacgtctgaggtttaaaagtgcagctgacaagcttttcagcctcagtcggttcttactacttgatgttatcaagtcattcattccaagtgggatttctaagagttttggcacatttctgaggaaggtggagcaaagtgaaggatcattctgcatgcttccataggtggttattgtttaaccccagaacgtgcagtgatcctagttggaatgagatcgtaatcacaatctcccctccttccatcatttgtaatgggtcttgctctggatgtcaaagcaactctggtggtaggttcacattctttctttgccctgtcttccctggaggctgacagtgtacccttgggttttacccttgctaggtgaaatgtaggttctcttccacgtttgcaaaggagatggctgagggtggaggccagtgtgagggcttgggacagagatgaacccttatctcaggggccatgattggcctttcactacagggtgatcaatgagtaatctgttgtttctggaaactgaaaaggcttctggaatatagaaagcacaagacacgtgtgttcctattaagggtccgaagagatttagagtaagatgctatattgtatgttggagaaacagcatcagattatagatttagctccgtttggttctgttttctaattgacctgaaccatgccaaccttaagttcttgtagtaagtggttggttgtccactgcagctgtttctgtttctagaataattgagaagggggtaaaacttaaattgcaaaattctgcagataaataataagagttttgtccagctggcaacacaaatattcagcagattctaggcatgcaggtgtaaaatatccttttcttttttctagctctctctttcaaataaaagcaatatggttttatttagaatctttaagtaaactggatacaggcatgtgtgagaactattgtgggttcagttccagaccatcacagtaaagcaaacatcgcaataaaattagtcacatgaagtttttggtttcccagtacacataaggttaggtttatactatactgtattctattaggtgtacaatagcattatgtctaaaaaatgtacataaccttaaatacattttattgctttaaaaaaaaaagtgctagggatcatgtcatccttcagtgagttgtaattcttttgctggtggaaggtgttgtcttgatattgactgttgaccagagtagtggttgctgaaggttggggtggctgtggcaattttaaaaaataaaacagcaatgaagtttgccacatcacttgattctttcttttacaaaaaaattctcttttggcgaggcatggtggctcatgcctataatcccagcactttgggaggcagaggcaggcagatcacttgaggtcaggagttcgagaccagtctggccaacatggcaaaaccccatctctaccaaaaatacacacacaaaaattagccaggcatgatggtgcacacatgtagtcccagctactcaggaggctgaggcccgagaatcacttgaacccgggaggctgaggttgcagtgagccgagatcccaccactgcactccagcctggacgacagagtaagactctgtctcaaaaaaaaaaaaaaaaaaaaattggagtcctctcaaactctgctgctgctgctttaccaactaagtttatgttaatatagtgaatcctttgttgtcacttcaacaatgttcaacaacatcttcaccagaaatagatttttatctccagaaaccactttcttttcgcgtccctaagaagcagtgtctattcagttcaggtttcatcctgagattgcagcaactcagtcaaatcttcaggcttcacttctaattctagttctcttggtatttccatcacattctgcagttacttcctctgctgaagtcttgaacccctcaaagtcatccatgaggattggaatcaactccttacaaactcctgttaacattgatattttcatcttttcccatggatcatgaatgttgtgaatggcatctggaatgctaaatcctttcctgaaggttttccatttactttgcctagatgcatcagaggaatcactatctatggcatctataaccttaggaaatgcatatcctaagtaataagacttgaaagttgaagttactcctcaatccatgggctgcagagtagatgtcgtgttagcaggcctgaaaataacacgaatctccttgtacatctccatcagagctcttgggtgaccaggtacgttgtcagtgggcagaaatattttgaaagaaatatttgtttttgagcagtaattcttaatagtgggcttaaaatattcggtaaaccatgctgtaaacagatgtgctgtcatccaagctttgctgttccatttacaaagcccaggaagagaagattcagcatcatttttaagagcactaggattttcagaattgtaaatgagcactggcttcaagttaaagtcaccatctgcattagccactaacacaaaagtccgcctgtcctttaaagctttcaagccagacactgacttctcctctctagctatgaacgtcatgggtggcattttcttccaatagaaggctgttttgtctacattgaaaatctgtttagtgtagccactttcatcggtgatcttagctagctctcctggataacttgctgcggcctctccatcagcacttgctgcttcaaggagctgttcaaggacagagcaaggagcaattctttccttaaacctcatgaacttctgctagattcagacttttcttctgcagctttctcacatgcctcagtccccatagaagtgaagagagttagagccttgctctaggttaggctttggcttaagggaatgttgtgctggtttggtcttctacccagatcattaaaacttcctctatgtcagcaataaggctgtttcactctcatcattcacgtgttcactggggtagcacgtttaatttccttcaagaacttttcctttgcattcacaacttggctaattgggtgcaagagacctagctttcagcctatcagcttctgacatgtgttcctcactaagcttaaccatttctagcttttaatttaaagtgagagatgtgtgactcttcttttctcttgaactcttagaggccattgtagggttattaattagcctgatttcaatattagtgtgattcagggactagggaggcctggaggagaggaagagagatgggggtctatggagcaatcagaacacacacaacatttatcccttaagttctctgacttatatgggtgcggttcatggtgccctaaaacaatgacaatggtaacatcaaagatcactcatcacagattgacgtaacagatgtaataatgaaacgatttgacatattgcaagaattaccaaaacgtgacacagacacgtcacgtgagacatgctgttaggaaaatggtgttgatagactttctcgacgcagggttgccaaaaaccttgaatttgtaaaaactacaatctatgaagcacaataaaataagatatgcctgtataatatgggacagcagtgcatcgttttgttttgttttgttttttgagccagaatctatttttctccttgaaaagctatatattagagattatttggtcctttttatctttgcgattattcactccttactctgattctatttctttttttttaaactgctataatttatatactattttctgtcatttttcaggagtagatggagacttaaagcaatgtaaaggagcaaggtaaatgatatctcctaagaaatgtcccctgaaagcactccttatatagatgctcaggcgactggtcagaccttctgatgagatgtttgaaaagtgattgataggcagtctgtaggtagaaagcacaatagtgttattctggaatacattacgcttgaaaataatgctcctaccatcggctataagggaattttagtgattaataaatgcagcatttaatatattaagagcttccttcaatagtgttaaaatggtggaagggggcaaccttgattttgtgttgcagatatttgcagtttaaaattgccttgttggtgcttaaagagcatttttttgaagacatagtaatcctaacacatgcatttctactgtgtaagagcacaaaaaggaagacttttccccatggcttttcatagctgggccatccatgtggcttctcttcacatcccttttcagcaatgtctggcagatagatcaccacctttcctgatcctcctttatcctctgtctcccttgtgtcctttgctgtgatgccaacagtgagtagcagctaaggaccctggtgcagctggccacgtggcaaggtgcctgcgtatgagaggaggatggtcacctcttcacagccatgcctggcaggcagtttcatggcattgcttgtggcgcttggtggggcccttgactcttctctctctgagctctgggagctgggccgaatgatgtgcccttttgtgattgatggtgccttatttaaaaaacactgcagatgacatagctgttcaaggacagagcaaggagcaaaccaaagtttgctctttgactcccaatagactgttccatgtgtctatgaagtaagagcaaatggtcatagttggcacatcgaagcttatctgagccttcagacaaaagccaaaataagcaccaaccctctcccacttgtgtcagctgccatgcacatggaagagaagcacatggtccttgagcactgtgcgcctgtctgctctctagcccagcactgtgtatccagcaaatcttcctgccaggatggaaatgttctgtaactatactgcatccgatgggagccacagctggaaactgggttcatgagatgtgactcatgcaactgaggacctgaatttctcgtgttatttaaatagcccccaatgactaattgccaaaacgtaacatagagacacaaaatatagagtggacagcacaactctagaggaatgcattcactcatccttaatctatttagaaaatactctgctgggtgttacaaaggcttcaaaattagtctcttcctttaaggatcttagagtcctgctggaatctaaaacatgattggtaaaatctgtgaataattgctaatgatatacacaataagaatgtgttagcaacagtgcaggattttgaactgaaatcacatttggggtagcatactgtcaaggatagataggagccaagaagaaaaatggatattccagaccaggagaaatggccaagccataggcatctttactaaagcatagaagagagtcgttttttgttgttgttgtttttatcaagcaaagactgtattaaaaaagatcttgctaatgattacattgaagtgtggaggtgagaagagatttgaaaacataataatcctaacacatgcatttctcctgtgtaagaacacaagaaggaagactttgttttccccttgggtttgcatagctggagcacctgtgtagctcctcttcacatctcttttgagcaatgtctggcaggtagagattagaaatctctaatgtttcattgagaaatacgagactggggctggggacagtggttcacgcctatcatcccagcactttgggaggccgaggcaagtcgatcgcttgaggccaagagttcgagaccaccccggccaacatggcgaaaccccatctctactaaaaatacaaaaattagtctggcatggtgatgcgtgcctgtaatcccagctacttgggaggctgagacacgagaatcacttgagcctgggaggcggaggttgtagtgagctgagatcacgccactgcactccagcctgggcagtagagctagattctgtctcaaaaaaaaaaaaaaatactagattaatctctgtcaggctaagattagtatttcttaaactgggtgcccattggtaatatccctttagcctattttaaagtgaaaatctcaccccatcctgcaagcacacatcctgggttttccccctatgactttcagaagagtctaggatggttatcgagacaccagcctacattctggatttgtctgattgtttccacatgataccaccttacttgttcctctgtcccctgtatttcctctaatctagaaattatgcctagtgcttcagttggacacaggtcagctgcctctggcaagaataatgctgtgccccttcgtcacctttttggggagatgtttgtattcagtctatatagggtcagtaccttcatgctagccccagccctgcagagtagagttgtcctcaggaaagctggtgaactgactcctctcccatagtggtacatggaactttttagtgagaagttcagagcctgagatacaagttagaagtactggctataatgcctgtgtgtgtggacagccggaacccttaggcaggaagaggaggctgccggggacagaggtgtgccatgctgtgcacccttcgaagagaaggtactcacaggaacctaaataggtttcacgtgtatgggttcctctgttccatgcagtgggatacaggaaagaaagagcagccatgcagctgttttctcactgtgtcggagcacacaccacagtctctttgatgtttgctcatgagattgaaggacactcatggctttgtcacaagatgcctgagaaagcacagaggttttttgtttgtttgtgtgtttgtttttgagacagaatctcgcactgtcgcccaggctggagtgcagtggtgcgatctcggctcactgcaagctccgcctcccaggttcacgcctttctcctgcctcagcctcccgagaagctgggactgcaggtgcccgccaccacacccagctaattttttgtattttttttttagtagagacagggtttcaccatgttagccaggatggtctcgatctcctgacctcatgatccatctgcctcggcctcccaaagtgctgggattacaggtgaaccaccacacccggccttagttttattttttttttttgagatggagtctcgctcttgtcacccaggctggagtgcaatggcgcgatcttggctcactgcaatctccacctcccgggttcaagcaattctcctgccctagcctccctagtagctgggattacaggtgcctgccaccacacccagctaattttttgtatttttagtagagatggggtttcaccatgttggtcaggcaggtctcgaactcctgacctcagcacagagttattaaaatcaaatgcagttgcctacgctttgtctgcttttgaaaagtaaacttaatgtttcagactgaggtgtatttgtcattggggtcctatgttctgcacagtttgtaaatctacttcacccaaagtgatacagtgatactcaggagggcttaaaaaagattaaatccttcatttggaaacatcatgcccagtgaaaggaacacaggccctaaggagatgtggctgattctagggaccgggaccagtaaaatacaacatgagcacagagcactttctcatgccaggatgcagtgggcggggttgggggggggggtcccactggcacaatatgaaccatttgtaatcaaaagaataatgaccagaagagagtataatactctgtctatatattttttaagtctctgtgttatgattctcaaaagagtaaaagggtggctgggggtgagctcttttacagaagaatgccagttaataaatatggacagaatgggagaattagccaggtcaccattttgggatcccgactgtaagtggttcccacaagcattgtcagtggaagccaaaatcatagagtaatcatgcaggagacgaaggtgcccgcagtgccatgtcagaagtcactgactgataacagaggcaaacgggccttcagagcgggcagctctgggggccacaattgaccctgtggcccaactgatgtagctttgccatccagaaagcagcatgtcacgtcacgtgtgctttctgaagtgacctcagaaatggttaacctgaatccatctggacctctagcagtttcagaggggtagaggaacacgggagggggtgtcatgtggaaacagcaagacaaatcctgaatgtaggatgttccaccaggtacctggactgggtccttgaaaatgttgactatcatggggaaaaaataggggctggcttttccacttttaaagaggctaaagggacatagtcaaattcagtggaccttagattggggaaaaaaatctataaaagacatttttgtgacaattggagaggtgtgatgtgtgctatttagggggtactatgaaatattgctgatttgcctgggtttggcagtggtattatggctgtgtaggagagtgttattctgaggagaaacgtgcagagagctagaggaatgaagagttagggcatctgcatgttttcaggtgtgttgcgtgcaggtatagggtatgtagatgtttcctatcctactattgactcttctgtatacttgaaaagttaaaataggaaagggaagattaagtcttaagcatgaaccactaaaaacaaccccaaaagcagtattaagtagtagtcagttaattctgtttaagagacaagaatgtaaagcatgcatctttagaaaattgatgttggagatatggaagaaatagtttcagaaccttcagctctctcgaacattacagtggcaatgcattcattgcaatgtgtattatagcagaaaacattctgaaggaagagtcccatttcctagtgctcatttttcagttcctcgtctctctcatagtgcaggagatttgtagacaaatgtctacaggatttagacagatgtcaggaaaattgtcttttgttgatgtcttaattggaatccgatagtttgtcagggcatgatgcttataaaaggaataaaagctttctaaaattcttcaaagagtagccactggtacctgtgtgtcacatcatatgctgatgagacatgacagaaaatgctcctaagtagccttatagctgatcctgaggagctactgtgactgggctctcactgcacctctcagctgacttctgcctactgggtctgtgtcatccctttttactctgaggctaccaaggtcttaggaaactggaggttggagcttgaactgagtgatgggaggaaaagacttcctgaagtgctgcccacatctcatgtatgttctcttggacccagttgtatccctgccattccctggaggttacctgttcatacgcagacttctctttcccttatttacctcaattgcagtagcttggcaaccttttaactcttgctttttaaaaggaaaattatttggttatcgtagaaacattttgtgcagcaaagtgttacacatatttctgttctggcctcaaataatcatggatttcattaaatactaaacattttgctgattttaatacagtgctttagtgtattcttattttctttttgcatctcttatttgcctcgtttatcttaacataaagcatttcctttggttaagtagatccttatatctgctttttctttttgtatgactcctatttaggttggtgctaaagtaatgacggtttttgccattacaatacctgtagacataaaggtctagcttactttttgccatttgctaccctgtgtttagtactggcattttgctgactgctcatcagcttttgatacggtgtgcttacgtgacaagctctttaaagtgaaatcataatcagatttgagatttagaattgaggcgacttgtcctgtctacagtgaaactgaggcaggacaacctggggagctatgaatagtaggaaaatcccagtgaaaatccagcacttctaacttctactcctgggcgcttcatcacttagagttaccagcagtcttggtaccatttgttcatagttttgccagccctcacaggtacaggtacaattgtagatactgaaactctcaccagctgacatctaatttaccagctgatttaattttatctcattgatgattgagaggctctactgatagcccaaaaccactttagcttaggtgaaacatgagctgcgttggtaactgaagcctggcccatctcattgacaacttacttactgtactgatttagtaaaattacccatcctctgtgtccccgagtatggtttgcagcatatcacaggcaatgtgtgacatcttccaggatattgcatgcctaccaaaatataatcagattaaagaacatgttcagttcatatctgacctacggccccattgcactgtttaacatgattttgcaacagagatgtaaccatctgcacatgttatgcatccccttataccattagggtttatgctgagatcaagtaaaatcatatcctctcatagggaggggacgggacttctgtgaagtagcctgaagaaattaacatctttatatgatcacatctataatacagaataataaatgccatgtacctgttgctgtgtttattgcttctgctggctgggactagtgagtgtcccgattttaaggacgtgttttgaaactggcttgtctgtctttctgcctctcttctcagccaagtgtcttgctaaagtgggctgtgtttgccgaactcactcccccattttccttccctcgctatgagctggctttttggccctaccactcacagaaattgttctgacagaggtagcagtgatgtccgtgctgctaggtgcagagggcacccttttcttaaattgccagaacttccggcttcctttgccgcttctgcaccctccttggaaatctttctctttggcttcacggatagttcctcttctggcttccccatagctttcttttcctcctggtgcctgtttggcgtccctatggctttgttatgggccctgtcctcttgtggaaacctcttctgagctcatggcttcggcacatgcttctgctctgatgaccccttgacctccctggctgggcctcacctcttttgagttcctgtctacgtttcccagtgaccacaggctcttcctacccgcgtggccaagaggcagctctgaagcattgtattttaaacggggcctctagttctctgccagatctgctcttttcctgcattccacaccaggcagcaaaccccgaaagccccacagcagatggctgggagttatcttccagtcttcaattccttgccatccccacccacaccttccaggcacctcctgatttataaatatttcaaagccacttctgtgtcattccagctgccatttcctgcttcaggctttcaggcttttttctgatctaatagcaatatttactgagaacctttaccacatgcagttctgttggttacctgcagtgagatcagtggtggctgtggggttttgatgctcatgagggtgaaatcgcagagttctggggcccaggtgtatttgcatgaggtggctttggtgagagcatagccttcaccaggatgtttttggaggtttttctcctagtgtattttcctagattcctttgtcaaaggaatttggtcataaactggcccttaagtactttctaagagaagccttgttcatgtggatcacaatgaccttagactttgtgtgcgttgtcagtgctgccctctcctgggcattgcttctgcattcttaatgcaaatatgtgagttattcctgggtgtggctccatgacttgttcctttctggaagctctagccttatctcagccctcatcttgttaaaccagttgtgctgaccttgcttctctgacagcaacctgataaaagcctgtaaagttgcccacttcaagtcattgagcaatacaggtagccaagcagtagaggtggttacaataaatggcttaacattcccagcatttaggtggctccattcagatggcggaaggcaggtggcactttctgttgtggagaatttgaggagagagctttaagttcaaaaggaatttaagaaaagcctaagttggatctatgagggctctggaggagagattgagatgttcagggtgttccttcgattcatgaacccgactgacttttcacagcaggaccaccagttgccagatactgagacaactgagtcaaatgaatacaacagcatccctgttcttcaggggactgcaggcaggggtgctgtaatttgtacgggggcgggggtggacatgatctgttcttctatattatcatcattcatctgctagagacaactcgattttcttgggagccaggaaaaggaagttggccagtcggatgtgcctcacagcagagcaaacgcatcccaaatgagccaccggaagggttggggagtcactgaggtggaggaggaagggctgagggtatttcaggccaagaggactcggtgagaggcggagcacaggtaaaaaggcctgccaagggcagatggcggcgagccctgtgccaggctaaggaattcacattttatctcgtagccatcatacagcctggcgagcacacgatgtctagaagggtggtgcttctgatgatgtggactgttggcgcttagacactggagactggtagaaggctgttgccattgtccagatgaacgatagaaggactgcatgagttttccacaaactggggggcctaaaacaacaggagattactttatctcagctctggagacaagaagttggaagtcaggatatcagcagggctgcgtttttccttggcttgtagctgcatcgctccggtctcagcttctctccacgtggccttctcttctctccttttgtctcttataaataaggacccctgccattggatgtagggcccaccgggataatacagagtgccacatctccagatccttcacttaatcacatctgcaaaggtcttttttccaaataaggtccgattctcgggccctagggattaggacgtggacatatatttttgggagccacccttcaactgactacaaggacccacagggttggaatgaaaggaagaaaagtggctgattcagaggccgttcagctgacagctgggcatagagggatgggagggagaaggcaggtgaatagcagtgacttgtcctgaagtcgaaattagaggaagctgtgaggcctgaaaatagggatgagttccattttaggcatttggacatgttgagtttcaggaaactgaaagactgggcacctcttaggttgacagcattgatggaaacaaccatgatttcccatttaagacaaacaaaactcttggtgccgttaacccatgaagaaaactgacataggtggccatcgacctacactcgtctttgaacagctacagtacctagaagccattttagtttttacttttattattattattttttgagacagagtctcattctgttgtccaggctagaatgcaatggcacaatctcagctcattgcaacctctgcctcccaggctcaagtgatcctcctgcctcagcctcccaagtagctgggactactggtgtgcaccactgcacccggctaattgctgtatttttagtagagacggggttttgccatgttgcccaggctggtctcgagccgtgcacccggctaatttttgtatttttagtagagatggggttttgccatgttgcccaagctggtctcaaactcctggactcaagtgatccacctgcctcggcctcctaaagtgctgggattacaggtatgagccactgtgcctggcccctggaagccattttaaacttatttctaagtccccttcctcagagagaatacatgcacacacacagttggataattagcctaggaagggtctggaaatttagccatatgcccaccatgttttgtcctcctcctccttttgtgtgtgtgtgtgtgtgtgtgtagtatgtgcatctctgatacaaagggagcagctctggatccctagtcattctccaatcagcctccgaattccccctaaccctgcatcaaaacctgaatccccccaaccctgtgtgaaagcctgccacttcaggcttaatctttgttgacacgtaagggtgccgaactcacaactttgaagtccttttattctactcccttctccttttctcatcccagctgggttgtaaatgtcagggagaagtagagggcccagtcctccttcctggggtagggagattatttaaccatgggatgcaccatgatttccaaacacagttgattttccagagaagggagtgaaaagaaaagtgctttggaataacctttggactccacgcaccatgccggggataaacatggaaaataaccatttgttgggcggtgctccgtgtcacatattctagtatgtagttttatacccagccattgcccttaccctttcgatttttgttagagcgggacggtgccctgcatgctgtgtgctgtctgagtatgacatttctagtagtaaggaaggttaggatggctctttcctttgccttcattaaagttctcttgcccagatgtgagatctttaaaaggtcagtgtttttgaataaggaatgaaatcatattctaagataaaagttcagagagttatacaataaaataataaattagtaaatggcacttccctgagaggcgatggtcactggtcactgttgttgcatcccattcctcttgccttcagggaatatcccctcaggtatgagaatgctcagggctcaaagacagagaagagctgtacgtcacactgttggggctggcagcaaaatgctgagcaaccttgggctctacaacatgtcctccatggaggtcaggctctaggcctgttctgttgactgctggagtctcaacattcagaacacgggtccaacatggcatgtgtattgacagagaagcttcaggtaatttttatgtccttgaatgaatgggcacatgttacatgacagagcagggactagatggagccaatatattagatccccttctctccacacctcattttctatatagtgcagccagtatgagaatataaaatggaaaggaagaaggcatatcattttgtatgtgctctatgatctttaaatgttattaaatgttggtaatgaaatgctgtggtataactaattatatcctagcacctctttcccatatacttgcattctctaattatgttcaaagcaatggttgcccgaaggctaagggtactcggtcctttcctcccccatgaggactatgttttagcttgtaatttcacctgcaggagctcacaaaccagctgcatttgagtgcaattatactttattcatagtgactaataacagaaaagagacatcgtgggggtttgggctggagatttataatctcatataaaaaatacgaattcttgcttatttatgggttgagcaccttgggcccccgctgtttcatctgatggctgcctgatttttatccgcaaaatcattcattagtatctacactagaatgtaaacacagaatgtaagataaatttgttgtgcagtacttggatagttagaacacatttccccagatagaaacattaaaactagaggttattcactcccatattcacacaacctttatgcacctgaggaggttccgaatgtccctgaccatctcttatttcttatgggaaagtgtttgggtaccagcttggaatgccaggagtgtaattctccagggcagcgactgccgcccgtgccattgggtccctagccctttttcatgctctgctttctgatgagcttacacacacaggcatggtgtactgtgggtgcttagtattgctgtaggacttcttgtgtcctgagttcaccactaccctttaattctaaacatttataaactattgaagttagattcaaaactttcttttccctaagcttttactttctgcttattctgcttataaattagtaaatgttggccgggcgtggtggcacacatctgtaatcccagcactttgggaggccgaggcatgtggatcacttgagcccaggagttcaagactagcctgggcaacatggcgaaaccctgtctctacaaaaaatacaaaaatcagctgggtgtggtggtgcacgcctataatcccagctactcgggaggctgaggcatgagaatcgcttgaacctggaaggcagaggttgcagtgagccaagatcataccactgcactccagcctgggcaacagagtgagactctgttaccaaaaacaaaaaatctagtaaatgttaacagtcactgttcagaggccataacagtgtttgagtctcaacctttacaattttttcataaacttcacctttatactgttaactcacacttacaaaactctaatatattttatttctttgttgagtacttcagttgtctgaattaaagaatgaaactcttttagtcaataatcatcttaaacataataagtttataaaaatgatgaacctaaaattcttaatatttcaacatcattctgatcatgccttaaattgcaaatgtaaataattcaggtatgcatttaaatggttatttattagcattattgttctcataggccaaattcaattaaaaagtacaagtaataaaataataagtaacatggaaaatgtattcagtggtcttgctgcttttaagcatccctctaaatgatttgggagttgagagatgtctgttcattaaggaaaacagttccctcccaggtactttacattcccatgcaggtgattagagttttcatttcttaaaataagtaaatatctttccacctaactccagtaatctttgaacttgggaggaattctccattcttttatgcttctcaggtcagtacaagtcgtaggtacagctattaaaaggatatctgattgaattctggatatctttcatgtagtttgactgacagtaacacctcatagggccacattactgacatagttagaacattgtgctagccttagttatgtgtctgccaagcccctagctgttcaaagaaaaggcggtctcttaccagctgtccttccctggtaattggagctgtggaataaaggtcagttgctctttgagaatgtgagtgagcatttctgactcctcatccttcagtgcccccatgtgtggaaggcttggtaaattgagctgtgcctgcagttaccaagctatgcctccttttgtcaatataattcccactttgctactttgggtaccagaggtacactctgcatagcaggaaccataccctatgctttttggttcttttgagaaatcctaggtagaattagatacataaaatctgagatactcgaaccaatttatacatatgcaaatatgtattctttaaaaaaggatcttgatccttatttcttagtgatcttcttcatcccttccccatgttaagatagcaccttccattaacaaactgctcttgccttttatataaaaaaataaaaattaaaaaaaccaagtagatgaagatgaataacccagtgttacgggctgagtcatgtccccctcaaacttacgtggtggaggcctaaccccaggacctcagaatgtgactatatttggagataggtctttaaagggctaaacaatgtcctaatccaatgggactggtgtccttataagaggcgattaggacacagacacactacggacaaccacgtgaggacacagggagaggacagcatctactaaccaaggagagaggtctcagaagagaccaaccctgctgactgactctgatcttagacttccagcctccagaattgcaagaaaattaatttctatgtaagccacccattttgtgttattttgtgatggcggccctagcaaacttacagtcccaagaatctaagatttttgattgtgtgaaggatcaagccatctggaccaatgttttcctgaatttctgggcagacctttccaggaaggtgggcagcaaatggcccaggtctgttcagttagaggatcaccagagaagtttctccattctcagctcctatcatctttttacagctgaattttctgacattcctccacccccaccagcacacaaaaataagtgaaccaaaagcataacagctaaagaaatattcctgtgacatggtcactcatgtgtctttaggagagaagcactttgtactgtgtattgctgtttatattcttaatgtttttcttacatttcatgatgatttacattgccctaaattttttaaaaatgtaattttggcattatcttcatatatatgcatatatccctggtggtaattcctaacaggccattgatagggaatgctaagagtaaggatagtgatatggtttggctgtgtccccacccaaatctcatcttgaattgtagctcccacaattcctgtgtattgtgggagggacctggtgggaggtaattgaatcatgggggcaggtctttcccgtgctgttctcgtgatagtgaataagtctcatgagatctggtggttttatgaaaaggagttttcctgcacaagctcgctgtcacgtctgccgccaagtgagatgtgcctttcatcttctgccatgattgtgaggcctccccagccacgtggaactgtgagtccattaagcctctttttctttataaattacccattctcaggtatgtctttatcagcagcctgaaaatgactgatacagatagaaatggaagggtagcggagggcctgtcaccttcactgaaaaagaatagaagtgattgagttttggtaggaaagatgatctttaaataaagcctttgtgcatgttgtggaggacagttgctggttttcattaattcaaaaggcctagggatatgtgggtttggcattaatctataatgcctcagacactggaaaactagctctgagaagggtttaggcaaagtgacatccatctagagctctatgtttgtatatttagctcttaaaattcaaaaagaatttagattattgccattagctaaatggaagcatcatggtgcatcaataggaaatgggaaaaaaaatgattaatagtatttatacatatgtgttattctgtagcaataacgaaggcctagcatgctggggtttgttttcattttgtgaggactatactgtgctgttttttagtaaactggtgaactgcctcagataaattgtcacacatagttctgtaaactctgcctgtagctttcattgactttaggttgtgaatgaaacgtttaaaagtttatttttatgttttttttatgtttttttttaatatgtttgaaagtcattgtacagtagcccgatgagggaaaaacaaaaagatagccaaagttactttttttttgagacagagtctcactctgtcgcccaggctggagtgcagtggcgccatctccgctcactgcaagctccgcctcctgggttcacgccattctcctgcctcagcctcccgagtagctgggactacaggtgcccgccaccacgcctggctaatttttttgtattttttagtagagacagggtttcaccgtgttagccaggatggtctcgatctcctgacctcgtgatccacccgcctcggcctcccaaagtgctgggattacaggcgtgagccaccgcacttggcaacaagatagccaaagtttcttaaatgccttctatttctattgctgctgtaacaaattaccacaaactgaggcctgattttaccaatctcttggtaaaatcgggtgttggcaaggctctgtttgtttctggaggctctaatggggaatgttttcttgccttttccagctattagaggccacccacacgtcttgactcatcttcaaagctagcactgtttcacctctttgaacatacttttttagtgcagacgtttgtagccataatttccctccacgcagtgcttttgctgcatcccataagttttggtatgttgtgtttccatttttattcttctcaaagtatcttttaatttctctcataatttcatctttgacccacaaatttttaggagtatgttgtttaatttccacattatttgtgaatttcccaagttttcttcagttactgatttctaatttcattgttgattgggaaaatatatgatttcacttctttgtaaacttattgagacttatgacccagcatatggcctattctggataattttccatgtgcacttaagaataatgtatattctgttattattgggtcagttttgtatagatgtctgtcaagttttaatggtttacagtgtgtaagtggattaaatcaagtcttgtatttgtcttccgtctagttgttctgtccattgtcaagtgtggcattgaaatctccagctactattattggaatcagctatatcccctttcagttttgacagtttttgctgcttgtattttggggctctgtggttaggttcatatatgtttataattgttgcatcttcttgatggggtgacctttatcactataaaatgtttccattaaaattgtttggttttttttagtgaaatggtttgtcctaagtctactttgtctgatattactatagctacttcagctctctttgggctgttgtttgcaaggaatctcatttccatcattttactttcaatgcttttgtaccatttggtctaaattgtatctctattgtagatatcatatagttagatcatgtcttttttaaatccattcttcaatctctaccttttaattggcgtttttaatctatttacatacaatgcgattattggtaagacaggatttacgtgcggcatgctgctgttttctgtgttaagtcttcttgttaccttatttctttattactgccttttttaactttagatattttttagcgtgccattttaattattctgtcctttactgtatttcttagtgattgctctgtggactatgataaacatcttaaccacttattttaagtagttcacaaacctctgctcctatgtagttccgtttccgactctcttatttctgttgctgttgtcatacaaattacatgtttataccttgtttgcccatcaacacttataatttacttcacacaaaatttgatttacaaacaaaacataacgtttatactgtctttaatatctcccaaggggcaaaagcaaagcccagttgtgagccattgccttaaagtataaaaaataagtgttacagcattcttgtcctttatctcattttaaggtaacttagcacgatttagaaagaacaccagagacgtttttttaattggttattggataatgagaccccaaaaaaccctggataaaaaatgttccatttttaagtgtttccaaatctggcttgatagtttccagaacaaaaaataaagtaaaactttataacaatttttggtataaatacttcaagttagaactttgattcattaatctttattcaaatactgaaagtatgttgagaaggaaaatatatacaaactcataacgtaactctagtaataatctcaagtgagtttgacctggggagaaggtctgttcagagaaaggtgcatgtaatcgggtgatgagaatctgaatttgagccagctgtatccacacagtctttataagtcatccctaacactcagagcaattgcgcgggatagctgtttgccctggaaaaaagcttgactcttgctggtggagcccagattcaaaacgggggcagggggtggttacaaagcatatcaatctgttatttcatcacatacctgctgccttcttaaaggaaacaggaaagcattctttgatcagcatctacagggtctgagattctgctttgaaaaaatccatgtaggaaaagcgagaaggaaaggaagtacacaggaagggagagccaattcatctctgtgaccagaaaaattaaaagttctttttgcactggtcatctactgccaaatatgtgcttttaaatgggagagagaacaatatgcatgtacatagcagtattattcagtatcctgggctttttcctcttcattatggttatcagatttgtgtgcaaatgaatgtaaacacacacacacacacacacacacacacatatatgggtttttttttttgagacagggtcttactctgttgcacaggctagatagagtgcagtgcagtggtgcaaccatagctgactgtagcctcgaactcctgggctcaaccgattctcttacctcagctccccgagtagctgggaccagaggcacatgctaccacacccagctaatttttaaatgttttttgtagagacagggtctcgctgtattgtccaggctggtctcgaactcttggtctcaagcaatcctccttgccacagcttcccaggtgcctgggattacaggcatgagccacagcccccagctaacatattctttaaccccaatatctacaggatttaagactctctctgttggatagctcaacttaaagatatggtagagctctcctgaatttataaatccaaatcaacagttatttattctcccaagctagggacccaccctccttatggtcgcagggggttccctggcacactgcatgctagttagaaagccctcacactgaccccaggctcctccctatatgcctgtaccctttggccacctacctgtggatcttttctctctgggagcctccttgttctctgtgtttgggacaggctgtcaccttctgtcaactagggtaccttgctcttaaattatcccttcaatcccacctccaccataattaaagttaaaacagtagtgggacctgcttttagcctgcagtgtgtgggcgtggagggaaggcaccctgaagctccagggaaggaatggcgccatactttgtgcgctcaccagtgccccagaaaggatggcactggggacaagagccccaaaacatgggcatcccctcctccctaagaaggctcaacagagggtccccttcagggattccatcaataaagaaagcacattttatgaaggggagttgagaagtcccaggaagatttcctcacattggattccaggggtcatttatgagtgttgtgatggtcggtgggtattttttgtcattcagggctacttctattaacattgtaactgttcattttttcccaacctaataagtttttctttttaaaacaactttatggaggtttaattggagtacaataaactgcacataaagtatactgtgtgaccagttttggcatgcagttaccgtgacacagttcccacacccagatgacaaatcttcccacaactcccagaagtttcacgtgcccactgcaacccctgcctctctctgaccccatgccaaaggaaccactggtctgcttctgaaattaaagatttcctagaattgtatatagaaccacacagtatatgttctttttttaatctggcttctctcattgagcataattttgggaactcatgtcattgtgtgtaccagtagtttttatgccttttattcagttgtgtggctgcaccacaggctgaatatccattgacctattgacagtcttggcttctttccagtttttagctgttacaaatgaaactgccataaatatctgtgcctaagtctttgtgtaaacataggcttttctttcttgagtaaacatgtaggactggactgattccttcctgaggattgtatggtaaatttatagttaacttttaaagaaactgcccaaagagttgctatgttagccttttattactgctgtaaccagttgtcacaaacagtggcttaaaacaacacaaatgtattgtcttacagttctggacaccagaattggtctcagttggtaaaatcaaggtattggcagggctgtgttcctttctggaggctgtggggtattggctgtttccttgcctctccagctcctagagtggccgccattcctgggctctgactaccgctcctcttcataccttctctctctccctcctggccgcctcttataaggaccttgtgattatattgagtccacctggataatccagggtcacctccccacctcaagattcttaattacttttgcaaattccctgttgccatggaatttaacattcacaggttctgggaattaggacttggacatctttgggggacaattattctctctactgcagattgcgtcatcactgagttgtaaagttcagttccttacgtattctggatacgagtcctttgggtgtctgtgtgtgcatgtgtgtatgtatgtattgtaaatattttccctcagtctgtagcttgccttttgctttcttatgtgtatgtgccttttaattttgaagaaagcccctttatccatatgttctcgtacgacccttgctctttgcgttctatgtataaaaccttcacataatccaagcctccaagaatttttctcctgttttctttacagaggtttatgatcctagggatcaatatttttccccaatacagatatgttttcatacagataggtatggtctagcaacaccttttgaaccagttcattttttaagtgattttttaaatttaaatatggatgagaaaaaaattcttagaccaattcccatacctattaaatagaattgctaatgcctgtgaattatgccacatgctaatcaagagttttactttgcagatgatcactcaattatctttacagatctctattttaagcaatcatatttattattttttctctacagttcaaaaatgatagcttacagctacaggaagcgatatatcaaatacttaaatacttttttctaagcccactagagcaagcttctcatttgaggcaatattactgagactcttaattttatgcttaattattcatttcagtcctttaaattcctaaacacgagaaagcactagcatttacatgcaggctcatttgtaaaggtgaaacagtgacagcacggtgctgtggaagtttctatcctgtatatataaagcacaaaatacgttagtggttgtagggaaaagcgcggtagtgctcacagcgtgttaacaacttgcaacatttgttgaagaacagatgattgcacttctcatcatttgatgttctcatcaccgtgtcttctcccttctcatactgctaggaatttgtgcttggcttgtaacattgcttctacctgacttctgttttcgggtctgagaggacatttcttagataataggtcattgaaattagttagctgaaggtgacatatggataggtcttcaggtgagaaaaacattctgatttacatagtgatgtattcttaatcactgtttttgcaaggtttctctttgtcagtatttgtttcaaaatatattaatgaacttatcatttctgattactgatttatttaaccttgtaaggactgtctccatgtcagttgtcacatttttcttggtgcctagcacaaagtaggtacccagtcaacatttgtttaattaaactgattgtattctgagcatgtgccatttctgcatacccgggatatctggcttctcgagatttttcatctatgatttgaatcaatattacatgttatgtttacttgtgtgacacaggatggtcccaacttagaaatatttgtctcagaaggggctctgtgctcagtcactggaaacctggactgaattttaatttaaggggaaagtcaattttaggttcgtttggattctagttcatagcattacagttttgttcttcagtttccacagtgtaaatgaaataacacatatagcagcaaggagcagtgagccagtcatacgggtgcagtacagtacttaaccaaaacaagcaaaccataccgttaaattttgaaccaggtaggtttgggttttctcctagtttatagacaggtatttattcatggaaggcaagttggatggagattgcagaaaacctaaaagagaggaatatattttgtgtttttggactttaacagcactaactttgatttccttttcctgtgacatacttacctctgatttttgctcacactcagcctcactgttctatagttttggagtgtttcctgcaaatcacagtgtctttctgctatacattgggataagaaaatatatacatgaattagatctggtaatggcaggccttgagaatagagcaaagggtaaaacccaaatatgtcagcatccaagcccacataagtgtgacagttctccagactgtgttaaagtttcctgattgtattaggacatattgtattgctataaagaaatgcctgagtccacgtaatttgtaagaaaatgggtttaaatggctcacaattctgtaggctatacagaaagcaagccactaaggcgtgtggcttgtgtgcctacagagcaccaggatgagctccctttgagccctggctgaagcaggagcagtggggatgaggggagcagtgtcctgaggcagctgggccctgggcgtggctcaggaaaccacccttctcttctaggcccctgggcctgtgatgagagaggctgccttggagacttctgaaatacctgtgagacctttcccccactgttttggtgtcagcacttccctcctttttagatatgcaaatttctctggcaagtggttgctccacagcctgcttgaattcctctcctgaaaaagctttttcgttctctgccacatggccaggcagcatatttcctaaacttttttgctctaccttccctttaaatataacttccaactttgtcatttctttgcttctgcatctgagcgtagtctgttagaagaagccaggttacacatagcatgctttgctgcttagaaatttgttctgctagataacctaaaggattaccctgaagttctaacttccacagaaccctagggcatgaacagaatgcagccaagttctttgctaagaaataacatgtgtgacctttcctccagttctcagtttctcatttccatgtgagaccttgttggcctggacttcaccatccatatcactatcagcattttgatcacaaccatttaactgttctctaggaagctgcaacttttctctcatcttcctgtgttcttctgagccctccaaactcttccaacctctgcctgttacccaattccaaagtcacttccatattttcaggtatccttgtagcaacacgccacttctggtaccaattttctgtattaggccgtgcttgcattgccttaaagaaatggctgagtctagataatttagaagaacaacggtttaattggctcacatttctgcaggttatacaggaagcatagtggcagctgcttcgggggagtcctcaagaggcttacaatcacggtggacgggtaagcaggagcaggcatgtaacatggcaaaagcatgagccagagagagagttggggggaggtaccatgcacttttaaaccaccagctctcatgtgaactcagagcaagagctcactgatcaccaagtggaggatggcccaagcgaaggatctgcccccatgatcagtatacctcccaccaagccctgcctccaacattgagggctacaattcagcatgagatttgggagggaataaatatataaactctattactgaccaatgcagtttctcctcataaacactgacctgatgcagggtctttttggcgtagagggggcatggagattagttcattctgattggtcattaccaaaggctgggcaagggcatgtggtaagggatgcaggagtgcctgtggaatatagaatggtgaatgaggctgagcagggcaggggtcccagggcccagagagaagtgcctggcccaccatccacctgggaacatgctaggggtttgctaacggatggccaaggtggctgggaagaaaccaggaggcaggccagggtaggagggcagccacactcatcccatgagtctagtcggcagcccagggtccttggccagctcaatgacttatctcctttaagggacttgattgtctcaggcatgcctacagagtttccaccgccagccagagagccaaaatgtttcccaagccaatcccatgagatgcctcacttctagtgagccacccccagcccccacaacagcctccagtcagggcccacctgaagcctcccttttccaactgtaaagctttcccagctccccaacctgcatttgagcttctgccaaaggcaagtgctggtgtccaactttcttgctatgcaatctctgaatgaatagcctctgctcgttctcatttgaagagattttcatttaccttcacacatggacagttatctttataacttaactcagtgcctcctcatttaccagaatctggtcttttcgtgggcttctcttgtcttcccgcaaatgtaataatgccttcctatgacactaggatgctttgagcagatagactcttccagtccatgcaaagaggtggtgtggtttggcctcactcctcactgcaggcttaggccagctcccccttgcagccacgtgcgtggacgtgactctgggagtgaagtgaaatagcgctgccgacaggatctgggctctgtgctgtgtgccaggagcatagagagcaatgtgaaacagctgttgcccacagtgacctttcagaacagtttttgctgttagggttctagggattactaagtaagcttggctggttaagaaggtcaaaaaaagcccaaggcaaccccagctgtctgaactagccatttcagaaggctgaaacctttctgctgtgaagggctggatttcctagcttatgtagttcaaagctcagtttttaggattgctgtgctacttactgaccgaaagttggtttttggaaattgacccttattttccaatatctttcataaagctggaaatgctttcactagaagaaaaggaggatcttatgttagaacatatatatatagcgatgtaaaagtttcagtagttactctcaaaagaaggtcaccaaggacaactgtgatttcatatgtaatgattccagcctagaaaatgtttttttcttgatttccatttaagagagttgagccaattaactaatccttgcatatggtatgttccattaagttgtcagtgtttttattccaagatgcatgtttctttaaaagagctagcttattagggcatgtcttcataagcactttaccctggccatgtccgtgagaatgctgtgcataactttcattgaattctacatctcatttgatgcaggcctaattaactattattaactgagaactccaatttattggaatcatttgctgcagttaacttgagaaagaatggggcatgtttaagggtccttatttttaaatctctctttcattacaaacacattaacataagtctgatttgggggtgacagaaggaaataggaaaataaatgtaactaaaccataatggggtacaatataaaggaaagtaagtactgggatgaatatcatcatagattgtttattctttaatttgtactaatttgtacatttgtatatgtacaattaagcacttcttagttaagattgatatatttttaaaatcacaactttatagagcacaagtcttacatgaaaacataatgccaggtcagtggccctccacttgagcacacattcaaatcactgagagggctctgtaaaacacacattgctaggtcccaccccagcttctgattctgtagatctggggtagggcctgctgtgtggtttgaacgtttgttctctctgaaactcatgttgaaacttaatccccaatgtggcagtattgagaggtgtggggtctctaagaggtgttgggtcatgaaggctctgccctcatgaatggaccctttcgttcatggattaatagattagtgagttgttggatgaatgcgttatcaaaggagtgggactgctggctttgtaagaagaggaggaggctgggcactgtggctcacacctgtaatcccaggactttgggaggccgaggcaggtggatcatgaggtcaggagtttgggaccagcctggccaacatagtgaaaccccatctctactaaaccccatctctacaaaaaattagccaggcatggtggtgtgcacttgtaatcccagctactcgggaggctgaggcaggagaattgcatgaacctgggatgcagaggtttcagtgagctgagatcacgcctttgcactccagccctggctacagtgcgagactccgtctcaaagagagaaaaaagaaaaaaagaaaaagagagagagagagagagacctgagctagcatactcagccccctcaagatgtgatgctctgtgctgcctcgggactccatggagtccccaccagcaagaaggccctcccaaaatgtgtcccctcgacgttggacttctcagtccccataactgtaagaaatgaatgtcttcatacattaccacgttttaggcattctgttaataagcagcagaaaatggaataagacagagtccaagaatatgtagttggacagcatctcacttcatactgatgctgctggtccggggacctcatttcgagaatcaaggtgtttaggaaacaagcagtagaatatcttagatgaacaatactagtggtgtacattttaaataaattgaacaattactgattagctactatgtactgtcaaaatggttcagaaaaatgacaccaccacttctatcaaaatgtactggatgttgggttttttaattaaagcaacttcactttaaaatgtggttttacacacattcaaaacactgctgaccctctttcctcagctgccattaaggtgcttagcccttccgaggaagctaaggccttgtgaagctgtcactcattgggtgactagcaccctgcccggtggcaccagccccgcactcgcccacaccatggcctccatctttgtttgagctcacttgcatctactcggccctcattctacagtgcagtgtggtgaccatcacataagaccgtcgccctcattaaagcagctagtgtaaatggtgaaacttttgggcctgacctgtttgcaagggcctggccagtgtcaacatcgggagcctttttggtagcatgggggctggtggacctgtacctacaggcagttctgcccctgtaccatttccccagccagagtcaacattgggaacctcctctgcagcagcatgggggctgctggacctgtacctgtaggcagtcctgcccctccactgctgccccagctgagcagaaggaagtgcaagcaaggaaagaagcatctgagggatctacttaggacacgggctttaatctttttgaagaaacctcttttgtaacatgatcagtgaaaagctgaactcttggctgggcaccgtggctcacacctgtaatcccagcactttgggagtccatagtgggaggatcactccaggccaggagttcaagactagcctgggcaacatagggagaccgtgtctctacaaaaaaaattaaaaatcagcctggtgtggtggcgcacacctgtagccccagctacttgggaggctgaggcgggaggatcacttgagcccggggggtcagggctgcagtgggatgtgatcaccctactatactcaggtgagaccttgtctcaaaaagaaaagctgaactcttaaaacgtgcacacacacagtcagctaacatcttcataactgtcagattgtgacaatttgattctaactcaagatcagcctttcttgtagtttattttgtgtctttaaggaactagcctatctaacacaaaacactggctttaagttttttctcttttttgtaattgggaataaaaattatgctcaagatacatcaagattagttttggagaaaaaaagcattaagtagattcagttgtgcaagatgcacaaagtgtaacttcataagtaagcggtcacaaactcgggttcataatccgttacccaaaatctatggagccagatgtatttaaatataggttatttttaaaaggtattagaattcatatgttccatgacacagaacgttctcaggcagcacccgtaatcaaatccattagtatttctatagggaagtgcttgaagagtcgcactaagtatgataaatgtggaccattaaaaccacctcatgctagcccagtacagattttgcagtgttttcagaagcttttgggttatggaattgggaacagaggctgtgtttgttcctctgcagccccggcaattaagaagtgtttgtgaagctggtttaatgtgcctagcaggtgtgatgtattggtgaattccaaataattgatagttttgtttgcttttttttttttttaagcaaaatatttggtaggaggcactttagtttctcaagttcaatagctgtttgctcttactggagcgttgctgttaagggagacagcagatcttgtcaattccctataactcacggttaacaaaagcattccctaatgattccatatgttgatgctcagaggtaattctgggccaagcgctcagagcacaacacagattatttcactccatggacgcaaccgcctagaaggtgtgtggcatgactacatcattaggatcccattttagaggtgtgcaagccaaggtccagcaggcttataagacctgcagtatgaataggatcctcattttataggtgctttacccaaggctgctagcttccagagtttccggctagaaagctgcagagttggggtttcccgaaagaccaccaggctttagaggacctggcttcactgcctgggctgcctgccacctcccacacctaaagcatctccccccgccccaccccacccccagctttaaggccacccccgctctgcaggtcagcggctattaaatacatttctccaataaacatcgtatgttagacaggctaagaaacttgtcccagggcgtgcagctgagctgggagttttctgcaggtctcttgggtccccaaagccctaggtcttgtatgaacatgagggtaggagcaaaatcaggccttcccatgtgtattaatgttactctgttctcacactgctataaagaacttccctgagactgggtattctgtagaggaaagaggtttaattgacccacagttccacatggctggggaggcctcgggaaacttacagtcatggcagaaggggatggcaaggcagcaggagaaaggggcaaaggaggcacttgcaaacacttataaaaccttcagatctcactatcacgagaacagcatgggggaaaccaccccaacgatccaatcacctccctccctccacacttggggattacagttcgagattgtcaggcctctgagcccaagctaagccatcatatcccctgtgacctgcacgtatacatccagatggcctgaagcaactgaaaaaccacaaagtgaaaatagccacttcctgccttaatggatgacactccaccattgtgatttgttcctgccccaccctaactgattgaccttgtgacactccttctcctggacaatgagtctcagaagctcccccactgagcaccttgtgacccccacccctgcccgcaagagaacaaccccctttaactgtaattttccactacctacccaaatcctataaaactgccgcacccctatctccctttgctgactcctttttcggactcagtctgcctgtacccaggtgattaaaaagctttattgctcacacaaagcctgtttggtggtctcttcacagggctgcatgtaacagatgagatttaggtggggacacagccaaaccgtatcaccatatgtgcttcttaatgacagttggctcaaggtgttttccccgtaaataacgcaactcacagttataaaattgaagataggtccccatttgcatggtaagcaggtacagctccctgagagagcagttggggagaaaccctcgctttttatatctttgttgggtaaaacatcaaccactgtgcctcaggggcggacttagtgagcatttaagatacattttcagttataaaatgttacttgatttgcagcaattacccagtctccgccttagacagaaacttagaggccatcggcctagacttcctccaggcacagggcttccataacagttgaattaatttaagccttaatgcctcccataagcccccgggaactcaggctgcctctgaggatgaaaacacccgccagtctttgggccccagcctggggcaccctgtagcttcttcagagcttccacctccctgccaggctctccccctccccatgctgcccttgcagctactacagaagctgctctcaacatgccacacagattccagctgggaggaggggagtggtcacagtcacaagggatattttctaattctcctaaggagggtagtagtgtatgtggccctagcatgttaaaaacaatatgacctttcctggtaaaaaggaccctgaagcaatgttaaagctgcaagcttgttagtaagcagggaagaatatccatctgatggccctagtgcaagtgttttatgctcctttattttatttcagcatttttcctttcacaacgctgtccctttaagtgtgccatcatcaacagctgtagttatcatttgatctgaggagtttaattacttgtttagatcctttcttattccacggatttaggattattttatctaaatggtgaggaaaagtgtctgtctgcacagtcccctacagatttataatcccacagttctgtgtcttttaaattaaaagctccatgacattttaagctttaaataaacactgttggaagcatttttagaggatacagctgttttcctgcctttgtccacactcctttcttcctgttcgcacactcgccttagtcagagttccacggagcacctccatcgtcctgcctgccctctgttctgttccttcactcggcttttcaaacccgacagtggtgtctcacttgttcgatgcctgcagtttccttttgtcaatcttcctctctcaactactagaacaaacactcaaggaagtaaaatgtgccgcctcactgccaatccgtccatctccttgccctgagagccttggctctttctccccctcacagagaagaagaaaataaaaggagcgctcatgcctgggtaaccctcccttagaggaggcttttcaccactcagctgttgaggaggagggtgggccagcccttccttctgttctgcagcttctgtagggagaccgagtgcaggatggaatccaggaagccttgagttactcaggttgttacttgaacttcgacttctacaaaccagcccagacttttctaagagtcctgtcttttgtactctcctaaagggctttgagccctccattcagggattgggccttcacagtctgcagtatccagaacggtggaggttctgaggtttgtttggtgtgttttacagcaaacttaataaaatacagcttgtggccaggcgcagaggctcatgccttaatcccaacactgggagaccgaggctggagaatcacttgaggccaccagtttgagaccagcctgggccacagggcaaggcatcccatgtctacaaacaaaaaaataaatgaaaaaaatacagcttgtggtagaaaagcaaggagaaaaatattatagtgctgaaaatgaaatggcacctgcagatgcagctgtgggtggatttgccaagaaaagcagagaaagaacagaggagggctcttcttgttgctgttagcagtcaaaaccagagtatccatcaggaggtggagaagccaggggtcttctgcagggaagagggccacagagggggtcagtgcacagggggaggaaggaagatggggagtgcagggcaggggccacccaaaagcccaaggaagagcccagtccacaataaccagcctctcctggtctccagtgtccacagggtggactgggcccagcctcagccccatcccaggaggaagagccagagagttccccaggcaagtgcagtgagccctgggaccaggagagaagcgtgcacagaggcaaagtccacaccgtggcagccaaagcagtcagtgagcccagtcctctgagtataaggcggcaagagccctagccgatgctgcaggtgcagtcaagagatgcagtttggatgctgctgaaggaacatgatacagggccacacggaaaactttttctcaagacagcagcactctgcccttggttcattcaggaattttgcatataggtggtggatatgattgactgcccaggccttgtgtctacacagatgaccattcaccttctgtgagaaagatgcaggagacaaagcacaggtggccctaccattgcagcggctcacaagagaccttcccggcctcctccatgtgtgacacagcgaatcctgccgtgtggtgcaggcagctctctgcatgcctatctgggaggagcagatattttggagttaaaacctgccctaactctcttttttttgaagacataatttcgctcttgttgcccaggctggagtgcagtggcacgatcttggctcactgcaacctccgcctcttgggttcaagtgattctcctgccccagcctcctgagtagctgggattacagtcacatgccaccatgcccagctagttttttgtatttttaatacagacggggttttgccatgttgcccaggctggtcttgaactactgagctcgggcagtcctcctgccttgacctcccaaagtgctgggattataggcgtgagccaccgcgcccgccccataactctcctttagtcgcagttcataccttgccaactttcaaaacacatcgaggcaattacagacaagcatgcatacctatgtgcatgtaagcatgtgaacatacataggagtatgaagacttacatgcctcttggatacacatagccttctctgtgcgtacacgttacttccctcagtgtgtcctgggtctcccagatactatcttacagggaaaaaaactagtatttagggatgattattgtatttgtttatgtcattgtgggacagttaaaggccattgagatcgcctgctcttttcaggacttcttgttgggtccagctgtacagattcaaggtagactacgtcctgctaatgctgctccacaccctgtgggaaggtttcagtgctaaatctagaacaggtggtcagtctcctaactgaatttgaatccagatttttgtcagatgcatccgtgtgtcttcttcttaaatcagttgtgaacagggctatttccagcctctcgggttcagggactgcctctgtgccaccgcagactggaagacaaggactctgcccaggccttgggatagccttctgccttcactggggccttggggggattgtcatcaggcaacactcagctccatggagcttacctgggtttgaaattccacttggtagacattcctctgtgttgaagtatttctttttttttggcataatgcctcctagcaggtcagttagttggttcttcagtaaagtaatctttctaggcccacactggagacagagtggggaagacagctagtgtgtaacaagcatgctctaggaggctggcactagaatgttacttatgtgccctgaaatattcattctgtaaagtaggattatttcactgtagtagcatcctcagtagtattcttattggtaatatgagtgcaattgatactatgtatatattaaatatacatacagaaaaaacacatgaatagaaatgggtgtgagccagtactagttattatattgtatgtagtgtaatctagcgtatattagtggtactggtactattattagcagtattcctgttcatcttgtgtaagcgtgaggaaagcaggcacctgcaggctcactatgtttctgaggctgtgccctgagtaagtgccgagccgggagttaattctcaggtcagctttcaccatcccgtgacagcctgtgcattaaatgttctgttcttacctgggagcttcacagcagcatcctggccaggcatggtggggattcatcccactgggcagtggaaatgtccttaatactagtgggccatgcagtggactttgtcagctggtgctggcttccatgttgttgggaacaccgagtaatgatgccttgtgctatcgaatggaattgaccattccaaggatatatttagattcaaatacgtacatttaaacagaaaacacaataatacagatttcatttctctcctgagttctgaatttccagatcacaactccagacataactccagcagccttgagaggaggctgcccatagtataatttagtgagaatgacctgcaagcctttctcctgttcacttaggtctccacaaaagcctttgttcatggaatgagacctacacagtgtatgtttatgcggacctgatacaaacttactgttcatacagtatgcactctaaaaatctcttttttttttcctgcagatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggtgcggttgcctcgctgtttgcagggttatgtttgtgactattagcaatggttttgtaaatcacctttaaagtctagcatagggcatgcttagtttgtcctcttttcttcagtatctaaactaagtccctcctggtgctcctgaaagagtttggctgatgctgtgggatgctgtgattcaattttctctttaaaagcttcttaaaataatatgcgttagtttcagtgatttctgggttccaaaaacatttgagtattgtttatattactatatataaagattatgttaatgacagaatgtcttcaaagtttaccttaatagatggttttgcctttttcttttcaaaatcagatataggattaatatttcagcaactattcaaactttaacaaattgataagcagctaaatctccccaaagacgcttaattaaaaaaaaaaaaaagtaaaaagtcgaattcatttttagcctgtgtgtttatatgccgttcagccctttctttacttgtatccagttttcttcggaaaggaaaaacaactttgttccctccgtgcttgttaactgacattcaatcagaacgggcttgcctgacgctccttgttcaagaatattctagattacagaccttgaaaatagactatttgaagatttttctgggatatacaggatgaatactctgtctttagaattcctggtgctaggggagaaaaaaaacagcagttatgtgagtaatcttggatttaaaatgatattaatatgaagcatacctacttttgaaatgtatgttattatttatatttatacatatgtccaaacatgtggattgaccattcctgggcagcacacacacacatgcaaacacacaccctttgtaatcactctgtctgcatccactgaaaatggtagtgtttgtgaatctcaggcatgggtacgagcatcgtgatactcagttctctgcatctagtgtctttctgcaccatttgcacatgaagttaccttgataagtcttggtgaaacacatccatacagttactatatacaaatttaattgtggtaggacacagacacacacactaaaatttaccattttacctattttaaagtgggcagttcagtagtgataagtctattcatgttgctatacaattgacctccagaactttttcatcttgcaaatctgaaacttcgtgctcattgaacaagtccccatttcgccctgccctcaacccctggcagccaccattctactttctgtttctaagatttttactactctccatacctcaaataaggagaattatgtagtatttatctttttttgattggtttatttcacttagcataatgccctcaaggttcatccatgttagagcatgtgataggattttcctcctttttaaggctgaacaatattctatggtatgttagaccacattttgtttattcatagttcatttgttgagggacatttgggtggcatccacaccttggctgttcttgtgaataatgcttatataaacatgagtgtacaaatatctctttgagatcctgctttctagtctcttgggatatacccagaagtggaattgctggatcccatggtaattttattattaatttttgagtgaccaccatattgttttccatagttgttacaccattgtatattcccaccaaaaatctataagggttccaattactccacattctcatcaactcttgccatttcctggatttttttgatagtagtcatcctaatgggtgtgagttgatatctctttatggttttgatttgcatatctgatgattggggatggcaagaatcttttcatttgcttgttggccatttctgtattatctttgaagaaatgtctgtgcacatcctttgcttatttttgatttttgtgtttttgtttttatgttgtaggagttccttatgtattttgaatgttaaactgttatcagacatatgacttatgaccattttctcccattctggctcccttttcgcttagttgttggtgtgcataagtttttgattagatgaatttgacatatgtcatctcatttgtctaattttgctcttgttacctgtgcttttggtgtcatagccaagaaatgattgccaattccaatttcatgaaactttaatttatgttttcttcctggagttttagttttaggtcttacattcaggactttaatccatattgagttaattcttgtgtatggtgttaattagaatctagcttcattcttttgtacgtggatgtccagttttcccaacactgtttgttgaagagacttatcttttccccattgagtagtcttggctggctcgttgaagatcgtttgacaaatacgtgagagtgtatttctgggctatctattctattctattagtatgtaggccagtactgcactgttttgatgaatgtagctttgtaatatgtttggaaatcaggacatgtgagacctccgattttgttctttttcaagattgttatggctatttgggatcccttgagattttttatgaattttaggatgtatttctctgtttctgctcaaaatgccattgggattttgatagggattgcattgaatctgtaggattgctttgcatgctatgaatgtcttaatattaagtcttcccatccatgggcataagatgtctttcaatttatttgtgtctttctttcagtagtgttttgttttgtagtttcagtttataggtccttcacttctcttatttctaggtattttattcttttgatgctattataaatgggattgtttataattttctgttcaacttgttcattgttagtatattaaaatgcaactgatttttgtttgatgtgtattctacaactttgctgaattggcttattggttctaacaattgggtttttttttttaatatgttgaattgtagtgatttctatatatatgatcatgtaatctgtgaacaaagataattttgtttcttcctttccagtttggatgccttttgttgtgttttcttgcctaattgcctggctgagacttccattattatactgtctagtagtgacaagagtgtgtatccttgttgtgttcctgaacttagaagaaaagctttagtcttcattgagaatgatattagctgtgaacttctcatatatggcctttaatatgttgaggtagttttttttttctatccttaatttgactgtttttaatcgtgaaagggtgttggagcttttcaaatgcgttttctttctgcatcaattgcggtttttgtttttttttttttttttggttccttattctgtaaatgtggtttcatatgttgaaccatttttgcattccaggaataaacttcacttgttcatgtatatgatcctttcaatttgctgtggaattgtttgctaatatcttatttagactttttaacctgtgttcatcagggatattgatctgtattttgtttttcatatagtgttttccatgtttggtagggttctccagtgaagccatctggtcctgggcttttctttgtggggaggttttcttttattactgattcagtctccttactacttacagatctgttcagattttctatgtcttcattttttcccccttctcaaaatcatcagggattctctgtcttcatgattcagtttgggtaggttgtgtgtttctaggaattcttttatttcttttaggttatccaatttgttgtcaaaggatatgccaacaaatagtattctcctttatttttgtggcattggttgtagtgttgccccttgcatttctgattttagtcatatgagtgtttttgttttttgtttttttagttaatgtagctaaggtttgtccataaagttactctgtgactgagtgtcttttgtgactttacaaagcactcatgatgtatgaggcatgcacgtgtcttatttcttccatatctacccaagcctttcacatggttttctttctacactttttgttctatattctaagatatacttgaaatatgttctactgcaattcttaaaaagaaaaaaatgttttatctagatagtctggtagtttggctggagtgctagtgaatctgttttatggaatctacttggtgatcccatcaacgtagtgtcttcatttggctttctaagcgagcaggtatcagattaagtaaggtgccaatcatagaaactcatagaaggtgaacaaccagccaggagctagttcttcaaagatagttcagtcctatagaacttatctagatggctctcttttctttctttactactttttgacctctttaacttttttttttttgacttgacaaatcatgttttttggcatatgatttgtgtgtgcgcgtgtgtgtgcacacgcatatacttattttaacttttactagccgctcagttgcgagtagggacttcaatactgaaagtctctctttgaaaatgatcatatctacatgccatatacacaattagctgtgctttgacagagcagagcatgcagaagacttgaagagtatacagaaatgcacaaggtaatgctggagagaagaaacttaaaatcatgctgggatgctggctcagatgatgtgcagggacagtggtcagatgatgtgccgctttggtattctgaaacgagttaggtgtaggataagacaaaattattagaaatcatacttaacctgaagggaaagcaagccagaggaggacaatgttggactgaatgtatagagcagaaagacaggccgtgcctaattccaatccagaaatgtgttcttccttagggtttctgctcaatattataccagtcacaaaaatgaagataaaatagctcttctgtcctgaaagaacattcttggagacctagtttccattcattttgcactcctcccatctcctcttttatctgcgccaaacctgaattcccctcggaaggtgaccttatagcgtcattgctctggtgactagattcagagaaacttgctgctgtagtctttcttctaggtgttcattttgctcacttactactttgttcctgttcttaaggtgtagatgataatataacccttgactttgtttcttttccttctggaagtattttctggtagggtatgttaggttgtggaaatgaccttgagctctttagaaaagaaagctgtctgtagggagggctttttaattcaacgtcattctttttcacatgctttcagagcgacagccgaacccaaggaggtatttagcaagttaaattgccggagtgaatggtagattaccaggggaagcagcccctgatcatgctgcaggggctgtgtgctgtgattaggctgcaggagggtgtctgcttgggccagtcaccagggaatcagcttgattatgctgcagggacatgactacctgggccaataaccagggaatcagcttgattattcttgggggtgtgtctgtcttggccaatcaccgaggaatcagtccaattatgctgcaggggtgtgtctgccttggtcagtcaccaggggatcagcctgattatgctgttggtgggtgggtggtagggggccggggagggggacgggatggggtgaggtgggggacggatgggtgtctgccttggccagtcaccagggaatcagcctgattatgctgcgggagtgtgtctacctagaccaataaccagggaatcagcctgattatgctgcagggtgtgtctgccttggccaatcaccagggcatcagcctgagtatgatgtgggggcatgtctgcctgggccagtcaccaaggaatcagccccctgattatggtgcagaggtgtatctttggcttgatcatggtatagaagtgtatctttgccctgattatgaagcagaggtgagtctgcctggtcatggtataggagggctctttgcctgggccagtctagccactaagaagacaaggtggacctaatggacttgaaagacgaggcagagtggccctgatgcactcgcacatcagctgcctatttgctatcatcacatttctggaaggccctctctatgaaaaggtgggtgggcctacgatgtcctcagtgggaaatccttttgagcagttagttctgtaggcatttcttatatggcttcatggttccatgtaaactgtcggtcagccaaggcttaaattattttaggaaaataaacttttaaattgtggcacaaattttagaggaaaaaatgcatgtggttcatctcttgtgagttttctagggattttaaaaataggtaccgtattacaactggaaatgtatgtcacattacttaaaaaaaatcttcacttaggatatcagaaaatcttgtttaaaacatagcctatgctggttacctccattgtatcttgaacaaatcctttcagtaatgaattccttgggacagatgaaattctacatttcattataactcagcgagggtaatttggattcaaagaccaataagaagaaagttggtgccttttattgtgtagaatcccccaggagttttttctgttgtcccagctctctgctttcccatgtgttttcactaagcatgagattcctagaggaagagcccagggcatggtatctgggccagtagaaaggacagcctgccttgcagatgtgctcctcagcctggccggctctcccctgcatctcttggccggctctcccctgcatctcttggccggctctcccctgcatctcttggccggctctcccctgcatctcttggccggctctcccctgcatctcttggcccttaccgcctgcaccaggctctctggtgttaacttcctgccctctactttccccctctcagaccatctggagcagaaaaagcaaactagaaccctggccccctggagagtcgtggatgggtgccagagctccccttaggtggctgaggggagggagcaggtgtggcctgtgtggtagaaaggatgggtccagtcacagctctgcagcggagcactcctcctgctgtccagccccagtccccttaggacagtaggagtactgactgacatgcccactgtggggtactatgatctgaatgtgtcccccaaatctagtgttgaaacttaattgccagtgtgataggattaggatatggggccttcaggaggtgattaagtcctgaaggtggagcctcatggatgggattagggctgtcatgaaaggactagagggtaaggcctgctcttccattcctctgtcacctgaggatacagcattcctcccctctggagggtacagcaacaaggtaccatcttgaagcaaggagcagtcctctgcagagacagacctgctgatgccttgatcttggacttcccagcctccagaggtgtgagaaatacatttctgttctttacaagtgtccagtcccagatattttgttatagcagcacaaacagactaacacctggggcattgctgtaagacaaccttggagcatgtgtggttacacctggcccagtgagtggctcctagcaggcacttgtgtcatctcctaacccaggaggatccagtcctcaccctgaatcccaccttgaggagttagtaaggtcgttctccatccctgctcggcttcgttgaaaagcacacaccagccatgacatggacaccatgcacatgacatgggctctagtcctctttctgtccaagctgtgtcttcctcttgtaagtaagccttcctcctcaggctgacttaggtaattatggttgtttccatccttctactttttttctttttaattttgttcttggtttattttcttacaccgttgtcttcctggctgttaacagatacacccccaccctttccattaggagcatctggcaggaaggcactcatcctctggaagtcagctaacaacttgcctctctttcctctgaactctcgtgcatgtagtgctgagtgagtgctcggggggacacaggagaaaggtctctttcctaatggagtatgtcatccatttggggagaggggacaggcatatctgcagcatccaagtgaaaacccgtggtaggatattgttgcacagcaaaatgagaaattcaggaaagagatgccaaagggatgtagaattaagtaaagcaagatattcttggagtagtggccgctcctggggtagggggtgacctcgggggagtccacaagaacagaagagatacagatgggagaagccatttcaaaaggaaaacagcacctgtggaggattccagtcagccagtgagtttgcttctatacagcatgaagccaagcttctcatggctcacaagcttcagagaggaattgtggctctatgagttgagcttcttattccccagctcatctgtttgctttctggatagggagaaccattgggatttttaaaaggaggcgtgtcagaatgcaacctgcacttggggagaatcctctgggtttgtggcacacaacgcctgcagcctagaagagatgggccagaggaaggccagggtgatggtaaaagacatgcaccccccttgactgggccatgaggtgtccagacggaacattctttggagtgtgtgtgtgagggtttttctggaggagattagcatttgaattggtggattcagtaaaggagattttcctttccagtgtgtctcatgaaacacatcatttttcgcatcatgaaatttgtcactagaggaatgaaaggatgatcttaagtagggagaatatcccttcaggataaaaaaaaaaccacaatcatgatatgcttttttttccattggagacacagtctcattctgtcacccaggctgcagtgcagtggtgctatcatagttcactgcagcctcgaactgctgggctgaagcaatgctttcacctcagcttctggcgtggctaggactgcaattatatgccaccacacccactaaggtttttttctttttttctttgtagagacagagtcttgatatgttgcccagtctggtctcaaaagttctacctcaagcagtcctccttcctcagcctcccaaagtgctgggattacagacatgagccaccacactgggccttttttttttctttaattacacaaattacacttgtttcacacggtacaaaaatgtatagcattaaaattggaagcccttctaactcccactctcctactccctggagataaccgttactcagtgtttaactatttaaggtacctcatttcaccccttgtcttatgatgcctatgtgtttgtgtgtagacccacaggcacacagagatatgctcacctacactcacctacatgcacctttatggaatgaggccgctgacataattcaccaagatccagagcaagtacctatagattaatgggacagaaatcccaaatgctttaattaaattgttagtcaattttttttttttggaagtaggtctaacaaaagtgaggacatctttttcctagctcttaaatgaattgtcactgtggatccctgaaatgctggacatcccttgggatgggaaggcactcagagcacttcctgcctgggagcacttacaaggttgcattagtccatgcagtgctaacatgattcttgtgtcaaggacagcttccagaagacctcagcaggcaagctgtgctgctttggtttgtcctccttagtgatggaggtattgtgctgtccacacccttacagtcctgtagattttcatatgtccacactgacacagtcacatctcttgttccgtctcctgtgccagtggcttcagggccagctgttacctttaggaaccaggaagcacccaggtcagcttccaggccaagaaggaagccagcagaagaattatagcccttggtttataggccgctctgataatccattactttctaagtctgggcagcaggcctcagtgttgaggggcagtataacacctaggtggcaggagcctcacagagaagagggacccatttgtgtacatggcacaaactgtgtctccacctgcctgtcattcctggcctatcctcagccagatttcacagctcggtgctggggctatgccagttagatctacccagggtgttggggcttcgagtctcattaagatggacagtgcctaggaaccccagaacacattctctgtgccatgttcaggaaacatgcacctgaagggtattcatgccacttttccttgttggtgtccactatggtcgtgttggctcacaagcattgaggactcactgcatgtcatgctctcagtgctttcactcgtgggggtatgtgtcagcctcctgccgccgctaagaagcagtcgctcttagcacagggaatggcaggtaggactgcaggggtcaagttacttgtccaaaagcttgcagcctctgattatggaggctggcctcgaacccaggtggggaatgaagagtccatagctcttagccacggcgctctactgccccagatgatgtggcggtgaccttctgttgaggtagacaacatcagagtacaaaggggagaagatgtgttctgacacgggtcacagggctgagccctttaaggccatatataacccatgtggagaagtccccagtgctcggggactctgcctcgtccagctccgtttctggtggtggtctcgatttggggcactcagctgattctcagtcgctggagaggctctgctggcaaagctggacctcagggatttttacttaggcagattgtactccttggataacagcacaattaaaggacacacacaacaagcgaaaaggaaaattgtacgctgacagtcatggtaacacattcaacttacgctgtgttccttttccgtttaacaaatcgaattagccccatgttcaggaaaatttatgatcgtagggaggaagaagcccatttgccagtcaaatgtaaatgtaaatgaaaattcttaccccccttttcctttaaagtatcagcttattggccaggcgcggtggctcatgcctgtaatcccagcactttgggaggtcgagacgggcggatcacgaggtcaggagatcgatcgagaccatcctggctaacacggtgaaaccccgtctctactaaaaatacaaaaaattagccgggtgtggtggcaggcgcctgtagtcccagctacttgggaggctgaggcaggagaaaggcgtgaacccgcggggcggagcttgcagtgagccaagatcacgccactgcactccagcctgggcaatggagcgagactccgtctcaaaaaaaaaaaaaaaaaaaaatcagcttattcaatgatgtatatggacattattcctcttttctgaatatagtgactttcataggcagctaattgccttgttatttagtaaattgtaatgaagacatcctagactaaggagaataagatacaaatctttgcttctgatcatcctagatattacctcactgcgcatgtggagatgtttctcaaagaattacaatttatattttttgctttgtttgtttgacacaggatctcactctattgccaaggctggagtgtagtggtgcagtcatggctcactgcagccttgacctccctggctcaagtgatccccccaaacccaagcgatcctcccaccttggcctctcaagtagctgacacttcagatgtgtgccaccatgcccagctaattatttctttcttttctgtagagacagggccctactatattgttcaggctggtctcaaactcctgggctcaagtgatcctcctgcctcagcctcccaaagtgctaggattacaggaatgggccaccacacctggcccagtttctgtttctaaatgtgtggtggttctcctgtggatttctaagtctttaggagtataggataatgaacaagagaaatccttacctcaaggacctctcgattcaaaggagaggaaatgagtagataaatgaccacaatgggttgaatcaagtcactgtccctccgggaggggtgtgctcacagcataggacagcactgtggagctgcacagacaggctttgaggggtgttaggtgccagcactctctgcacactgcagtcaggacgagggagtggggagggcagtgacttttaggtgagcatccaggtgtagagcgctgccagcttgccccgagtcccagcacccgctcacagcctcctggcgccagtagtagaaatggttgcacaaagcaaccaatgagaaatactttcagttttccatctgccacacagagaaggtaggagaggcttgcaaagggaatagcatccagtccttttgttacttgggcatggaaagttggggttttccttttgattgagttctgggaagtcagcatgaatcagctttcggttccctgcctccagaccctattctcctgcttcagtatgatgtccctagagttgtcaaatccatagaggcagaaagtagaattgtgattgccaggggctgggggagggggatggaggttttagcatttaatggggacagagtttcaccttggggagatgaacacgttctggacatggatggtggtgatggctgtacaacaatgtgaatgtactgaatgccacagaattgtacactgagaaatcattaaaacagtacattttatattgtaggtgttttaccacatacaacaatagttattctttttcaaatggcaagaagccattcaaggattttggagttgtgttttggcaaagctcctgtgcagatgaggtagaaagcctgtagtgagtagacacaaatgtggtttttcacataagtgttgtggataagtgcatctccttatccccaacagaatcatacactcttatcagggaagacaggtgtctctcatacgccccaagcacctgggtcatggggacttgggcccagtgtcatgggcaggtttgagtgaggtcaggagtacctcgcaccacgcctactctcttgaggtggtttctgcaccacttctatacggtgggacctttcatctccatagcatggtagacacaagaatacagggaaagtcttactctctcctttctagaggattccttagagagtagactgtaagagcaagactttaatatttgagactattgacagagacaccatcaacagaaactcctcacaacaaagctctagccataaaactgaaatttctatgaaatatttgcaaaaaaaaattgacaataggaaactatgatattttatagtaagtagtccacaaattaggttaagaactttaaaattagtttgggattactataacttaaagtattctgttatttttgtcttattgttgaatgcataaggcaaaatgaatccatttttgatgtgagttatttaaaagaagaatacttttctgttacctcttatttgtgaagaaattgaaaactgaaactctttcccaatctttatatcatttgcacttttatgtttgttttgtgacgtagtcagggttgttcttatttgcattatgtaggtgaggatacaggttcagagaagtgaaacggagaaggagaagtttgaccctggccttgtaggccattaccaggctgcttttattgagaacctcaggtatggcattctctacgatgagttaaatgccttcttcagattgggttttataatacttgtgcttgtttaggtaagagaatttacattgtttaatcacgtagagagctatagtagaaaatcaggaaaattgaatgagctattatgttaacatttcctagtttgtatcttttcctttggctattaatcataagctatttaaatagctgttttatacatttattttgtagtgatagatccttagaagtagcaacccgaaaagtgattcaaagtaaatgaaattagtactgtaagcagctttctggcaaatcaaagaagacacaaaatcaaatatttttctgaggatggtcagtattttgagatagttggtcaggttctccagatcttaagaaagccaatgaaagaaaaagtccatttaaggccgggcgcggtggctcacacctgtaatcccagcattttgggaggccaaggcaggtggatcacttgaggtcaggagttcgagaccagcctggccaacatggtgaaaccctgtctgtataaaaatacaaaaaaaattagctgggcatggtggcgggcgcctgtagttccagctacttgagaggctgaggcaggagaattgcttgaactagggaggcagagattgcagtgagctgagatcatgcctctgcactccagcctggtgacagagtgagactctgtcttaaaaagaacgaataaaaagtccagttaaatgtgccttccctttgagtttccagagctttccacattctagtgaaacctaggagacctgagttaccacagtcaagtggtgaactaagtgtgtcctgatcagaacaaaatactgttcctcggtatctttccctttcttttttatttaccattgacagctggctacagagatcatataatctccagaaagaatgctggtatagcttctgtgaggacaggaggctcctgacgatcataaagtctttttcatggagtcaccattgaccctttggaagtgttcagtgccacttctttctcatatcaacgtaaaactctgcaaagtcatctccttctcatctgttacataatacaaaagaatgcattttacttgattttcagggcaaagagcagattctgaaactgatagcacatttgcacactgaactcagaatttgccagtggtagtaacctttgtcacatggcggggagcacaagattgtgtctgattgtgtctggcctggttggggtgaagtcggggctagtgggtcgcttacatggtagcctccagcctcttcattgtgacaacacaggagcttctggtgttgaaactgcctgtccctgtaagactgagatgagatgtgaggcatatgatcaaagggtcacttaccagctagctagggggaagtggacatttcctgaatgtcccacattttagaaaatagtacgaaattcccaatgcagatactgtctgggttgtatgagtcttattttactgagttttctttgtaccatgcacagcctattgtaagcgcaatttaataaggagattttaagcatgttggtatatcaaattgatttgatctttatatacatcctttttgtctattagggatttatatgaattcaatttcacagggctaagaaaaatttttttaaatttaaaaatttctgctcctttggttgcattgaaatggtgggtctatggctcataaaatattctatgcatggtaagctaaaatatatctgtatttggatttagctgcataagtacaggaactgaacatcagactttaataaacattaataaacccttatgctatatgtttttcaatgagttattatatagtatatataatatttagatactatatatactttaaattctcaacattgttttgataatttgctctaataacgctctaataatttgagcacttgtagagaatatttagttaagtggttaatggaagaaactcgttggggatttttggattccgtttctaggagggcagttctctcatgaggtaaatttcctatctggtctgtgcatgaatttcttgaagaactgacaataattcttcctattagtgtcacaggcaagggggcaaaggggttaggtgtcaatgcctggctgatttcctgcattacaaaatttacctcttacttttctgtcttcctgatgttaccccctcttttctttcacctcttgggcctgcacatgatttgtttgctatcaggggccaataagctttctctgtgttttcagctttacagaccccatggtatatgtgtgaagcctttagctttgctgtgttaagaagcaagtagctgtaaacagtgcgtgagtgggtgctggtgctgcactccagtcaaactgtctctacagacacagaaagtggaacttcatctcattttcacaggttataagatcatattttttgactcttttcatttaaaaacaggtagtaagttgaatttgtgtttcaaaaaaaaacaaaaggcaggataaaacgaagagctaaaacaccacagagcaggttgaaatcccggatgtgaagtagtggagccattgggccctccaccccaagctgtgcattcagaatgccacctggggcagaaaacaggtttatacacagagccagagagacttcagatctccggtgatcaggcacagtggaggacgtagataaaagatccctgcaccctgcgctgtgagcccaccaggtcccttcacctcactctcttttatgcacaaccaaaaaagatcctggagaactcttctctggggaaggaagttacctcatgacaacaactcttaaacaccaacatttcgaggcccactgatggaaaaactgactacaggtagtaacttcgagtttggagaaggctcccacctgtgcccccaggtggtgctgtgtagcttactgagaatctgcctggcggctcagcccccactcttctgttgtggcaacccacatctgaaatgttgtcctctggggaacatgcatcctttccagacactcctgtaatctatatatttgttcctccctttcaagaggcttagaacttaaactttggttgtcatttttgttgatattatgctgttcattcctagtatagccgttttctaaaaggagagagaagcaaggatcatggatcagtagccaacgttagagtcagagagcagtttgcatgcaggttgtcacagaggcacatctagaacacaaggaaactctcatgcattccatgtgcttattaaaagggcattatactgcgaagtactagtctaataattctctgcaagggatttaaaaaagggatcaggggttagtactacttgctagagtcagagggcaatttgtatgtaaattgttacagtggcaaatctggaacacaaggacactcacatgtatcccatgctattaataaaacggcattttattgtttaagtcctagtctagtcattctttataagggaaaacaaggatcaaggatcagtacaccatgctatagtgagagggaaattttcacgttaagttgttacagagacaaatctacagcacagggaaatattgagtcatttttaacattaaggtgtcaagtcctgcctggaggaggggcacttagggtcagtaggatcaggtggagaggcttttcttctaaagtcctagtgcttagcagaggaatgagagagaccattcagtcccactatcacattgtacacctgtagttgcagcactgtgggaggccaaggtaggcagattgcttgaggacaggagtttgagaccagcctggtaaaatcctgttgctacttaaaaaaaaaattacacgctgtagtcctacgtttacttcataaaaactaatgtagaaatgcaaaattaattttccttaaataaaatttctgcattactctctatattactttgtctcttttattttcaatggctgaaaaaaatagttttgttttaatttttattatttgatccatccttaattaccaggcattgatcagtggtttgaattgccctccctggctttccattttaatctaaaattctgctataagtctatgaaattggaccagaacacaagctgtgccatcagtgatactgataacgagattctagagaaaggtgcttctttggctggaggagtttaggccgatcacatttcagtgaccccggagaacattagacagcacctattgccacaaagcaagcagccagctgtgggtagaacagcaaaggcagtcggatgctcatcgcctgtattgccctgggaccagcagaccaaataaatgtaaactggactcttgcaactgtttgtttgaagatttgaaaggagttagtttatatttattttcataactgctttatttctgtcagtatttaatgtttgccaaaaaaggaaacacaggtttcccacactgtctccccatcaagtatcacaaatttgtgtgtcaagtaccagaatttgagaaagataattaagatggtttaaggtcatctcacagatagaacctcagtctatccaagttttctcctccagggtcaacccactgtattagcttcctggtagtgctgtgttaattaacaaactccgtggcttaaagcagcagaaacttaactgtctgacacctcagaaggctagaagtccgaagtcaaggtgtgagcagggctgcactccctctcaaggctctagggaaggatccttcctgcctcttttcagctgctggtagttgccggccacccttagctttccttggcttgtaccttcaactccccaatctctgtctccattttcacacgccctccctcgtcctgtgtgtctttgtctccaaatttccctctcctttctttggatttagggtccaaccttaatttagtatggcctcataataacttgattacatctgcaaagaccctatttccaactaaggtcctattcccacgttttaggtgaacatgaattttgtggggagagcactgtcaagccagtacacctccacccatactttcctactcccagctcagactgccactgttcaggttgccccaggagggccctgagctggggcgcggactcagtcagtcgtgtttggctggagtgttccatgaggttcagccagtcttgccagagccttgctcctcttccagcccctcaacccaattcctttctcctgtttcctttccttccacactaccacactgtcttacgtccaggatataggttagtcactcaattccataagccggatcctgtggtgcaaattccataagtggcgatccctgatattagctttgagttggtgccgggtccctagtaaattaggactgaagatctgcacacagccaagggccctctccctagcagcaagcaccttttcaaaagagcagaattcatttggaaggcctagaaaaaggaaggaggtgctctgccaaaatcaatgatgtctgagaaagaagcatgctccctagagcttggagaagatcagaagagggatagcctgaggcatggctctgcagtaaatcattaagagacgcccactcacagtggctgtggctaccagaggtttcctgtgagggaactaaaaagcgcacagtagtgtttgtaagtgatggttccattttaatagataaacatacagaacttataaaaaatcaagaatctatattagccagatttcctaaattagttaatatttcttttaaatttatacttaaagtcacagtttttaaaactatatatatgaatgtgaatactatatgctttggggaatttgactttggttattttctagtgtcaaggataaacacagccagacagtagttaaagcgatcagcacagattttcttccataatatactattgcaatagagaaaagagaccaatgtgaaactgggctcaacatcaattatcccagaggtgactgggcattttaaagggaaattcagggagtagggaggggtcagcaggggctcagcagagttggggaagtgaaaattgcagaaagcaggaagagggtttggtcagtgtgaagccatctgggtttcactggtgctgatagaagtcaggctcctgcccttccacagaggcttgtctgcaggagtggctggaaccaacaatcagttattttggcagccttgagttttcgtaggcaagtactttaagggggctagagtcatgtagcggtgtgaccttgagctgttgaacttgttcaagtctttataggccagtgtgggggccttgtggagaaaaagactcagagcagcctgagtagagtctggtccaggagacacttttgtcactgagcatgaccaatccatttatcacaatggtagcagcgtgtcctcatggaattatgtttccttcgataaatcttgaacaagaaataaatgcatcagcatatgtttttaaaagttaaacagatgttaaacttaaaggaagtttgctaaaatccatttcgtggacccctttgtaaatacctgacctacacagcttaccccttatgatttaaagttaacttgcatccattttatggaatcccaggtgcctgtttgacctgcagacatctttctcccttcttggtcactctctcagggcatcagctcttcacacagcaacagcttcctgcatgtggcccctgactgtccattgatgaccgaaggctcgtggacttgccaagttgcccacgtaaaacccagggttcagagagcgagacaagtccttgcattgtgaagtgccaacaattctagtattccaaagctcagtgttgttcagaacatggtacccttgtgagatcacgtgtgacatttgtgaagaacctggaactgatgtttccttaggaagcctcgcaacagtaagtgctttcagctcgctcaaggaacttcaagtaggcaagaaataagaatggaaaccctgcattactccatcagatcttgaaagttttctcttggataaatgtgcctgtcaatcacatcgaatcttatcccctgcctccatgtgctataccacaacagcgacgtctgctggaccgtgtgtgctctctgggtacacattttccaggaggcagcatcttattagagagtaacaggtctgtcttgtgtaaaggagaatgctaaccgcttcatgagaaggctccccaccatgaactcggataaccggatgctatttttttaacttatttattttttaattgacaaatagaaatcgtatatagttatcacacacaacgtgttttgaagtatgtatacattgtggagtggctgcgtcaaggtaatgaacacatgcatcatctcactttctcatcatgttttgtggggagaacacttaaaatctagaatctgagtgattttcacatagccaaatgttatttttaatgacctttgccttaattgtccattcaatatcggtcatagatatttattgagggcccagcatgtgccagccaagcgtggcctcctaattggaaacacaaaccctgagaaactctgagcattgttgtgtagtgcaggggccatcctcacacccccacagccagcattcagcttgcttcataagccatggatggagtcaaaggaaaactagctcaccttcccactatgtatctgaaatcactttctattccatgctgcacacatgtactgcaaggaaaaggaatgattcctgcccccaccactgccttccattcctaagaacagagaggatggagtacgaggatgaggaaaacagacggcaggaaataagcagtttattcactggatgtctgcatggggtcttgggagtgcagaggttgtgactcattcttgagtggaagtttctaaccacatacatacaaccgcaataactgcagccagctgctggaggtgttgtggtgaatcccagcgggttacaagggtgtgagaagcctggtaaagtttccaggaagtgaaagcacatgagctatgtcttcacccgcaaagatgcaggtaacagctcagattctgagtcttaggaagaggatggaggccggagggtgacagggtttctctgtagtcctcaggaagtgaaactgcctcacaggaaataaagcaatatcaatcaggcagtttctttctgtgtatatttgaatattgtcaatgttttaaaaatcacgacgtatttctttttttttccttctttttttttttgttgttgttgttgttgagacagtctttctctgtcgagtgcagtggtgtgatctcggctgactgcaacctccgtctcttgagttccagtgattctcctgcctcagcctctcgagtagctgggattacaagcatgtgcctccacgcctggctaatttttgtgtttttagtagagatgggatttcaccatgttggtcaggctggtctgcaactcctgacctcaagtaatccgcccacctcggcctcccaaagtgctgagattgtaggcatgagccaccatgcccagccaaaccggacatatttctaaggaacgagaaagagcagccgtctgtccaccacctgccccccacaactgtcttgaaccgcatcccagacagcttggtgtcgtagctgacattgcctgtgtcggccctcctctcctgatttattttaatcctcatatgttctttcttcttctgggaattgttcttttctagcattctgtttttgttttaaggactcagtaacttatatgtcttcatgaatactaattattatcatgactgttgcttcctcgcccacttttctctggattgtcatttttttctggcagattcctgtcttctgcctgtttgagtcttcttccacaaacacctggcagtgtctgttctgctcattcacattcaagaacagagcacctgtgtgttcatttcctggggctgctgccacaagatactgaaaactcagcaacttctaataacagaagttgactgtctcccagttctggagactggaagtctgaaatcaaggtgtctcagggccacactccctctgtaggctctaggggaggatccttcctgcctttcccagctcctgggggctctaggcatccctgggcttgtggccacatcacttcagtctctgcctccgtttccacgtggcaaagtgagctcatctcaagatttttaacttaattacatctccaaagaccctttttctaaacaagacagaagtaccatgggtgaggacttctgtttgggggctaccgttcaacccactgctctcagtcacacaaagcttttgaagcataacacctgctgttcaggcagttgcaaaagtagcccctaagaaagacagcatgccaaagcaccttccccatggtggggtggggtgacgggccaggcacccttaggatgcccatgcaggaagtggaggctcagcagaatcccacaggtgtgtctggtcctgggatagcatcagcgtcttctcacaggtagccaggtggcatccatcagctgaccacatcgtctgccccagtggcacgggctgtcttccatgtctcacttcatagagctcttctagactgaggcccaggacatggttctcggcacacagcgttaatgacatgcacggccctctaagcggttccctctcccactttgcgttgtcaacccccggtaccccccacttgattctgttgctcactgcaggtcttaggtagtacagagaatgttcaggcttgtagggttctgatggccagatcacccaacaaaagaatgccacgaacacctgagaccgcgcggcagctgcctgtcttctgcctctttcctttgtttaatcctgtttaattgcacatccctgttctcacccaccttgggtctctaggatggaggaaagcaggagcgtttcttcccactcacagtgctgattctccacattccccagttcttcccctggagatgtgtcctgtgagctgattgtttggagcaacagatacctagatatctgtctctctgcccttcctgtaaacccacggaagcacaccaaattctaggagctgggaactggagttcatttatacacataattaaccagcttctccctagaacagaactccatttgcattttttcgtcttttacttctcagggaaagccactgagtgagacaaagtttgtgtgcactctttaaaagatgaaaaactttgtgaaggcatcaggcagttttgaatcaggtgattaggatcgttcattcctgatgatacactggagctatatctgatgataacgacactacctaacatttatctggggcttcctcacccatgtcattttccaggcattgttcttcttgtgaattaattccatgaggaacgttaatcattgctctttgacagatgacaaaattgaggcccaaagagggcgtataattgacggatgtcccgtaatctctgactgtggtcatagtcttgtcttggctttcatcttcataggagtcccaagcattttggagatctcagtatgttgtggtggtgtaaagcagtcgtccaaaaccgtttttgattcattctccatcaataagaatgttgagctgcattccagtctagacacattggtgtgtgtttgtttatctactccaccttagaaataattcacagcaatagaaatgcaagaaggataagctaaaataaaataatcggccgggtacagtggctcacatctctaagcccagggctttgagaggccgaggcaagaggattacttgaagcagaacttcaagactagcttagctaacatagggagaccctgtctctacaaaacataaaaaaatttaccaggcatggtgacatgcacctgtagtcccagctattcgggaggctgaggctggagaatcgttttgagcccaggaggtcaaggctgctatgattgtttgactctgctccagcctgggtcacagagcaagatcctgtctcaaaacaataataataaaataatctgtttaagtttttaaaattaatagcaccaaagtactttaagaaaatttttatacagtgtgttttacagagccatgtgtttaagtgtgctccattttttaaaatattggtttaaaattgtgtgatctagcaatttaaaaatcttgttttaaattcagattgttttgatactcagctttaatcactgtttatatccagacagaagttcatgattggctaattttttttttttttttttgagatggagtctggctctgtcacccaggctggagtgcagtggcgctatgtcggctcactgcaacctccacttcctaggttcaagcgattctcctgcctctgcctcccaagtaacgggttacaggacgcactgccacacgtgactgtctcttttttaaaaaaattagagccttttatctcatccatcagttaggttaaggtttaaattgaaatttagctaataaatatagtcctctgtgatactaatcagtggttgttgcaaactaatgaaatagtgtggcattttagtatttttaactaatggattcaagttctgtagaagctctttaggtggagtacttctacactgattgaatattgtttttatgcgtggaggtatgtgtatgtatgttcatgagatctgtcgttttcttgtctggcttttgtctggttttgggatcagggaagtgctgatgtaaaatgtaaaatgagttgagaggtgttccctccaatttcctgaaaagtctgtttagaattggcatcctttttttcttgggaagttggtaaatttaccagcaaggccatttgatcctagatgtgggaaggaggtttttaattacaaattcaattcctttcataggcagaaggctattcaggttatttgtgtcttcttgagggagttttatatctttcaaagaattatctcatttcatctaaatggtcaaatgtgttgccattaatcctataataattaagtttttatcattttatcgatgttagaatctgtagtgatgtctgtcccctctttccctgctaatgttagtacatttggatcttctttatttttttgatcagtttagctaggagtctactaatttaattgctcttctcaaacaactcgcttttgatttagttggttttctgtattctacttttatttcattgattttctctctcatgtttattatttccttccttttatttgttttgggtttaatttgctcttttccttcactttcttaaggtaaaagcttaaatcattgaacttctttctttcaggttttcaatgtggcaacttagatcacttatttgagaccttattatttaacatatcactcaatgccatcagttttcatcgaagcaatgttttagccacatcccagaaattttggtagtttttagttctctacaaaatattacctagtttccctttgtgatttcatctttgacccatgtcttacatagaagtgtaacatccaaatatttgtgattttccacattcctattattaatgtctattttaattctaccatcgttagataaggtattctgtatgattttaagtattttataatttttgagaatagttttatccttataataggatatttcttgttgaatgttccacgtgcacttaaaaataatgtggtttctgctgttgttgggagaagtattacataaacgtcaattaggtcaggttgcttgacagtggttctgaagtctgctgtgtccttacttcttttctgtctacttgttttatcaattactgatagaggagttttaaacttccttctacgtttgtgtttctccattcagttctattggtttttgctttatgcattctgaagctctgctatttgatgtttacacatttagaattatgtcttattgatgaactgatctatttgtcattatgaaatgtccctatttatccctgatgatagtcattcattgttctaaaggcttgtttgttattaatgtaagtaacctggctctcttttgagcaatagttatgtggtatgtagttttctatccttttatcttcaatctatctgtgtagttatatttaaagtaggtttctgtagacaacatgtagttgggtcttttgtttttcttttttattctgatagtgtctatcttaggtgtgtttataatacttataaagccgttacataaggtcatgatctgctaattccatctgtctctatcatttctgtgtctatttctcctgattgtgggtggtatttgcttctttgcagcatggtaatttttgattgaatgttagacactatgaattctacacccagtggagtgctagattttgcttgatttcatttgctttatttaactttgtcctggaactacattatgatctgtccatgccttccttttaaaaatctttagagggtcaggtgctccagatatctgttaccttatcctgaatgactgtaggtgttcggaaaaaatgagtctgttgattgttttgtgtaacaattgacaaagtagggacattaaatcatgacattattaaaataggcatgattatacaattatttaaaataattttaggccaggcgtggtagctcatgcctgtaatcccagtactttgagaggctgaggcaggcgaatcacctgaggtcaggagtttgagaccagcctggccaacatggtgaaaccccatctctactaaaaatacaaaaattagctgggcgtggtggcacatgcctgtagtcccagctactctggaggctgaggcaggagaatcgcttgaacctgggaggccgaggttgcagtgagccaagatcagccattgcactccagcctgggcaacagagtgagaccctgtctgaaaaataaaatgaaattttaggcaaaccgtcacaccttgtgtggatttagatgttcctgttgtgctagtcgcataagttaaaggtaggaaggactcctggtatttttgattctttctgataactagtcctctcatgattggctctatgatgacctccatggacctgtgtggtccctgtagttaatccgtgtggctaatgacagtgtgaggatgctcttttcatatggcacgttgctgttgatcagctgtgttcagcagctttcttttgtcccctgatcccttgttaagtagcgctgcagcagtccctcagccacagccttcttcagcatctggtggacgcctttgtgtaatttcctctccttagcagggtgaagaatgattgaagtgttttctgtagaatacagcatttttgcagaaaacaccaaaagcatagtccttgtgtatttactgctctggaaaaaaaagtatggttcagcgaggccctgctgaagggccttccccggtgccctggccagatcccaggtccagtcacctcctgggcctgctctctgcccttctccacgtttcataaggaggcccagcaggcaaagcagcagtgcctcccagtgcgctcttcttctgttcctttgggaaacgtatcgctcaaccgccaatagcttttttgattttttggtttgttttatttgagcagggatgttgtggagctgacaaccgcttttagacaatctgtcctaggtcagaaattcctcaaaaggagcagcctgagagtgtgctgccacacagctggagggactgtccctgcaagaaggtcttatggtggaggcctcgcccctcacctcagtccttccctcctcctccccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaaggtaagtgggtgccggtgacacgggccgtgttccacaaccatgttccaccaaataatatccatgtagtgtttgctaaatgtgaaaagttgtggtttgtgctgttgaaggccactttgcaatgctccctagaacttgggtatgtgggcagggagatggtctggttggaagattttgtgaggaatcgtggccgcacctaagtcaccaggccagggagactcagccagaatccactgggtctcagggacaatctgagaagcttacagtgccagaacaaggcctattcagacattttccagggaagcggcggttttaatgatgtggggcttaaaacagtcttattgtctaggtgcaggctttaaggtgagtattcactgcagttcagatgtaaatcactaaaactcacttcccctccccaactgcttatagagtgctcgttggttgctgcagtttttgcttgtgtagtgacgctgggtttttatcgccaagtttttggacttccatccatttctccattggaaagtggcagctggtgggcttgtatgccgtggcaccccctgtcccgcaccacggctgcttgaccatgcagggtatgcagtggagacggcccctggctccctcttcttgttaaataaggctcctcctcaggtgacctgggcagagcgtttagagagccgaccgcttgtggtggctgggcctggctccagattcctctgaccgttctgtgactgccaagatggagtccttggcctgaacgatctgcaggtacagattccagaatcacaggaagtcacccttgaaaggggggctcccgctggcgatgtaagtgtaagcagctggggagggcatccgtcggggagtctctgcaaatgcctgcttcccctgggttcctgcatgtgaggacttttgtggtttgtggggaagagcctttcagtgagaggtctttttcaggcctcacctctcattactaaccagtgacaccaatcacgagctcagggaaattactcagaaaccttcccaataaagcggagctaccggagtagtcttgaaagacctgttttttgttgttgttgttttgttttgttttgttttttgcccagggtgcaacttactaccttgagcctatagaggcagccggaacctgtgcctcagtacacaggcctctgattctctgaagctaagtgggcatccagcaattcagttcagttctgacactgactcctacggttagcccagaccccgaaggttaaggccccagtcccacaagacgcccattgcacgttccaggggccacctgtacttctgattggctacaaattgggggttcctgcaatcctctcttcaggtctaataatcccctaacatgactgacagagctcaggaaaacactttcatacacttgctgctttgttatgaaggataaaactcagggacagccaaatggaagcaaggcattggccaatgtatggcgggtggttgcaatgctcccctgccctctctgggcacctgaccctcccagcacctccatgtgctcaccaaactcaaagctccccaggccccttatgtagaggtttttatggagctttcttacgtaggtgtgagtgatgacatcactgacgattgctcattgaactcaatccaggccaaggtgccctccctggagatgagggggagggctgaaagttccagtcttgtttgtttgtttgtttgtttgttttgagatggagtctcgttctgttgcccaggttggagtgcagtggcatgatctcggctcactgcaacctccacctcccgggttcaagcgattctcctgcctcaccctcctgagtacctgggattacaggcgtgtgccatcacgcctggctaatttttctatttttagtagagacagggtctcatcatgttggccaggctggtcttgaactcctgacctcgtgatccacccgcctcagcctcccaaagtgctgggattacaggcgtgagccaccgtgcccagacctaatcttctaatcgcatatttggtctttctgatgtccagaccctgtcctaaagctatcctgggtccactagaggcatcttattaggttgaaaatggcttattaatgactcagaaattccaagtgttttaggagctccatgtcatgaactggggacaaaaaccaggtgtgtagtttttatgatgccatagctataaacagtcattgaaagacagtggggcattcttagcaacacacatacctgggctgattgaaatctcattcttgatttaagtctcattattgaattcaacttgactgcaattgcttaacgtgggacgtgcctgagacctcccagctagtaagtcagagagtcaaggctgagcctccaggtgcggctggaacagctcccagtgggaacatgtatctgcttcttatgtctggacatgtgtatgtctgcatgcttggcaccctgttacaaattcctctgcaacatgttcatttttccttagaatttcccccttgtggaagaattattccatagcttcaggctataaagccttcttcccagaaacaccatttttgttgttgttgtttaacctgagttattgttcactagaaaagtgaaggtgctgcactccataaccatgtcccagaagcgatcagagtatgttggcacttgcattcagttctgtatttacaaactgataaagacaaggtgaaatatttgccttgttaacatgagctgttcctatagctaaggcaattaaacggaatttcaagtacaggcagtccttgttttgcaaggtactctgttaatggaaacatggtgtttcatgtggggttttttggttttggttttgttttccttttgtttttcagatagggtcccctttgttgtccaggccataggcggtggtagcacaatcgtagttcactgcaacctccatttcctgggcgtcagcaatccttctgcctctgcctcccaagtagctgggaccataggcacacaccaccatgcgcagccgggtgtggcagctcacacctgtaatcccagcactttgggatgctgaggcaggaggatgcttgagcccagtagcttgagaccagccaggtcaacatagccagaccctgtctccacaaaaaattagccatgttttaaaatgtatatggaagcaaagtgtatgtggaaaccacatgctgccattgcatgggaccagttatggtgaaacccacagagcaagggccctcatgaggaggaatttctctcacaaggtaccctgcaaagaggcccatggaatgaattgtgttttaacatcttggtgttctcattgacaatgtttgttttagacttgtcaaagaaaaatgagcagttgcattttttaaaagtcatttagcttttagaaagttctaaacattttccttattattaatctacatttacttacagatatatttctcttgcagaaatgaaatgtttcctctcatgcttcttacttagagacagtgacacattgtgggtcttcctcctgtgatgtgcatattgtaatactaaaggaagtttttcccaagctcctgtcagggaagcagccctggttttgtacttggcatttgtgtcaggaatacaggaggcagtggccaggggccgtgtggacgatcttggagctcttcagtcaggccctgctgctgcttcttgcccgcagtgtgggtgtgagctcacaggagcagcatgcctccagagttcaagggcattccattaaatcatcagtcactgaagagacttctgaatctcttagggaattgccttagggaattgatcatgccataggtgtcaccaggttaattaggcatagtagtagtagtagtcataggaaagtagtcaaaaacaagtaggatcaaagggttattaattatgttaaatattaattcccatcttactaggagaaagtgtccaacagagctgacattaaagaatcaagttttcactgagaatattttctaagttattcatgtatcattattttgttctaaaaaatatcaagcaaacataaggccaccttcagaagccccccagaaaccaccttcaggataatgagcacccatcgagtgaaagcacccgcccactgtgtgccaggcagggtgcgacatctgccaacacatcccctgaaggccagagacccagtgggtagagggcctccatgtgccgaacgccaggtcctgagacttgcgagtgtgagcacactcattgcttggtggggacttgagcgaccaagctgggaggcaccccagggctctctgttcccagccacaaaaatgccatcattgttgtgaaacaaaaatgatggcattgcttacatatcacttctagggttgatatttattacaagtaaaaccagaaatcggaaatcagttttgttttttttttttttttttgagacacagtcttgctctgttgcataggctggagtgcagtggcacgatctcggctcactgcaacctctgtctcctgggttcaagtgattctcctgtctcagcctcccaagtagctgggattacaggcacacgccaccacgcccggctaatttttttatttttagtagagatggggtttcaccatgttggccaggctggtcttgaattcctgacttcaggtgatctgcccacctcggcctcccaaagtgctgggattacaggagtgagccactgttccggctggaaatcaattttttacagcctagccatcactactttgcgtgttttagttttcttgtacttgttagtgttgttttaggagctgaatttcaggttttaaaaaaattatttttgtttttgtttttctgttctattttcaagaaagttatacatgttaaactgcataaacagatagagtagactcattttgccagcctaagttttgtgtatattcggtatctgtctttttttgtataataccagggttgaagttgtgagataatattcacaattaataaacaagggacgtggtagattctactctttttcgtggaaacctgcatatttcttaatgaataagggctaagtccacataaataggtagactgggctcatttcaaccagcctttagacatttctactcatagcccaaactattatgctatcaccttgttaagaatacagtcttacaggtggtggttcatgcctgtaatcccagcactttgggagtccaaggtgggaggatcacttgagctcaggagttaaagactagcctgggaaacatagtgaaaccgtgtctctacaaaatataataatgatgatgatgataaatttgccaggtgtggtggcgcctgcctgtagtctcagctacttaggaggctgaggtgggagaatcacctgagcctaggaggtggaagtttcagtgagccgagatcatgccactgccctccagcctgggtgacagagcaagactctgtctcaaaggaaaaaaaaaaaatagagagtacattctgggtggtgacttagggatacaggtgttctgtgaaattctttcaactctgctgtacgctggaccatctctacagtgcaatgttgggggaggcagctctgcctagtgtgacagtcagaccaaaagttcactcaggcacaaattagagcatcataggggaactggggatggcacagggcctgagataaatgctcagcgtttttacagagaagaacagagggtgggattagtgctgaacagaacaagtccaacaggagtgcagccaacacagaatcaatcgtgaggactttggaaaccaagcagaaaagtttacacatggtacaataggcatttgagctcactggaaattcttagaaggacacattggccatgtctgtgttttagagctcagtggagtactgggtgacagattagaaataggcagtaagggaggaggaagtgccaggtgtgattccaatgtgatttccttcagggaacttatagttcaattagaaaaaaataagtaatgtcaaaagttataggaggcttaggagaaagtgaaattaagaaaactgtcgctgggcatatattcatatcaacttgtaccaaatttgaagaactttttgcatctctgtgactctttcctagatttaaaaaaactgaaaaaaagatgtagctagttaaaaatacatgtatttttctaatacctgtaactgcatgtgacatttacacaaagtttcatcttaacttatccttatcgtacattgcatatgtcccaaaagaatgcagacaggagcaggcaggctgtcagtgtgagctgacctctgtaactggaacttcttttcctccgagaataatagagaacaaatagctgtatactacttatgtccaatttaaagttaatatttgggccaggcgtgatggctcacgcctgtaatcccagcactttgggaggccaaggtgggtggattacttgaggtcaggagtttgagacctgcctggccaacatggtgaaacctcatctctactaaaaatacaaaaatcagctaagtatggtggtgcacacctgtaatcccagctactcgggaggctgaggcaggagaatcgcctgaacccgggaggcagaggtgcagtgagccgagattgtgccattgcactccagcctgggtgacagagcaagactccttctccaaaaaaaaaaaaagttaatatttggtgaccagctgagctttgctggacctctggttttggggagattagatgttcttgaatcagcttcttaccctgcaacactgagttacgggcacagccacactggagctgctccagagggtgaggaccgtcacctgccattgtttgccaccctctgtgggcctcaggaccccacagcctgggtcctcattgctccagcctcaaggccacctcctcctgtcacccatcatcgctgaacaaaataggcatgcctctgctcacttgtccttggtattatttcatttccctttctcccttctttcgttatttaaaaaaccgtaataacaaggaccttcacggttactgtccttacacttcttttctttcattgaacttgcctttgggcttggtgtcccttctgaatttcctggcacgagggcacttgcttaaaccaaatttcactgtcagaggaaatgtgtttcctctaccctcttaggtgcagtgattgggggcctgtaaatcagactaacaaaagacagactatcaagagtaaagatagatttgtatttacatacaacgaaggagttcacagaaaaatgtgactcaaggaggcagttagaatttcggatttgtatgtcatcttaacatggatgggagagaggcagaaggacacacagaagaataaacttttaggaaaacttttaggaaaactaagtgggccgttaggagactagatggtggataagatagttttataacaacatcttttggggcgatttctcatctaggtgtgacaggtgctgacttcttatctttggtgataagactcacacttccctggttgtgaaactcctgagcattggatgtatgagggctgagggctgaattcttctggaaggctttccttagaaagggaagggagtgcagaagccttctgttcctgtacttgatgcttactgtcttcagctctaataaccctcatgccactgtggcatgttcctcagtccatggaggccccatctgcttctccccaacaccccatcattactcccctgcccccttctctgaatgcccagcacccagcactaataagaggccctctgcctgccgagcgcacgtggcatccttgtttctaaacaaccctgaggtgcccggcccctggttctcaggtcctgcctttatccagcccgagtagccttacgtccgtgtccagaacactagccttggggcatcttgctctcccagatgacctcggtgtccctcagtcttgttcccacattagctgccaggtgccacaatccctgtttctgactgcatcctcgcctcctcacctcgcctcggggggcatttcatcctggcatctgccgctcctgactgctgaaaccacagacatccgtttcccacgctcctctgcaacgtctccctctgctggctgcaccatgcccatccgccctcatccactgctcccactgtttctctctgcacttcctctcacccaggaactcggttcagcaatccccaaatgtcagcatctgtgtgtgtgcaggtgttgttttggtgttcatctcactctgtcccatccccctgggtgatcttatctgctacttgttgtcactgtgcctgactcaaatcttggtttctggacatgggtagagtcctgggcccagtggtctggaaaggggccttgggaaaatcttatgtaaaagttcagccaggccacacttactaggagtctcaatagaggttctcctaccttaaatctactcttggggaccctgctgcttgtctgagccccaggctcatgaatctgcactgcctggaagtcatgagcacctctgaaaacacggccaacactccattttcccacattttccttcagcctgctcctgtccctccaggcaccctggagtccctcagccaaccttgaagcttctcattgcacgaggattctctctcctcacatgccgtctgcagccagcaacctcctttatccatccacttcttaggccctctcttctgaaaacctcccttgtcctcatttgtacgtttcttcccttcctgaattgaggctgtaggtagcagctgctatgttgacttcaaggtctcattcccagcctgagaacacagactcctcccctgtccccacacccaaatcagaggctatcaatgcacgatatacggaagcagaagccaatagacacagaatccagtcactgattctgtaggtaaagaaacagattcacaccaagggactcaattcccctctgtaagcttttattgaacctttcgtgtacgtgccattttatcagattgcaagatgccaggaataccgagtgatttaggagcacacactgtcatttagttttaataatagccaatgtcatttcttattagaatttagtagttatttcttgctctttgattttcagttcttataaactttggcaaagaaaccctacattcccagctatagtgtggccttctatattagtctgttttcacgcttctaataaagacatacccaaaactgggtaatttatacaggaaagaggtttaacggactcacagttccacatgactggggaggcctcacaatcatggcggaaggcaaggagcagcaagtcatgtcttacatggatggcagtgggcaaaaagagagcttatgcagggaatctctcccttacaaaaccatcacatctcatgagacttactcactatcacgagaacagcatgagaaagacctacccccctgattcaattaccttccaccgagtccctcccataacatgtgggaattgtgggagctacaattcaagatgagatttgggtagggacacagccaaaccatatcaccttctttttcttttcccgtggtgttccccacaaatagagaaggcattcctcttctgtactgttatttcacaaaccctgactgacacttagtctcgtgatccttgtctccatctcctgccactacagctgcagtgatgtcaatggggaggctgtctttttcaccttcaggctctccctctccccttgggtacatcatcagctttgataggaggtggagctgtgctttggccaggtcacagctcagtaagtgttctggcttcttggcagacccacagccacctgcgttcctccagactggtttccagggcttacagtcagcggcagaatctgtcctcctttgatggagagctgctcgtcattcttggggaacttggggcactgcagtgttgatttctagttcacagccctgcagagacctcgacacaggttgcatgcacacgggcccctgtactgttctgcagaattacgccagagctgagccattcctggggcatgagggtctctgggaaaacacaaattagaggcatgaggcccttctgcactctgtcaaatgcagagaagtgaagaaataatttcactaaatgctagagaaaaacagcaaatctcagaacagaatgaagttctgtcctctcataattactcttcatatgtcttgccttcagatatcttctttatgcttggctggagaaattccaggatggcactgtgccctgtgctttgtgtggagaaaatatgatggatgaatccctggtccactatttcccttttaaaggcagatacttgtatgacaatggaaaatgtaacaaaacttcatttaatcagcactgtgtgtgtgtgcgcatgcatgtgcgcacacgtgtgtgtgtttatgtgtgtgtgattgatatgtgttatggaaaaagctcatgtctctggaaatactttccagcaaaaaacatctaatagcttaatctttatagcagtgctggttttggccctttaacttccccgaagttgtaaaccaaaaaattgcagtctccatatatgttttattgcatcctctaaaacaggagtccccaatcccctggccatggaccagtactccatggcccgttaggaagcagggcgcacagcaggaagtgagcggcgagtgagccagcattaccacctgagctccgcctcctgtctgatcagaggccacattagattctcacaggagcctgaaccctagtgtgaactgtacatgcaggggatctgagttgtgtgctccgtatgagaatctaatgcctgatgatctgaggtggaacagtttcatcccaaaaccagcccctttcaccccccacctatctaggaaaaattgtcctctacgaaaccggttcctggtgccaaaatgctggggaccactgctctaaaacatgtatttttttatttctggactgtcactcaaatgcctcaaaaaaatccatgcctcgtagttccttgaaacactttttaaaagaactagtagccactattagtacaaatgccactaccctactcggggcatttcattaggttggctggtgaccagctgtgcattttttgtaatgatactgtgttcactgagtctttttgatagcaaggtttcagacaactagccagtaaaaatacaatctagtcactattcccccatacactagtgcatcaagttcgttggtcctgcattaccagttatcttttacaattgtgtcaattttcaaaatatcttttagcttttaactagtaattattactaataattattggatgttttgggctaaaaccttgctaaatgtttagcatctcatttaatgtagtaccacagattattggcaaatttgggcattgtttctcttcactgcgattggaggagaatggtgtattgaatacagagaacacgtgacccataagtagcactagtgctgtttgtatgtatggctccccaccttgcattgcataacattgctgtagttgaggaatccgctttttaaaagtgtttggcctgggctaatttgcaataaagcccgtgaactctcccacccctggacatgttgtaccttccttgtaccttcctcacccgatctggcctccacaatgcttgtgtacacattctcggacttgccctcacccaaactagaatagggagaataaccagtgaattcagcctcgttatgtttggggatttatgcgaggatcaaggtggcatttcagattgttgtgaaacagatggatcagtcaggaaataataccggggtagatgtcttgccagtggagagggggacataaaccccaaggctctggcttacttccaacactaaggtgaatcctactccaatcaaatattaacatgtaaaactcgaaccaagtctccttctggtgataggacctaagcaagctgcgctaactctccccttaagaacagtgagaaaaactggacaaaaactcgaaagcatctttttgaagggatctgattacccagcaggtagggaacggtgggaccctttacccctagagctgtccccagaagaagtggctaatgagaatgagaagcccgagtttgttttttgttttttgttttttctttttttggtttgggggcaggggggctgaggtgggagaatcacttgaacccaggaggaggaggttgcagtgagctgagatcacgtctcttatatagaacctagtttgaaaaggaagggatattttaagtcttttaagataatgttaactatttttctttctttagctctatttctgtgtgtagctgttttactacaccagaattcagcaagtgatagtttcttaagagttagttgctatgtggaaattgaagccctatcagtaaccttttcctcctcgtgtatcttcaaatctattaccgagccttaaactttgaatggatcttgtatccctagcttattcaagggttaagaaaatacgttttctgtagaaaagaagacatgttctgtggctcatccagagtattatttgagctgcatgtctatagtttaatcacatactgttggaggtcttcctgggagatgctggaggcccaggagtcaaggggctctgtgtgccgttctccaaacacagctctctagaaagaaggttccagcatgactcaggagaggttggtgcaaactgggaccctctgggcacctctcagggacacagactgtccagctggttacggaagcacatctcccacctgatttattcctaaataggagcgaggagggggacaatctttcccttcacccccacatcttcctttcctcttccctacctccctgtattaatactgagaaaccacacctgaacaatgaaatgactaggaactacggtttctggttgtgttcccaagtgggaatatgggctgttcacgacctcggaatgtagaatgccctcattatttattcagtagacatccaataaatgcggatcaacagcttgcctatctttgatagtttttggcagtgtgtgctggttttaatctttgtacttgtcccataagtgaccccatgactagagagtgggctcttccatcttgtaagagccttctgttcacgttctgttctttttatgagaaggaagttccagtgcatatcccaacataaagagaaacgttgaatacgtactgtttttctcttatatatatgctcaaaataacgactgtagtaaacagtcgtcatgattataggatgaattacgcagccattcatagatttttgtagttgtcatttacaagtggactatgcaatagttcataggcttatgaatacataatctaacaatattagctgggtgcagtggctcacacctgaaatcccagcacttagcgaggccaaggtagcttgattgctagagcccaggagttcaagactagcccgggcaaagggcaaaaccccatctctacaaaaactacaaaaagaaattagccgggcatggtggtgcttcccggtagtcccagctacttgggaggcaaaggtgggaaggtcacctgagcctgggggtgtcaaggctgcagtgagctgtgattgcaccactgcacccgagcctgggcgacagagtgagaccctgtctcaaaaacaaacaaacaatattatacttgtagtatttaaaaaacataattatctggtattcccatagctaatagaatgaaaggggagactttatctccctagacaggaagcacggtacctcctacactctcttctccccacatcaactggataggtgtgtgaacgcatttcaaagtcaagtatggttagtaattacttgatctttttccagccccttcagataagctgaattgaacacccaaaagtgatagtaacatcattttcctttgcaattacaaagaccattaacccaacagaatctccatgctttacctgtttgtgatgtttttgttccattttattaagtatgactcctgataaatgaatcactacacaattaattttttctcattctttagattcatacacacagacacatatatcaagcaaactataaattgctaaaatgacaggccagcagtgactacttgttatcacgtgtgtaacatctcttgagggctgctttgtaattcatttgtatggtgttgttgtaccagtgtaactgctaagtggtttctctggttccatgtgcatttgtacatgaagttgtgcaatctccacataccagcagtttcaaagaatgacagtttgcatgaggccatcttaatagcaggtagcatgtaaccaacccatctgaattaagccaccattgcagaataaaacatttgacactaagccaggtatttcagtggatgagttgtattttggatttccaaaaaaaaaaaaaaaaaaaaaaattaagcagtcatgctctcgaataatcttactagacataaacaatactgctagggtaggggggcactgcctttaacaatggtcagagtttcttggtaaatcagtggttttgcttctttgatgtttctaaaacactgatatgcccagttgccctgctctgacctcatctcaccctccccagcttccctccccacccacctcgtaaagcacagacctctcagcctgaccccttgctccctacctcactcattacttctggtttccttttggggccttgtcttctgcctgcccccagtacaatgtttatttttctgcatgtccatctcatcctgacaagcctctccacactggagtgcagccagtagctgtctctgctaagctcttccctctgcctgcatttctcaccccacacacaccttccatttcccagtggctacatacatcatgtgcgattatgcctgtctttcatgacctgcctctgaccagaaatccctgagtcatcttccctaaacccactccttcaaatccaccttccaaatcctggtgaatggactgctgtccctgctccagaggactgtgtgcctcaaacagggctccccacagtgggcctgtattagcagggattccccagtgcatgtttcctgccttggagaccatgaactccagggaggctggagagctgtctgctctgctttctgtcttctgcctgcccaagacagtactttatgtaggtgttaatttcctaaaaatatgtctaacatgcttgaattgctgatagctattgattaaagcccagcttctaatataaatatgcatttctgatgaatctcacaaaaaaacaggaagaaacaaatgccattaatttgcagtttatcaatatcctggctagtaattgagatatttagtggcatagtcactagaatataaggtgctagtcccagtcccaacacgagcttgagtaattttaaacttcatagtgaattttttgtaacgtctacagaatggatcaccattatcataataatagctgatagcgacggagcatgtcccatctgccaagcactggatatcattgattcattcatttataaaatttgaagttggtgggagggcatatttaaagactgctacctggaatagtgttatttgtcagagattcatttgtttgttctccacattcttcaatatatgaattattccatgcaattgaacagctccccaagtacgtcatagttatgaaatgttgtgtgttgactttggaaggttacagttcatttgtgatcttccaggcagcgggggtgggggtggggggattcttctctgtagtgaaagtgtttttctctgaaatcttcagctactttcctactctgtgaagccttcttctcctgggtcagtgggacccttccttgagagtggtttcagtaggttctccaaaaactgttcaactgagtaaaattgaatagaatagtccatgcattttgtcccaaggtataaaaattggctttggggaggtgaaaatgaaaccttacttttttttaatgtatcaagcaccaatacacatacagaaaaatatagtgtatctgtgttattataacatgttatggggatagactgttggggaaaaataactggaaaagcttttttgggggtgatcatgaatgaaatggttgagaaacactgagttagtcatacacagtatcagacaagtactgtgtcagtagccccagtaatttccaccctcaggccaggccccacatccagcacattctcgctcttctctagcccccacagccaggtcagtcttctagcccaggctccatcagcatctcaggttagagaaaggaaggcaagatgccttccacctctgttttccaggattgagaatatgctcacgcccctctctatctaaaggaaaggagagagggatggaccaggccctgtgttgccctcacaggtgccctgggcgccattttgtcatgagtggtcagcagagcccattgccgaggggcctagggagggtgccctcacagagctggtcccttcagttctgaattaagcagtagcctcaatgccatgtaagcaaccattcctgcaagaggataggcatttaaggtgaaatctgcctcatctgtcgttatttacaggtaagattcagaatagttcaagaaaacaaggcaaatgaattgcatttgcattgacgtgagtcatgccacattcagctactctttgtgaaaacgtccccaaaatagattcctcggagtgctgctttgcgggaccttcatcgatttgctctgaagataggtgtccatgcctgagaggcctcagtgaggtttcaactacacagttatccatggcagcacttctggaaacatttctgtgctaattgtacatggcaggtccccagttcctcatttaatgggaggaatctcctttttctggaaaatttctctggactgctgtgtcacagaacattctagaaaccccttacctcatgaacattctactactagacaatttagaattgaacgttaatatgggcatgggaggccagtgaaaacaacataagcctcacctggtactgcaacacatctttgtttgggaaacactgactttgcaaccacagctataaacaccggcttttatttcaggagtcagcagttactatatttgcaggaaggagaactgagggcatccctgtgaaaaccagaaaataaatccatcctgaagggcattggctttgtaggcctctcatcccctgttgagtaggttgctgggccatgcacaacgggtgtcagtatggaaaggaccaaggagaggaccgaagagaggcctctgcattgccagctgccacgtgctcaccacacagacagctcattggctcatccaccagctcatttaatcacgaagtcttttaatcccctccaggtccaatgaattccttaggcttttttctctgtgtttatcagttcccattataaatggcagcttcttctacatggcacatttggagatgacatggaaaaatcactcacacaggccagcaaaggcactctctttatgctgtgataatcctgtttggggaagccccctctgtagcttctctcaaaagcaggcaaacatcgctgtgcttttgctgtcctgacaatgtgtggagtcatattatacagcaagcataccacaagcaagtcacatctaaggcacctaaatgtggtttttccataacgaaagtgctgttgaaaataaacacaacttgctgctctacaggttagagcattttaatcccgtacatggctaatcttcccgagtctgtctgaagtcataatgtccctctaaacacacaaaaccgataggggcctcccgtcacacttgcggatcatgagtctcatgcagaaggctacgtaagatgaattgatttcacatgttttactcagaggatgtggaaaaagaaaatgattctagtgaccatctagaaacttgcggtttgtttttgactttaagacagtcagcacctttcagggccttgctgggttttcactggtttctgacagattggtggacgcggcatctgtaccattaaaagaggaaatcaggaaggttttttgagctgtcttgaagtcttttgctcaccacttaatttacatacatacactttaatatgcatgctaagagtgcccgtaatgtacttttattgagtaaaatgacacagagagaattcgttaggaagctttcctgcccaccccccaaccaagtcgttaaataactttttcaaaggctgttctctataggagaaggaatcaatttaggggtgtagttcattcatttacctagcttgtaactctaaagggttttgttataaacatgtttatatcaataatggttttatagtttgattttcagagcactatcgattcagtaaaacagtagctctgcggtgcacaagggatactgacctccacctcagcactattacttagaggaatgcagcaccatatgtagcttactagtaggtaggtggatgtttggatgaaggaagggagagcaggaggaagggagggatggatagattgataaatagggatggatggacagatggatggattgatgaataatataaacaaaagtactaattaataacaaaatacacacatacctcagcagtcattttgacagcagtacttaaaagtttcatgtttaaacaaacatctaatagtgtatatgtatccaacatgacaacattgtggtacttatttacagatcactgtctgacaaggaacatgaagtcaaacagaacttaaaccttagatatgagcactgccaatcaaaattaaaaacaaagtttaaggcccccttgaagttttgatgtctcaccatgtgaaaattgaacttcatattacaaaattaatgcataggaaaaaacctcctatgaaaaagcctggttttggtgatgagattcagatcatacatggctttataattgatgaatagttgtgagcagctgctgtactttctgtgcttccatgtaattccaggaccgcttctgggagccctgaaagtacccttcagtgacttccttccaaatgttgtatttcactaagcaaaagggaaagctttattccttagagatgatatagtaatatttggaaagctcactagttccaatgaagcacataatttaaaacagacacatcatagtttaaaaggtaaaatcggttacgaaatgtgatcccaagtaggcacgggcagcactctgcctgtggcctggaggaggtcccggtgtgcaggattggaaaggggctggctccttccctgctgtgactgttctgtctgcttcccgatgggacgtgctgttgatcccagctgctgagaagaaatggtgggcaagtgccacggggacaggatttgcagcagggaggagccaaaggtggaagcatcaccgggaagtgagacctggggaggaacacgagagcatcacaagccgcgggcccttctccttccctcttgaaaacctaacctagctcctgacactgcctcctactgtgttcccttcctgcccaaactgtacctagagctccatccatagacctcgtctgctcaccgcacagaaatgccagggctgccgggatcccttctcagcgctcctccttctgtgtaatcaactgcttctctgctctgatgacacctgaccgcacctccagctcacagccacagtgcatggagaccccgagccttctacttgggtgtcccacgatggcctcaaacccaacttgtcacaaaagctacctctccttcctgccaccaaaatggcggccccaagacccaccacatcagaaacatgagaatcagcttctccatcaggcttaacatcccaggtatcatccagttccctattgcttctcagtttttcctctaatcccatccatttttattcattgctcttgtgtttggactgtttccctcccccaattcagatgctgaaatcctcacccccagtgtaatgcgttagggggagaccagggagccagagaccacgctggctccctgatctcacaccgcctggccccagacctatgggaaatccctgtctggggtttaagccacccagtctgtggtattttcttacagtaacctgaagggactaagacaccctgctgctgtcagacaaagatactcttatgtgcaacttgctagttataaaatggaacttttaagctatatgatatttgtcttttaagaaattaaagtacaaggactttttaagtcccctggacagagaccatccccaggtcgctgctgcgcttcaacatcgttggagaagtcagttcatcacctccaagtgataagccgccaaggtgcttcacctcccttgtcgttggaaatgtcatgctccctaaattaaatccctcaagctacagtttaattaagctcatctcctcgcctggagatggaaatcagatatattttagccttcagctgggtagagtgaaaagaacattggattctgcagacctggattctattcaagagttctgtcttccgcctgactgcatgacctccagcttgcctctgaacttcccttgcactaagcagaggagatgctgcatttgctctgtctattccctagcgctgactttccatggcccctttgtggctctaagtcctgtacccaggacacctccaccatcttcactaatttagcagacgttcatcagtgctcacgatttgccatggcatcctgggaaggtgcgtgaaaactgggccctgcctagttacagccgatatgtaggctgtacaagctgcgtcaagaatattcttgaccagatacttccttgaagatgtggaagtcagccttagaaggtccactaaatacactacaaaatgatcacaaaattaattaaaatcatatagaatatgcatgcatacacacacatccatgtgcatgtcctgacacagagatgatatgtggggtgaaggagggagatttcagggtaggccgcaggcctgccgggagcatgtgcaggtggcagcgccatcccctggaccaaaccccagttctccggcttcactgaaggtgcaggagccctgctagaaaagagaagggagccgtgggcacttccaccttccctgtccctggccaccaccctcaaaggagcaacccaccaagtccgtgcagagaaaagtcagtctgcctccactccccacttgcagaggctgaagtcccttggcttagagagaaaagtttctttctacagatgcaaacatacgaatccatgattcactgtatgggtggtggtatgaatgagttttaggtcaagtgtaattggtcagtcatggtgggacaggaagggctgccccctaagtgaaaacatgaggtgcttaaaaggaagcatgagagccaggtgcttaaaaggaagcatgagagccaggtgcttaaaaggaagcatgagagccaagttcagtcagggtgaacctcctttccctgtagctgggtgtggcagacggaaactgtgttgagatatttctgccttcgaagataagaaacatacttcttccttaattttatttgtgcaaaatataaactgtatttagcttatattcttctttctttttttgatgcttaagtcctgtgattaccagacacagttgttccaagatagcttttaaggatttattcttaaatccttaagtttcagtagacagacagccatgctgtgaacattctttaaatggttaggcttttagataccaggtacttttcttgtaggtgtggtcctatttacaagtgcattagatctttgggtgtaacgaagtctaaagacgacataaaaatcttttggggctgggcacggtgggtcacgcctgtaatcccagcactctgagaggccgagatgggtggatcagttgaggtcaagagttcaagaccagcctggccaacatggcgaaaccccatctctattaaaaatacaaaaaaaaattagccgagtgtggtggtgcatgcctgtaatcccagctactcgagaggctgaggcaggagaattgcttgaacccgggaggtggaggttgcagtgagctaagatcttgccattgcactccagcctgggtgacagagccagattatgtctcaaaaaacaacaaaaaaaaaagaaaataaataaaccttttgggacatttttaataggtgcttcaggacacagtagttgttctgctttataattctactgtttctaggggaaaaaaaccaaaccaacaaaacccaaacttccagatgctgtggcatgaccccgaatcatttcccacgtgcaggctgtgtgtgtggtgcagttgccatctgggcctagcaccagggggtttcttctcaggactcatgtttgatgtcttctctttgtcctgtgtctggggctttctttaaattttgtgtgcaaacaatgcctggtattacaggctgttttcctgtaaaccactcacttctgctccactcctgttctgttgagttttcctggcacgtttccatcatcgaccacctccagctgactattctatcagcttttgaaacttcaggttccgttttcaaattccatcttgatcaaatggaattctcgttagcggacatgaagtgtaagagtccggcaaatgtcggggaaaggtatctcctgacagctgttagcaaagcggccacatgagaggaggaagaagagggtttcaggtgccaggggtgtcatgtatcccattgctgtttgttttgggctgagatcacccatggctgtttacatcagaggctgtacttacttttgaccttttagaatagttaactttgcaagggtcttgtgctggaaaacccaagccaactggcctgtcttcctaggtttcccctcaatcatttgaacactgagggttttacttactcacatggacatatttcaaatggcccttctgttgcataagcttattatgtcaccttctctctttttttcttttttttttttgagacggagtctcactctgtggcccagtctggaatgcagtggcacgatcttgactcactgcaacctctacctcctgggttcaagccattctcctgccttagcttccagagtagctgggaatacaggcatgcgccaccatgcttggctaattttttaattttttggtagcgatgtgattttaccatgttggccaggctggtctggaactcctgacctcaagtgatccgcgtacctcggcctcccaaaatacaggtgtgagccactgcgcccagcctacgtcaccttcttattgtgattgattgtgatagcaaccagttaccaaccttgacttttcgccactcttcatgcttattcgagtcccccttactttatgtacgacatttgtcttacatgttgtgtgtagtattccagatgtcagtgccattttggattattcttaaaaataggtgaggacagattaattgaacacagaggaaccagcaaaacgtgaaagccatgagaaacagtaaaaaggtctccaagagctggtgtcagctgctcctgctgtcagtgccgcagacacttgcaagtttccctcctcactcacagccctcacttagttgcctttaaacaggggctgcctttgaaaagatttctcaggtgtgaagggacaccatggggcctgcatttccctccactgcagaccccctgtattagtccattttcacactgctgataaagacatacccaagactgggtaaattacaaagaaaaagaggtttaatggactcacagttccacatgaatgaggaggcctcacaatcatggcagaaggtgaaaggtatgtcttgcatggcagcaggcaagagagagaataagagccaagcgaaaggggtttccccttataaaaccatcagatcttgtgagacttattcactaccatgagaatagtatggggaaaactgcccccatgattcaattgtctcccaccaggtccctcccacaacacgtggggattctgggagctacatttcaagatgagatttgagtagggacacagcaaaactgtatgaccccctttaggtgagtgcaggtgtattgggtgccttccattatctctttgggaacagccacagtcagctactgatttcccgtcccacacacctgtcttgctccttggaagcagcctcacgcaaatagagaataaaagctgctttcacaacttagccaagcagtgttaccccaggggataatccatctcttcctctaccccagtccacatttcacaggtggaccctgcacaaagcttcagaatccccggagaaggtgacggatattttgaaatgtcatttgacatttaagtgcctatctctggtcccagataaaaacagtggagggcatttagaatacaatcaagtcataacttttaaaaaggcaagggcagaaatatcatgaacaggtagtcactgaatgagataacagagaaaaccaacttggacagtctaagtggagtcatttcttctcgcgtcctacggtgaccagtgtctcacaggagaaagaaaccagggggcatcagaggctgttggaagggaggtgttgggacggactactgtggcttgcctgggactgtccagggtgtagcacggaacatcctgccccacagctgacccttcagttccaagcaaaccgaaacagctgggccaaccaagttccctctgtgaaagtaaggtagcattcacattccattgtcacatggattaactcacttaatccagggttcagccctgttgggataagttggctaatatgatattttagccccagattgaaggaaagaatggggtaatggaaagaaaaagggagggagggaaaaagaaaaaagtcattgtgctggctacagcacagaccactagtagttaagactgtgtgtgtgtttcagtgttttctactgaaaacgccaaagaatgcagagcttctctttcagacctggcatcaggcttccgtgagccctttccaggacaccagtgcattgagtcgctgctatatacctggtgatgagccgaagaggacattttcataatgaaaggcaaagggggccaggtgtggtggcacacacctgtaatcccagcactttgggaggccgaggcgggcagatcacttgagtccaggagttggagaccagcctggccaacatggtgaaaccctgtctctactgaaaaatacaaaaaaaaattagccggcttggtgatgcatgcctgtagtcccagctgcttgggaggctgaggcatgagaattgcttgagcctgggaggtagaggctgcagtgagccaagatcgcaccactgcacttcagcctgggtgagagagcaagactctgtctcaccaaaaaaaaaaaaagaaaatgcagagggacaaaggagacaaagaagagatgagtggagagctgaaaggccccacctcaacaactcctggagttctaggccacatgtggagaagagcaggggagactcctcagcataggtcgccatggcgaggacctctcttcccttacagatgtctgggcctctgcagagtctcagttaaaaagcatcagtacatctgttttcacatgaagtgtgtgccattctaggaatgcagggaagaagcttccttcctaagtgtatgtcttcctgagagggtcggtgatatgaagatagcacatgtggattatgcttgtttatactatggagcaggctctggggtgtctcctttggagggagccctcatgtgaaacttactgtaacattgtcaatgtggtggcacctttaggagctcactgataaatgcagtgtacaaacaccccattttatgtattggtttttcttttagtactttatttttttcctttttaattttaatttttattttaatagtctgtagggtacaggtggcttttggttacatggataagttctttagcagtgatttctgagattttagcacacacgtcaaccgaacagtgtgcactgtacccagtatgtagtcttttcttcctcaccccgctagtccccaaaatgcattatatagaattcttatggcttcccatcctcatagcttagattccacttataagtgagagcatacgatatttggatttccattcctgagttacttagaataatggcctccagctccatccatgttgctgcagaagacattatttcattcctttttatgtctgagtagtattccatggtgtatatatgcctcattttctttatccgctcattggtggatgggcacttaggttggttccatatctttgcagttgccagtaggaaacaccccattttcaatgtgggtatctgaatgaagagaccacgggttttggatggtgttgtgtctgtaatcccaataataaagtggattttcgcgattatccaaaagagagcatgcacgcacactacgttttcgtgctcatttgtcacgtcacactagcacacacaggaactgaatttttaacttaaaagattctaaccatttaattttcaaaccacagtacataaaacaggagcagctctgaagtggttttatattttaagagcatgatttttagttttgcaattgcctctcacactctgaatgttcaattattgattgaacagattgttatgatcccaataaaataataaagttttaagctgagaatcttgcctcaccacacagctgcgctccatttcaacaatgctttggctgcaacagaaacctctcccctttaaaggagccacggcggggagacccccggagccagtaagaaacagcatgctgtcctcaccacaatctctactctggggagcccccactgtaattctgtctctttctgcacagttgcagagccaatggtgacgacgataataaacacttcatccacatgtctggttccataaaaggccatctcgactttctttttcttcctacagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgtaacatttacctggtatctacatccttacctgcattggaaaatgtttgctacctcacaacaaccatttgcctcctttaagaacactgatgggctgcactttttggatagaaatagaatttgatttcagaatgtatgcttggtgagtctcagtgcccaggaacacttttggaataatttatcagacattgaacttctgtgattaatcgcttttatagatttactcagtctttaaaattcgtctctgatttgccagagaaaaacggtggtagccatggaaatcgggagtgaaggagcactgcttcattgtggctcagcccttcctaggggcctctgccctttgatgtccttgagctactcttcagctctggaagttgtggacaaaccgtaggaatgtatgtgtgcgtgtggtggagtgattgtctgtgaatgacaggccctggctattgattgatgttgcatcaatttagcaaattcatttcctcattcttgatggcctgaatatatgtctgcacttttaatgctcctcttaaccagttgtaacatcttaccatttccctaacaaattgaattagtttaataaaatcttttgacacatgt

SEQ ID NO: 5445 - DNA, 99270 bp, human; identical to SEQ ID NO: 5444

SEQ ID NO: 5446 - DNA, 98635 bp, human
acttcctcctcgcccccacccagacccagaaggcgccaccatggcggcgcccccgcagcccgtcacccacctcatctttgacatggacggacttcttctgggtgggtagtgtgcagccgccgcctccagtaagggcggtcttgtgtgggcgtggggacggtcggcgcggggtacgtcacggcctgggggccgcggcggggcggtgttcatgcagggacgctcgggctcccgcgcgctctgcccccggctggccccgaagtcgggcggcggccaggagcgcccgcgggcccatgtccgggctggcgggcgcgcgtggccgcggcgtctacgcggccccagcacccgcttccggtcggcggcccgcgcgtggggccggagcacgtgggagcagtccctggggtccaccgggcgggcgcgcggctccgcgtcctctcctcagagcgaggcgcggcgggacctccgcgctctcttttcggttacgcatgcgtgcgaccttgagcggtgcccagcctcagcttccccgtctgcaaagtagcctggaggatacttgcctgcctgctccaaggttgctgctgtgggcgcactttgatggtagcatcctgcatggtagcggttctctacctggcggttttgcagccctgagggcatctggcaatggcgatgtcaggagacattttggctgtcacagctggcgaggagtgatggggtcactggcatctagtggagtccagaccagtgatactgttaaacttcccgcagtgcacaggagtgccctatgcaaccataaggaattatcccgcgccgtcaacagtgtagaggcacagaaggtccgtcaagtggcctggctgcctagggtgaccagcaccggggacatcacctgtgggctacttgtaaatgtagaagctggggccccaccctacccctgcccaatcagaatctgcattttaagcgcgtgaacgtttgagaacagctgctctatcaatccgaggcattaagaaacccttggcagtgtactaaggtagtcagtcttagcacatgtgaacttcaccagccaagaggaattcaagtagaattcaaagaataaaaccctgtttttaactcaagacagaactatgctgagctctaccgaaagccttgacacagttaacactatgacacataatcaccaggaggcttcatatatctataaacatgtctgcatactctttgtagacagctgacctgcttggttacgtatatcattccttcatttcaaaaccctgcaagttaggaggaagtatttgcatgtcactaattaaaaaaaaaaaaaaaaaaaaaaccctgcagctcagagaggtaaagctacttgcccaaggtcacacagctaataagccaagctgagaaacgattctggattgatccagttctaaatataaatgatgttgagctcatcttaaattgtgaatgtgaccttgtttctgctcatcatattgctgggtaattccctagcagtgtttccttttaaaaaggcatgcagaaaccattctcttcattttatgaacacagaggtgtaaactgatgaattccaaaggaaaaaaaaaatccccgtagaggtcactaattggagccaacggtgtatgcagctactaaatttgaaatgactcaatttcagaaagcttgtgggatacataggtatagtttgtagacatgaattttcctactccggtggtcaaaaagttaaattgtcaaataaatttcttatcctctaataaaggtccagagaacctgttctgggagtctcatgaattttaataccaaacaagatgtctcattaaaattaaatttattaaacttctaaatgagcttggtgcctaattctgattctagattcacacatagccatgccctgaagtgatgaatgtgacttaaatggcattacaagcattgacctcacattgttacccaatcctctgatctagtcagataaccaagaattagtgctatttggaaaaataagccctgcttctttttattcccccccctcattttctgcccatttcctcctttcctgccctacctcttctttgaggtggtaaggccttgcaaaactttcttggaaatatacctttgtttatcccattctttcaccaaatgtgtaaatataaaacacagctttccaagatgtgccactttaatttaatctaccagattatgcctgctgtcattctttagcacctcacttcagtgtatctgttgtttgcataacaatatactatcaatttataatgagttattttacaataggtctgtttttcgggaattttgaatgcatttttctaggaagttctgtttgtctatgtagccccaatacttgcatacttggggaagtaaaattgaaaacgaatagtttcatggaggattgttaacattagaggagaagattgtttaatcagaggagaatgaggaagtaaatggagattttagaggaaatgttgaccaggaagaaagccaggacactttcccatgcttttgacatgcacgatgctgttagttgtcctttaaaaaaaaaaaaaaatacacttcggtttctgtttctcatgaccaaggtaagagtcagttatgatttaggtaatattaataattttggctctcaaatgccattcagagaaagagagtaggggagtgggattagttaaaaactgggatgattttgaaataagaagatgacaattattaaacagtatctcagcagctggacagggaagattattctgtttgtaaataactgaaattaggaacacaaaagatggtcccaatttctttaaaagagaagacagtttgttgtccagagcagttctgtctcatagaattgagccaggtaaaaattttggggagcaatttttaataagtaaaaagatacagatgacattgatttggatgatgtatgttatgtaacctaatgtatcaaaaatattatttaatacaaagtcagtataagaaaatctttgaagtgtttgacattaattttgatactaggtcctcaaaatctgtgtgtgttttatacatacaacacatcttagtttgaactagcctcatttcaggcactctgtagcctcatttggtgggtggctactggcttggacagcatgggtctaggtctttgtggagcaacccaagatgtctgttgataatggctatgctgggagggtcaggcagagggtgggtgttaagaatattcagaattaggagttttggtgtatgtaaaatgtggtatgtgtaaaatgtgttttcttggagtctaatacagaattatttaaaatccttttaaaatcaaaggaaaataagcttatttccagtttcttaaatatcgtaaaataataaggtagatctgcgaagggtaataagaacatttgcagtgttgaccataatataccatatctttataaatccagattgcaggattttaatgagtgacttctacttcacctttagtaaaatgaagacctcttctgtgcctttttgcactcccgtagcttcctccttgccaaataatagcacttgagactataagtgcctgcctcactgtctggggcccaggagaccctaaaaggtcatggaggtagggtctctgtggggattaccaagcccagtactgatgggattgtgggctgcctgagacagttgacagtcatgtccactgtgtggccaaaattccacagacatagcgtgagtgtgttttgcgctgtcattctttgttaacttcatgtaggctgtttctttagacaccagaacatctatatagctgatgacaaaaatagatttttcttacgtaatattagcgcatgccctaggtggattgtcagaagaatctatgtatgttgtcatttgaccccatgaaatacgtctgaggtttaaaagtgcagctgacaagcttttcagcctcagtcggttcttactacttgatgttatcaagtcattcattccaagtgggatttctaagagttttggcacatttctgaggaaggtggagcaaagtgaaggatcattctgcatgcttccataggtggttattgtttaaccccagaacgtgcagtgatcctagttggaatgagatcgtaatcacaatctcccctccttccatcatttgtaatgggtcttgctctggatgtcaaagcaactctggtggtaggttcacattctttctttgccctgtcttccctggaggctgacagtgtacccttgggttttacccttgctaggtgaaatgtaggttctcttccacgtttgcaaaggagatggctgagggtggaggccagtgtgagggcttgggacagagatgaacccttatctcaggggccatgattggcctttcactacagggtgatcaatgagtaatctgttgtttctggaaactgaaaaggcttctggaatatagaaagcacaagacacgtgtgttcctattaagggtccgaagagatttagagtaagatgctatattgtatgttggagaaacagcatcagattatagatttagctccgtttggttctgttttctaattgacctgaaccatgccaaccttaagttcttgtagtaagtggttggttgtccactgcagctgtttctgtttctagaataattgagaagggggtaaaacttaaattgcaaaattctgcagataaataataagagttttgtccagctggcaacacaaatattcagcagattctaggcatgcaggtgtaaaatatccttttcttttttctagctctctctttcaaataaaagcaatatggttttatttagaatctttaagtaaactggatacaggcatgtgtgagaactattgtgggttcagttccagaccatcacagtaaagcaaacatcgcaataaaattagtcacatgaagtttttggtttcccagtacacataaggttaggtttatactatactgtattctattaggtgtacaatagcattatgtctaaaaaatgtacataaccttaaatacattttattgctttaaaaaaaaaagtgctagggatcatgtcatccttcagtgagttgtaattcttttgctggtggaaggtgttgtcttgatattgactgttgaccagagtagtggttgctgaaggttggggtggctgtggcaattttaaaaaataaaacagcaatgaagtttgccacatcacttgattctttcttttacaaaaaaattctcttttggcgaggcatggtggctcatgcctataatcccagcactttgggaggcagaggcaggcagatcacttgaggtcaggagttcgagaccagtctggccaacatggcaaaaccccatctctaccaaaaatacacacacaaaaattagccaggcatgatggtgcacacatgtagtcccagctactcaggaggctgaggcccgagaatcacttgaacccgggaggctgaggttgcagtgagccgagatcccaccactgcactccagcctggacgacagagtaagactctgtctcaaaaaaaaaaaaaaaaaaaaattggagtcctctcaaactctgctgctgctgctttaccaactaagtttatgttaatatagtgaatcctttgttgtcacttcaacaatgttcaacaacatcttcaccagaaatagatttttatctccagaaaccactttcttttcgcgtccctaagaagcagtgtctattcagttcaggtttcatcctgagattgcagcaactcagtcaaatcttcaggcttcacttctaattctagttctcttggtatttccatcacattctgcagttacttcctctgctgaagtcttgaacccctcaaagtcatccatgaggattggaatcaactccttacaaactcctgttaacattgatattttcatcttttcccatggatcatgaatgttgtgaatggcatctggaatgctaaatcctttcctgaaggttttccatttactttgcctagatgcatcagaggaatcactatctatggcatctataaccttaggaaatgcatatcctaagtaataagacttgaaagttgaagttactcctcaatccatgggctgcagagtagatgtcgtgttagcaggcctgaaaataacacgaatctccttgtacatctccatcagagctcttgggtgaccaggtacgttgtcagtgggcagaaatattttgaaagaaatatttgtttttgagcagtaattcttaatagtgggcttaaaatattcggtaaaccatgctgtaaacagatgtgctgtcatccaagctttgctgttccatttacaaagcccaggaagagaagattcagcatcatttttaagagcactaggattttcagaattgtaaatgagcactggcttcaagttaaagtcaccatctgcattagccactaacacaaaagtccgcctgtcctttaaagctttcaagccagacactgacttctcctctctagctatgaacgtcatgggtggcattttcttccaatagaaggctgttttgtctacattgaaaatctgtttagtgtagccactttcatcggtgatcttagctagctctcctggataacttgctgcggcctctccatcagcacttgctgcttcaaggagctgttcaaggacagagcaaggagcaattctttccttaaacctcatgaacttctgctagattcagacttttcttctgcagctttctcacatgcctcagtccccatagaagtgaagagagttagagccttgctctaggttaggctttggcttaagggaatgttgtgctggtttggtcttctacccagatcattaaaacttcctctatgtcagcaataaggctgtttcactctcatcattcacgtgttcactggggtagcacgtttaatttccttcaagaacttttcctttgcattcacaacttggctaattgggtgcaagagacctagctttcagcctatcagcttctgacatgtgttcctcactaagcttaaccatttctagcttttaatttaaagtgagagatgtgtgactcttcttttctcttgaactcttagaggccattgtagggttattaattagcctgatttcaatattagtgtgattcagggactagggaggcctggaggagaggaagagagatgggggtctatggagcaatcagaacacacacaacatttatcccttaagttctctgacttatatgggtgcggttcatggtgccctaaaacaatgacaatggtaacatcaaagatcactcatcacagattgacgtaacagatgtaataatgaaacgatttgacatattgcaagaattaccaaaacgtgacacagacacgtcacgtgagacatgctgttaggaaaatggtgttgatagactttctcgacgcagggttgccaaaaaccttgaatttgtaaaaactacaatctatgaagcacaataaaataagatatgcctgtataatatgggacagcagtgcatcgttttgttttgttttgttttttgagccagaatctatttttctccttgaaaagctatatattagagattatttggtcctttttatctttgcgattattcactccttactctgattctatttctttttttttaaactgctataatttatatactattttctgtcatttttcaggagtagatggagacttaaagcaatgtaaaggagcaaggtaaatgatatctcctaagaaatgtcccctgaaagcactccttatatagatgctcaggcgactggtcagaccttctgatgagatgtttgaaaagtgattgataggcagtctgtaggtagaaagcacaatagtgttattctggaatacattacgcttgaaaataatgctcctaccatcggctataagggaattttagtgattaataaatgcagcatttaatatattaagagcttccttcaatagtgttaaaatggtggaagggggcaaccttgattttgtgttgcagatatttgcagtttaaaattgccttgttggtgcttaaagagcatttttttgaagacatagtaatcctaacacatgcatttctactgtgtaagagcacaaaaaggaagacttttccccatggcttttcatagctgggccatccatgtggcttctcttcacatcccttttcagcaatgtctggcagatagatcaccacctttcctgatcctcctttatcctctgtctcccttgtgtcctttgctgtgatgccaacagtgagtagcagctaaggaccctggtgcagctggccacgtggcaaggtgcctgcgtatgagaggaggatggtcacctcttcacagccatgcctggcaggcagtttcatggcattgcttgtggcgcttggtggggcccttgactcttctctctctgagctctgggagctgggccgaatgatgtgcccttttgtgattgatggtgccttatttaaaaaacactgcagatgacatagctgttcaaggacagagcaaggagcaaaccaaagtttgctctttgactcccaatagactgttccatgtgtctatgaagtaagagcaaatggtcatagttggcacatcgaagcttatctgagccttcagacaaaagccaaaataagcaccaaccctctcccacttgtgtcagctgccatgcacatggaagagaagcacatggtccttgagcactgtgcgcctgtctgctctctagcccagcactgtgtatccagcaaatcttcctgccaggatggaaatgttctgtaactatactgcatccgatgggagccacagctggaaactgggttcatgagatgtgactcatgcaactgaggacctgaatttctcgtgttatttaaatagcccccaatgactaattgccaaaacgtaacatagagacacaaaatatagagtggacagcacaactctagaggaatgcattcactcatccttaatctatttagaaaatactctgctgggtgttacaaaggcttcaaaattagtctcttcctttaaggatcttagagtcctgctggaatctaaaacatgattggtaaaatctgtgaataattgctaatgatatacacaataagaatgtgttagcaacagtgcaggattttgaactgaaatcacatttggggtagcatactgtcaaggatagataggagccaagaagaaaaatggatattccagaccaggagaaatggccaagccataggcatctttactaaagcatagaagagagtcgttttttgttgttgttgtttttatcaagcaaagactgtattaaaaaagatcttgctaatgattacattgaagtgtggaggtgagaagagatttgaaaacataataatcctaacacatgcatttctcctgtgtaagaacacaagaaggaagactttgttttccccttgggtttgcatagctggagcacctgtgtagctcctcttcacatctcttttgagcaatgtctggcaggtagagattagaaatctctaatgtttcattgagaaatacgagactggggctggggacagtggttcacgcctatcatcccagcactttgggaggccgaggcaagtcgatcgcttgaggccaagagttcgagaccaccccggccaacatggcgaaaccccatctctactaaaaatacaaaaattagtctggcatggtgatgcgtgcctgtaatcccagctacttgggaggctgagacacgagaatcacttgagcctgggaggcggaggttgtagtgagctgagatcacgccactgcactccagcctgggcagtagagctagattctgtctcaaaaaaaaaaaaaaatactagattaatctctgtcaggctaagattagtatttcttaaactgggtgcccattggtaatatccctttagcctattttaaagtgaaaatctcaccccatcctgcaagcacacatcctgggttttccccctatgactttcagaagagtctaggatggttatcgagacaccagcctacattctggatttgtctgattgtttccacatgataccaccttacttgttcctctgtcccctgtatttcctctaatctagaaattatgcctagtgcttcagttggacacaggtcagctgcctctggcaagaataatgctgtgccccttcgtcacctttttggggagatgtttgtattcagtctatatagggtcagtaccttcatgctagccccagccctgcagagtagagttgtcctcaggaaagctggtgaactgactcctctcccatagtggtacatggaactttttagtgagaagttcagagcctgagatacaagttagaagtactggctataatgcctgtgtgtgtggacagccggaacccttaggcaggaagaggaggctgccggggacagaggtgtgccatgctgtgcacccttcgaagagaaggtactcacaggaacctaaataggtttcacgtgtatgggttcctctgttccatgcagtgggatacaggaaagaaagagcagccatgcagctgttttctcactgtgtcggagcacacaccacagtctctttgatgtttgctcatgagattgaaggacactcatggctttgtcacaagatgcctgagaaagcacagaggttttttgtttgtttgtgtgtttgtttttgagacagaatctcgcactgtcgcccaggctggagtgcagtggtgcgatctcggctcactgcaagctccgcctcccaggttcacgcctttctcctgcctcagcctcccgagaagctgggactgcaggtgcccgccaccacacccagctaattttttgtattttttttttagtagagacagggtttcaccatgttagccaggatggtctcgatctcctgacctcatgatccatctgcctcggcctcccaaagtgctgggattacaggtgaaccaccacacccggccttagttttattttttttttttgagatggagtctcgctcttgtcacccaggctggagtgcaatggcgcgatcttggctcactgcaatctccacctcccgggttcaagcaattctcctgccctagcctccctagtagctgggattacaggtgcctgccaccacacccagctaattttttgtatttttagtagagatggggtttcaccatgttggtcaggcaggtctcgaactcctgacctcagcacagagttattaaaatcaaatgcagttgcctacgctttgtctgcttttgaaaagtaaacttaatgtttcagactgaggtgtatttgtcattggggtcctatgttctgcacagtttgtaaatctacttcacccaaagtgatacagtgatactcaggagggcttaaaaaagattaaatccttcatttggaaacatcatgcccagtgaaaggaacacaggccctaaggagatgtggctgattctagggaccgggaccagtaaaatacaacatgagcacagagcactttctcatgccaggatgcagtgggcggggttgggggggggggtcccactggcacaatatgaaccatttgtaatcaaaagaataatgaccagaagagagtataatactctgtctatatattttttaagtctctgtgttatgattctcaaaagagtaaaagggtggctgggggtgagctcttttacagaagaatgccagttaataaatatggacagaatgggagaattagccaggtcaccattttgggatcccgactgtaagtggttcccacaagcattgtcagtggaagccaaaatcatagagtaatcatgcaggagacgaaggtgcccgcagtgccatgtcagaagtcactgactgataacagaggcaaacgggccttcagagcgggcagctctgggggccacaattgaccctgtggcccaactgatgtagctttgccatccagaaagcagcatgtcacgtcacgtgtgctttctgaagtgacctcagaaatggttaacctgaatccatctggacctctagcagtttcagaggggtagaggaacacgggagggggtgtcatgtggaaacagcaagacaaatcctgaatgtaggatgttccaccaggtacctggactgggtccttgaaaatgttgactatcatggggaaaaaataggggctggcttttccacttttaaagaggctaaagggacatagtcaaattcagtggaccttagattggggaaaaaaatctataaaagacatttttgtgacaattggagaggtgtgatgtgtgctatttagggggtactatgaaatattgctgatttgcctgggtttggcagtggtattatggctgtgtaggagagtgttattctgaggagaaacgtgcagagagctagaggaatgaagagttagggcatctgcatgttttcaggtgtgttgcgtgcaggtatagggtatgtagatgtttcctatcctactattgactcttctgtatacttgaaaagttaaaataggaaagggaagattaagtcttaagcatgaaccactaaaaacaaccccaaaagcagtattaagtagtagtcagttaattctgtttaagagacaagaatgtaaagcatgcatctttagaaaattgatgttggagatatggaagaaatagtttcagaaccttcagctctctcgaacattacagtggcaatgcattcattgcaatgtgtattatagcagaaaacattctgaaggaagagtcccatttcctagtgctcatttttcagttcctcgtctctctcatagtgcaggagatttgtagacaaatgtctacaggatttagacagatgtcaggaaaattgtcttttgttgatgtcttaattggaatccgatagtttgtcagggcatgatgcttataaaaggaataaaagctttctaaaattcttcaaagagtagccactggtacctgtgtgtcacatcatatgctgatgagacatgacagaaaatgctcctaagtagccttatagctgatcctgaggagctactgtgactgggctctcactgcacctctcagctgacttctgcctactgggtctgtgtcatccctttttactctgaggctaccaaggtcttaggaaactggaggttggagcttgaactgagtgatgggaggaaaagacttcctgaagtgctgcccacatctcatgtatgttctcttggacccagttgtatccctgccattccctggaggttacctgttcatacgcagacttctctttcccttatttacctcaattgcagtagcttggcaaccttttaactcttgctttttaaaaggaaaattatttggttatcgtagaaacattttgtgcagcaaagtgttacacatatttctgttctggcctcaaataatcatggatttcattaaatactaaacattttgctgattttaatacagtgctttagtgtattcttattttctttttgcatctcttatttgcctcgtttatcttaacataaagcatttcctttggttaagtagatccttatatctgctttttctttttgtatgactcctatttaggttggtgctaaagtaatgacggtttttgccattacaatacctgtagacataaaggtctagcttactttttgccatttgctaccctgtgtttagtactggcattttgctgactgctcatcagcttttgatacggtgtgcttacgtgacaagctctttaaagtgaaatcataatcagatttgagatttagaattgaggcgacttgtcctgtctacagtgaaactgaggcaggacaacctggggagctatgaatagtaggaaaatcccagtgaaaatccagcacttctaacttctactcctgggcgcttcatcacttagagttaccagcagtcttggtaccatttgttcatagttttgccagccctcacaggtacaggtacaattgtagatactgaaactctcaccagctgacatctaatttaccagctgatttaattttatctcattgatgattgagaggctctactgatagcccaaaaccactttagcttaggtgaaacatgagctgcgttggtaactgaagcctggcccatctcattgacaacttacttactgtactgatttagtaaaattacccatcctctgtgtccccgagtatggtttgcagcatatcacaggcaatgtgtgacatcttccaggatattgcatgcctaccaaaatataatcagattaaagaacatgttcagttcatatctgacctacggccccattgcactgtttaacatgattttgcaacagagatgtaaccatctgcacatgttatgcatccccttataccattagggtttatgctgagatcaagtaaaatcatatcctctcatagggaggggacgggacttctgtgaagtagcctgaagaaattaacatctttatatgatcacatctataatacagaataataaatgccatgtacctgttgctgtgtttattgcttctgctggctgggactagtgagtgtcccgattttaaggacgtgttttgaaactggcttgtctgtctttctgcctctcttctcagccaagtgtcttgctaaagtgggctgtgtttgccgaactcactcccccattttccttccctcgctatgagctggctttttggccctaccactcacagaaattgttctgacagaggtagcagtgatgtccgtgctgctaggtgcagagggcacccttttcttaaattgccagaacttccggcttcctttgccgcttctgcaccctccttggaaatctttctctttggcttcacggatagttcctcttctggcttccccatagctttcttttcctcctggtgcctgtttggcgtccctatggctttgttatgggccctgtcctcttgtggaaacctcttctgagctcatggcttcggcacatgcttctgctctgatgaccccttgacctccctggctgggcctcacctcttttgagttcctgtctacgtttcccagtgaccacaggctcttcctacccgcgtggccaagaggcagctctgaagcattgtattttaaacggggcctctagttctctgccagatctgctcttttcctgcattccacaccaggcagcaaaccccgaaagccccacagcagatggctgggagttatcttccagtcttcaattccttgccatccccacccacaccttccaggcacctcctgatttataaatatttcaaagccacttctgtgtcattccagctgccatttcctgcttcaggctttcaggcttttttctgatctaatagcaatatttactgagaacctttaccacatgcagttctgttggttacctgcagtgagatcagtggtggctgtggggttttgatgctcatgagggtgaaatcgcagagttctggggcccaggtgtatttgcatgaggtggctttggtgagagcatagccttcaccaggatgtttttggaggtttttctcctagtgtattttcctagattcctttgtcaaaggaatttggtcataaactggcccttaagtactttctaagagaagccttgttcatgtggatcacaatgaccttagactttgtgtgcgttgtcagtgctgccctctcctgggcattgcttctgcattcttaatgcaaatatgtgagttattcctgggtgtggctccatgacttgttcctttctggaagctctagccttatctcagccctcatcttgttaaaccagttgtgctgaccttgcttctctgacagcaacctgataaaagcctgtaaagttgcccacttcaagtcattgagcaatacaggtagccaagcagtagaggtggttacaataaatggcttaacattcccagcatttaggtggctccattcagatggcggaaggcaggtggcactttctgttgtggagaatttgaggagagagctttaagttcaaaaggaatttaagaaaagcctaagttggatctatgagggctctggaggagagattgagatgttcagggtgttccttcgattcatgaacccgactgacttttcacagcaggaccaccagttgccagatactgagacaactgagtcaaatgaatacaacagcatccctgttcttcaggggactgcaggcaggggtgctgtaatttgtacgggggcgggggtggacatgatctgttcttctatattatcatcattcatctgctagagacaactcgattttcttgggagccaggaaaaggaagttggccagtcggatgtgcctcacagcagagcaaacgcatcccaaatgagccaccggaagggttggggagtcactgaggtggaggaggaagggctgagggtatttcaggccaagaggactcggtgagaggcggagcacaggtaaaaaggcctgccaagggcagatggcggcgagccctgtgccaggctaaggaattcacattttatctcgtagccatcatacagcctggcgagcacacgatgtctagaagggtggtgcttctgatgatgtggactgttggcgcttagacactggagactggtagaaggctgttgccattgtccagatgaacgatagaaggactgcatgagttttccacaaactggggggcctaaaacaacaggagattactttatctcagctctggagacaagaagttggaagtcaggatatcagcagggctgcgtttttccttggcttgtagctgcatcgctccggtctcagcttctctccacgtggccttctcttctctccttttgtctcttataaataaggacccctgccattggatgtagggcccaccgggataatacagagtgccacatctccagatccttcacttaatcacatctgcaaaggtcttttttccaaataaggtccgattctcgggccctagggattaggacgtggacatatatttttgggagccacccttcaactgactacaaggacccacagggttggaatgaaaggaagaaaagtggctgattcagaggccgttcagctgacagctgggcatagagggatgggagggagaaggcaggtgaatagcagtgacttgtcctgaagtcgaaattagaggaagctgtgaggcctgaaaatagggatgagttccattttaggcatttggacatgttgagtttcaggaaactgaaagactgggcacctcttaggttgacagcattgatggaaacaaccatgatttcccatttaagacaaacaaaactcttggtgccgttaacccatgaagaaaactgacataggtggccatcgacctacactcgtctttgaacagctacagtacctagaagccattttagtttttacttttattattattattttttgagacagagtctcattctgttgtccaggctagaatgcaatggcacaatctcagctcattgcaacctctgcctcccaggctcaagtgatcctcctgcctcagcctcccaagtagctgggactactggtgtgcaccactgcacccggctaattgctgtatttttagtagagacggggttttgccatgttgcccaggctggtctcgagccgtgcacccggctaatttttgtatttttagtagagatggggttttgccatgttgcccaagctggtctcaaactcctggactcaagtgatccacctgcctcggcctcctaaagtgctgggattacaggtatgagccactgtgcctggcccctggaagccattttaaacttatttctaagtccccttcctcagagagaatacatgcacacacacagttggataattagcctaggaagggtctggaaatttagccatatgcccaccatgttttgtcctcctcctccttttgtgtgtgtgtgtgtgtgtgtgtagtatgtgcatctctgatacaaagggagcagctctggatccctagtcattctccaatcagcctccgaattccccctaaccctgcatcaaaacctgaatccccccaaccctgtgtgaaagcctgccacttcaggcttaatctttgttgacacgtaagggtgccgaactcacaactttgaagtccttttattctactcccttctccttttctcatcccagctgggttgtaaatgtcagggagaagtagagggcccagtcctccttcctggggtagggagattatttaaccatgggatgcaccatgatttccaaacacagttgattttccagagaagggagtgaaaagaaaagtgctttggaataacctttggactccacgcaccatgccggggataaacatggaaaataaccatttgttgggcggtgctccgtgtcacatattctagtatgtagttttatacccagccattgcccttaccctttcgatttttgttagagcgggacggtgccctgcatgctgtgtgctgtctgagtatgacatttctagtagtaaggaaggttaggatggctctttcctttgccttcattaaagttctcttgcccagatgtgagatctttaaaaggtcagtgtttttgaataaggaatgaaatcatattctaagataaaagttcagagagttatacaataaaataataaattagtaaatggcacttccctgagaggcgatggtcactggtcactgttgttgcatcccattcctcttgccttcagggaatatcccctcaggtatgagaatgctcagggctcaaagacagagaagagctgtacgtcacactgttggggctggcagcaaaatgctgagcaaccttgggctctacaacatgtcctccatggaggtcaggctctaggcctgttctgttgactgctggagtctcaacattcagaacacgggtccaacatggcatgtgtattgacagagaagcttcaggtaatttttatgtccttgaatgaatgggcacatgttacatgacagagcagggactagatggagccaatatattagatccccttctctccacacctcattttctatatagtgcagccagtatgagaatataaaatggaaaggaagaaggcatatcattttgtatgtgctctatgatctttaaatgttattaaatgttggtaatgaaatgctgtggtataactaattatatcctagcacctctttcccatatacttgcattctctaattatgttcaaagcaatggttgcccgaaggctaagggtactcggtcctttcctcccccatgaggactatgttttagcttgtaatttcacctgcaggagctcacaaaccagctgcatttgagtgcaattatactttattcatagtgactaataacagaaaagagacatcgtgggggtttgggctggagatttataatctcatataaaaaatacgaattcttgcttatttatgggttgagcaccttgggcccccgctgtttcatctgatggctgcctgatttttatccgcaaaatcattcattagtatctacactagaatgtaaacacagaatgtaagataaatttgttgtgcagtacttggatagttagaacacatttccccagatagaaacattaaaactagaggttattcactcccatattcacacaacctttatgcacctgaggaggttccgaatgtccctgaccatctcttatttcttatgggaaagtgtttgggtaccagcttggaatgccaggagtgtaattctccagggcagcgactgccgcccgtgccattgggtccctagccctttttcatgctctgctttctgatgagcttacacacacaggcatggtgtactgtgggtgcttagtattgctgtaggacttcttgtgtcctgagttcaccactaccctttaattctaaacatttataaactattgaagttagattcaaaactttcttttccctaagcttttactttctgcttattctgcttataaattagtaaatgttggccgggcgtggtggcacacatctgtaatcccagcactttgggaggccgaggcatgtggatcacttgagcccaggagttcaagactagcctgggcaacatggcgaaaccctgtctctacaaaaaatacaaaaatcagctgggtgtggtggtgcacgcctataatcccagctactcgggaggctgaggcatgagaatcgcttgaacctggaaggcagaggttgcagtgagccaagatcataccactgcactccagcctgggcaacagagtgagactctgttaccaaaaacaaaaaatctagtaaatgttaacagtcactgttcagaggccataacagtgtttgagtctcaacctttacaattttttcataaacttcacctttatactgttaactcacacttacaaaactctaatatattttatttctttgttgagtacttcagttgtctgaattaaagaatgaaactcttttagtcaataatcatcttaaacataataagtttataaaaatgatgaacctaaaattcttaatatttcaacatcattctgatcatgccttaaattgcaaatgtaaataattcaggtatgcatttaaatggttatttattagcattattgttctcataggccaaattcaattaaaaagtacaagtaataaaataataagtaacatggaaaatgtattcagtggtcttgctgcttttaagcatccctctaaatgatttgggagttgagagatgtctgttcattaaggaaaacagttccctcccaggtactttacattcccatgcaggtgattagagttttcatttcttaaaataagtaaatatctttccacctaactccagtaatctttgaacttgggaggaattctccattcttttatgcttctcaggtcagtacaagtcgtaggtacagctattaaaaggatatctgattgaattctggatatctttcatgtagtttgactgacagtaacacctcatagggccacattactgacatagttagaacattgtgctagccttagttatgtgtctgccaagcccctagctgttcaaagaaaaggcggtctcttaccagctgtccttccctggtaattggagctgtggaataaaggtcagttgctctttgagaatgtgagtgagcatttctgactcctcatccttcagtgcccccatgtgtggaaggcttggtaaattgagctgtgcctgcagttaccaagctatgcctccttttgtcaatataattcccactttgctactttgggtaccagaggtacactctgcatagcaggaaccataccctatgctttttggttcttttgagaaatcctaggtagaattagatacataaaatctgagatactcgaaccaatttatacatatgcaaatatgtattctttaaaaaaggatcttgatccttatttcttagtgatcttcttcatcccttccccatgttaagatagcaccttccattaacaaactgctcttgccttttatataaaaaaataaaaattaaaaaaaccaagtagatgaagatgaataacccagtgttacgggctgagtcatgtccccctcaaacttacgtggtggaggcctaaccccaggacctcagaatgtgactatatttggagataggtctttaaagggctaaacaatgtcctaatccaatgggactggtgtccttataagaggcgattaggacacagacacactacggacaaccacgtgaggacacagggagaggacagcatctactaaccaaggagagaggtctcagaagagaccaaccctgctgactgactctgatcttagacttccagcctccagaattgcaagaaaattaatttctatgtaagccacccattttgtgttattttgtgatggcggccctagcaaacttacagtcccaagaatctaagatttttgattgtgtgaaggatcaagccatctggaccaatgttttcctgaatttctgggcagacctttccaggaaggtgggcagcaaatggcccaggtctgttcagttagaggatcaccagagaagtttctccattctcagctcctatcatctttttacagctgaattttctgacattcctccacccccaccagcacacaaaaataagtgaaccaaaagcataacagctaaagaaatattcctgtgacatggtcactcatgtgtctttaggagagaagcactttgtactgtgtattgctgtttatattcttaatgtttttcttacatttcatgatgatttacattgccctaaattttttaaaaatgtaattttggcattatcttcatatatatgcatatatccctggtggtaattcctaacaggccattgatagggaatgctaagagtaaggatagtgatatggtttggctgtgtccccacccaaatctcatcttgaattgtagctcccacaattcctgtgtattgtgggagggacctggtgggaggtaattgaatcatgggggcaggtctttcccgtgctgttctcgtgatagtgaataagtctcatgagatctggtggttttatgaaaaggagttttcctgcacaagctcgctgtcacgtctgccgccaagtgagatgtgcctttcatcttctgccatgattgtgaggcctccccagccacgtggaactgtgagtccattaagcctctttttctttataaattacccattctcaggtatgtctttatcagcagcctgaaaatgactgatacagatagaaatggaagggtagcggagggcctgtcaccttcactgaaaaagaatagaagtgattgagttttggtaggaaagatgatctttaaataaagcctttgtgcatgttgtggaggacagttgctggttttcattaattcaaaaggcctagggatatgtgggtttggcattaatctataatgcctcagacactggaaaactagctctgagaagggtttaggcaaagtgacatccatctagagctctatgtttgtatatttagctcttaaaattcaaaaagaatttagattattgccattagctaaatggaagcatcatggtgcatcaataggaaatgggaaaaaaaatgattaatagtatttatacatatgtgttattctgtagcaataacgaaggcctagcatgctggggtttgttttcattttgtgaggactatactgtgctgttttttagtaaactggtgaactgcctcagataaattgtcacacatagttctgtaaactctgcctgtagctttcattgactttaggttgtgaatgaaacgtttaaaagtttatttttatgttttttttatgtttttttttaatatgtttgaaagtcattgtacagtagcccgatgagggaaaaacaaaaagatagccaaagttactttttttttgagacagagtctcactctgtcgcccaggctggagtgcagtggcgccatctccgctcactgcaagctccgcctcctgggttcacgccattctcctgcctcagcctcccgagtagctgggactacaggtgcccgccaccacgcctggctaatttttttgtattttttagtagagacagggtttcaccgtgttagccaggatggtctcgatctcctgacctcgtgatccacccgcctcggcctcccaaagtgctgggattacaggcgtgagccaccgcacttggcaacaagatagccaaagtttcttaaatgccttctatttctattgctgctgtaacaaattaccacaaactgaggcctgattttaccaatctcttggtaaaatcgggtgttggcaaggctctgtttgtttctggaggctctaatggggaatgttttcttgccttttccagctattagaggccacccacacgtcttgactcatcttcaaagctagcactgtttcacctctttgaacatacttttttagtgcagacgtttgtagccataatttccctccacgcagtgcttttgctgcatcccataagttttggtatgttgtgtttccatttttattcttctcaaagtatcttttaatttctctcataatttcatctttgacccacaaatttttaggagtatgttgtttaatttccacattatttgtgaatttcccaagttttcttcagttactgatttctaatttcattgttgattgggaaaatatatgatttcacttctttgtaaacttattgagacttatgacccagcatatggcctattctggataattttccatgtgcacttaagaataatgtatattctgttattattgggtcagttttgtatagatgtctgtcaagttttaatggtttacagtgtgtaagtggattaaatcaagtcttgtatttgtcttccgtctagttgttctgtccattgtcaagtgtggcattgaaatctccagctactattattggaatcagctatatcccctttcagttttgacagtttttgctgcttgtattttggggctctgtggttaggttcatatatgtttataattgttgcatcttcttgatggggtgacctttatcactataaaatgtttccattaaaattgtttggttttttttagtgaaatggtttgtcctaagtctactttgtctgatattactatagctacttcagctctctttgggctgttgtttgcaaggaatctcatttccatcattttactttcaatgcttttgtaccatttggtctaaattgtatctctattgtagatatcatatagttagatcatgtcttttttaaatccattcttcaatctctaccttttaattggcgtttttaatctatttacatacaatgcgattattggtaagacaggatttacgtgcggcatgctgctgttttctgtgttaagtcttcttgttaccttatttctttattactgccttttttaactttagatattttttagcgtgccattttaattattctgtcctttactgtatttcttagtgattgctctgtggactatgataaacatcttaaccacttattttaagtagttcacaaacctctgctcctatgtagttccgtttccgactctcttatttctgttgctgttgtcatacaaattacatgtttataccttgtttgcccatcaacacttataatttacttcacacaaaatttgatttacaaacaaaacataacgtttatactgtctttaatatctcccaaggggcaaaagcaaagcccagttgtgagccattgccttaaagtataaaaaataagtgttacagcattcttgtcctttatctcattttaaggtaacttagcacgatttagaaagaacaccagagacgtttttttaattggttattggataatgagaccccaaaaaaccctggataaaaaatgttccatttttaagtgtttccaaatctggcttgatagtttccagaacaaaaaataaagtaaaactttataacaatttttggtataaatacttcaagttagaactttgattcattaatctttattcaaatactgaaagtatgttgagaaggaaaatatatacaaactcataacgtaactctagtaataatctcaagtgagtttgacctggggagaaggtctgttcagagaaaggtgcatgtaatcgggtgatgagaatctgaatttgagccagctgtatccacacagtctttataagtcatccctaacactcagagcaattgcgcgggatagctgtttgccctggaaaaaagcttgactcttgctggtggagcccagattcaaaacgggggcagggggtggttacaaagcatatcaatctgttatttcatcacatacctgctgccttcttaaaggaaacaggaaagcattctttgatcagcatctacagggtctgagattctgctttgaaaaaatccatgtaggaaaagcgagaaggaaaggaagtacacaggaagggagagccaattcatctctgtgaccagaaaaattaaaagttctttttgcactggtcatctactgccaaatatgtgcttttaaatgggagagagaacaatatgcatgtacatagcagtattattcagtatcctgggctttttcctcttcattatggttatcagatttgtgtgcaaatgaatgtaaacacacacacacacacacacacacacacatatatgggtttttttttttgagacagggtcttactctgttgcacaggctagatagagtgcagtgcagtggtgcaaccatagctgactgtagcctcgaactcctgggctcaaccgattctcttacctcagctccccgagtagctgggaccagaggcacatgctaccacacccagctaatttttaaatgttttttgtagagacagggtctcgctgtattgtccaggctggtctcgaactcttggtctcaagcaatcctccttgccacagcttcccaggtgcctgggattacaggcatgagccacagcccccagctaacatattctttaaccccaatatctacaggatttaagactctctctgttggatagctcaacttaaagatatggtagagctctcctgaatttataaatccaaatcaacagttatttattctcccaagctagggacccaccctccttatggtcgcagggggttccctggcacactgcatgctagttagaaagccctcacactgaccccaggctcctccctatatgcctgtaccctttggccacctacctgtggatcttttctctctgggagcctccttgttctctgtgtttgggacaggctgtcaccttctgtcaactagggtaccttgctcttaaattatcccttcaatcccacctccaccataattaaagttaaaacagtagtgggacctgcttttagcctgcagtgtgtgggcgtggagggaaggcaccctgaagctccagggaaggaatggcgccatactttgtgcgctcaccagtgccccagaaaggatggcactggggacaagagccccaaaacatgggcatcccctcctccctaagaaggctcaacagagggtccccttcagggattccatcaataaagaaagcacattttatgaaggggagttgagaagtcccaggaagatttcctcacattggattccaggggtcatttatgagtgttgtgatggtcggtgggtattttttgtcattcagggctacttctattaacattgtaactgttcattttttcccaacctaataagtttttctttttaaaacaactttatggaggtttaattggagtacaataaactgcacataaagtatactgtgtgaccagttttggcatgcagttaccgtgacacagttcccacacccagatgacaaatcttcccacaactcccagaagtttcacgtgcccactgcaacccctgcctctctctgaccccatgccaaaggaaccactggtctgcttctgaaattaaagatttcctagaattgtatatagaaccacacagtatatgttctttttttaatctggcttctctcattgagcataattttgggaactcatgtcattgtgtgtaccagtagtttttatgccttttattcagttgtgtggctgcaccacaggctgaatatccattgacctattgacagtcttggcttctttccagtttttagctgttacaaatgaaactgccataaatatctgtgcctaagtctttgtgtaaacataggcttttctttcttgagtaaacatgtaggactggactgattccttcctgaggattgtatggtaaatttatagttaacttttaaagaaactgcccaaagagttgctatgttagccttttattactgctgtaaccagttgtcacaaacagtggcttaaaacaacacaaatgtattgtcttacagttctggacaccagaattggtctcagttggtaaaatcaaggtattggcagggctgtgttcctttctggaggctgtggggtattggctgtttccttgcctctccagctcctagagtggccgccattcctgggctctgactaccgctcctcttcataccttctctctctccctcctggccgcctcttataaggaccttgtgattatattgagtccacctggataatccagggtcacctccccacctcaagattcttaattacttttgcaaattccctgttgccatggaatttaacattcacaggttctgggaattaggacttggacatctttgggggacaattattctctctactgcagattgcgtcatcactgagttgtaaagttcagttccttacgtattctggatacgagtcctttgggtgtctgtgtgtgcatgtgtgtatgtatgtattgtaaatattttccctcagtctgtagcttgccttttgctttcttatgtgtatgtgccttttaattttgaagaaagcccctttatccatatgttctcgtacgacccttgctctttgcgttctatgtataaaaccttcacataatccaagcctccaagaatttttctcctgttttctttacagaggtttatgatcctagggatcaatatttttccccaatacagatatgttttcatacagataggtatggtctagcaacaccttttgaaccagttcattttttaagtgattttttaaatttaaatatggatgagaaaaaaattcttagaccaattcccatacctattaaatagaattgctaatgcctgtgaattatgccacatgctaatcaagagttttactttgcagatgatcactcaattatctttacagatctctattttaagcaatcatatttattattttttctctacagttcaaaaatgatagcttacagctacaggaagcgatatatcaaatacttaaatacttttttctaagcccactagagcaagcttctcatttgaggcaatattactgagactcttaattttatgcttaattattcatttcagtcctttaaattcctaaacacgagaaagcactagcatttacatgcaggctcatttgtaaaggtgaaacagtgacagcacggtgctgtggaagtttctatcctgtatatataaagcacaaaatacgttagtggttgtagggaaaagcgcggtagtgctcacagcgtgttaacaacttgcaacatttgttgaagaacagatgattgcacttctcatcatttgatgttctcatcaccgtgtcttctcccttctcatactgctaggaatttgtgcttggcttgtaacattgcttctacctgacttctgttttcgggtctgagaggacatttcttagataataggtcattgaaattagttagctgaaggtgacatatggataggtcttcaggtgagaaaaacattctgatttacatagtgatgtattcttaatcactgtttttgcaaggtttctctttgtcagtatttgtttcaaaatatattaatgaacttatcatttctgattactgatttatttaaccttgtaaggactgtctccatgtcagttgtcacatttttcttggtgcctagcacaaagtaggtacccagtcaacatttgtttaattaaactgattgtattctgagcatgtgccatttctgcatacccgggatatctggcttctcgagatttttcatctatgatttgaatcaatattacatgttatgtttacttgtgtgacacaggatggtcccaacttagaaatatttgtctcagaaggggctctgtgctcagtcactggaaacctggactgaattttaatttaaggggaaagtcaattttaggttcgtttggattctagttcatagcattacagttttgttcttcagtttccacagtgtaaatgaaataacacatatagcagcaaggagcagtgagccagtcatacgggtgcagtacagtacttaaccaaaacaagcaaaccataccgttaaattttgaaccaggtaggtttgggttttctcctagtttatagacaggtatttattcatggaaggcaagttggatggagattgcagaaaacctaaaagagaggaatatattttgtgtttttggactttaacagcactaactttgatttccttttcctgtgacatacttacctctgatttttgctcacactcagcctcactgttctatagttttggagtgtttcctgcaaatcacagtgtctttctgctatacattgggataagaaaatatatacatgaattagatctggtaatggcaggccttgagaatagagcaaagggtaaaacccaaatatgtcagcatccaagcccacataagtgtgacagttctccagactgtgttaaagtttcctgattgtattaggacatattgtattgctataaagaaatgcctgagtccacgtaatttgtaagaaaatgggtttaaatggctcacaattctgtaggctatacagaaagcaagccactaaggcgtgtggcttgtgtgcctacagagcaccaggatgagctccctttgagccctggctgaagcaggagcagtggggatgaggggagcagtgtcctgaggcagctgggccctgggcgtggctcaggaaaccacccttctcttctaggcccctgggcctgtgatgagagaggctgccttggagacttctgaaatacctgtgagacctttcccccactgttttggtgtcagcacttccctcctttttagatatgcaaatttctctggcaagtggttgctccacagcctgcttgaattcctctcctgaaaaagctttttcgttctctgccacatggccaggcagcatatttcctaaacttttttgctctaccttccctttaaatataacttccaactttgtcatttctttgcttctgcatctgagcgtagtctgttagaagaagccaggttacacatagcatgctttgctgcttagaaatttgttctgctagataacctaaaggattaccctgaagttctaacttccacagaaccctagggcatgaacagaatgcagccaagttctttgctaagaaataacatgtgtgacctttcctccagttctcagtttctcatttccatgtgagaccttgttggcctggacttcaccatccatatcactatcagcattttgatcacaaccatttaactgttctctaggaagctgcaacttttctctcatcttcctgtgttcttctgagccctccaaactcttccaacctctgcctgttacccaattccaaagtcacttccatattttcaggtatccttgtagcaacacgccacttctggtaccaattttctgtattaggccgtgcttgcattgccttaaagaaatggctgagtctagataatttagaagaacaacggtttaattggctcacatttctgcaggttatacaggaagcatagtggcagctgcttcgggggagtcctcaagaggcttacaatcacggtggacgggtaagcaggagcaggcatgtaacatggcaaaagcatgagccagagagagagttggggggaggtaccatgcacttttaaaccaccagctctcatgtgaactcagagcaagagctcactgatcaccaagtggaggatggcccaagcgaaggatctgcccccatgatcagtatacctcccaccaagccctgcctccaacattgagggctacaattcagcatgagatttgggagggaataaatatataaactctattactgaccaatgcagtttctcctcataaacactgacctgatgcagggtctttttggcgtagagggggcatggagattagttcattctgattggtcattaccaaaggctgggcaagggcatgtggtaagggatgcaggagtgcctgtggaatatagaatggtgaatgaggctgagcagggcaggggtcccagggcccagagagaagtgcctggcccaccatccacctgggaacatgctaggggtttgctaacggatggccaaggtggctgggaagaaaccaggaggcaggccagggtaggagggcagccacactcatcccatgagtctagtcggcagcccagggtccttggccagctcaatgacttatctcctttaagggacttgattgtctcaggcatgcctacagagtttccaccgccagccagagagccaaaatgtttcccaagccaatcccatgagatgcctcacttctagtgagccacccccagcccccacaacagcctccagtcagggcccacctgaagcctcccttttccaactgtaaagctttcccagctccccaacctgcatttgagcttctgccaaaggcaagtgctggtgtccaactttcttgctatgcaatctctgaatgaatagcctctgctcgttctcatttgaagagattttcatttaccttcacacatggacagttatctttataacttaactcagtgcctcctcatttaccagaatctggtcttttcgtgggcttctcttgtcttcccgcaaatgtaataatgccttcctatgacactaggatgctttgagcagatagactcttccagtccatgcaaagaggtggtgtggtttggcctcactcctcactgcaggcttaggccagctcccccttgcagccacgtgcgtggacgtgactctgggagtgaagtgaaatagcgctgccgacaggatctgggctctgtgctgtgtgccaggagcatagagagcaatgtgaaacagctgttgcccacagtgacctttcagaacagtttttgctgttagggttctagggattactaagtaagcttggctggttaagaaggtcaaaaaaagcccaaggcaaccccagctgtctgaactagccatttcagaaggctgaaacctttctgctgtgaagggctggatttcctagcttatgtagttcaaagctcagtttttaggattgctgtgctacttactgaccgaaagttggtttttggaaattgacccttattttccaatatctttcataaagctggaaatgctttcactagaagaaaaggaggatcttatgttagaacatatatatatagcgatgtaaaagtttcagtagttactctcaaaagaaggtcaccaaggacaactgtgatttcatatgtaatgattccagcctagaaaatgtttttttcttgatttccatttaagagagttgagccaattaactaatccttgcatatggtatgttccattaagttgtcagtgtttttattccaagatgcatgtttctttaaaagagctagcttattagggcatgtcttcataagcactttaccctggccatgtccgtgagaatgctgtgcataactttcattgaattctacatctcatttgatgcaggcctaattaactattattaactgagaactccaatttattggaatcatttgctgcagttaacttgagaaagaatggggcatgtttaagggtccttatttttaaatctctctttcattacaaacacattaacataagtctgatttgggggtgacagaaggaaataggaaaataaatgtaactaaaccataatggggtacaatataaaggaaagtaagtactgggatgaatatcatcatagattgtttattctttaatttgtactaatttgtacatttgtatatgtacaattaagcacttcttagttaagattgatatatttttaaaatcacaactttatagagcacaagtcttacatgaaaacataatgccaggtcagtggccctccacttgagcacacattcaaatcactgagagggctctgtaaaacacacattgctaggtcccaccccagcttctgattctgtagatctggggtagggcctgctgtgtggtttgaacgtttgttctctctgaaactcatgttgaaacttaatccccaatgtggcagtattgagaggtgtggggtctctaagaggtgttgggtcatgaaggctctgccctcatgaatggaccctttcgttcatggattaatagattagtgagttgttggatgaatgcgttatcaaaggagtgggactgctggctttgtaagaagaggaggaggctgggcactgtggctcacacctgtaatcccaggactttgggaggccgaggcaggtggatcatgaggtcaggagtttgggaccagcctggccaacatagtgaaaccccatctctactaaaccccatctctacaaaaaattagccaggcatggtggtgtgcacttgtaatcccagctactcgggaggctgaggcaggagaattgcatgaacctgggatgcagaggtttcagtgagctgagatcacgcctttgcactccagccctggctacagtgcgagactccgtctcaaagagagaaaaaagaaaaaaagaaaaagagagagagagagagagacctgagctagcatactcagccccctcaagatgtgatgctctgtgctgcctcgggactccatggagtccccaccagcaagaaggccctcccaaaatgtgtcccctcgacgttggacttctcagtccccataactgtaagaaatgaatgtcttcatacattaccacgttttaggcattctgttaataagcagcagaaaatggaataagacagagtccaagaatatgtagttggacagcatctcacttcatactgatgctgctggtccggggacctcatttcgagaatcaaggtgtttaggaaacaagcagtagaatatcttagatgaacaatactagtggtgtacattttaaataaattgaacaattactgattagctactatgtactgtcaaaatggttcagaaaaatgacaccaccacttctatcaaaatgtactggatgttgggttttttaattaaagcaacttcactttaaaatgtggttttacacacattcaaaacactgctgaccctctttcctcagctgccattaaggtgcttagcccttccgaggaagctaaggccttgtgaagctgtcactcattgggtgactagcaccctgcccggtggcaccagccccgcactcgcccacaccatggcctccatctttgtttgagctcacttgcatctactcggccctcattctacagtgcagtgtggtgaccatcacataagaccgtcgccctcattaaagcagctagtgtaaatggtgaaacttttgggcctgacctgtttgcaagggcctggccagtgtcaacatcgggagcctttttggtagcatgggggctggtggacctgtacctacaggcagttctgcccctgtaccatttccccagccagagtcaacattgggaacctcctctgcagcagcatgggggctgctggacctgtacctgtaggcagtcctgcccctccactgctgccccagctgagcagaaggaagtgcaagcaaggaaagaagcatctgagggatctacttaggacacgggctttaatctttttgaagaaacctcttttgtaacatgatcagtgaaaagctgaactcttggctgggcaccgtggctcacacctgtaatcccagcactttgggagtccatagtgggaggatcactccaggccaggagttcaagactagcctgggcaacatagggagaccgtgtctctacaaaaaaaattaaaaatcagcctggtgtggtggcgcacacctgtagccccagctacttgggaggctgaggcgggaggatcacttgagcccggggggtcagggctgcagtgggatgtgatcaccctactatactcaggtgagaccttgtctcaaaaagaaaagctgaactcttaaaacgtgcacacacacagtcagctaacatcttcataactgtcagattgtgacaatttgattctaactcaagatcagcctttcttgtagtttattttgtgtctttaaggaactagcctatctaacacaaaacactggctttaagttttttctcttttttgtaattgggaataaaaattatgctcaagatacatcaagattagttttggagaaaaaaagcattaagtagattcagttgtgcaagatgcacaaagtgtaacttcataagtaagcggtcacaaactcgggttcataatccgttacccaaaatctatggagccagatgtatttaaatataggttatttttaaaaggtattagaattcatatgttccatgacacagaacgttctcaggcagcacccgtaatcaaatccattagtatttctatagggaagtgcttgaagagtcgcactaagtatgataaatgtggaccattaaaaccacctcatgctagcccagtacagattttgcagtgttttcagaagcttttgggttatggaattgggaacagaggctgtgtttgttcctctgcagccccggcaattaagaagtgtttgtgaagctggtttaatgtgcctagcaggtgtgatgtattggtgaattccaaataattgatagttttgtttgcttttttttttttttaagcaaaatatttggtaggaggcactttagtttctcaagttcaatagctgtttgctcttactggagcgttgctgttaagggagacagcagatcttgtcaattccctataactcacggttaacaaaagcattccctaatgattccatatgttgatgctcagaggtaattctgggccaagcgctcagagcacaacacagattatttcactccatggacgcaaccgcctagaaggtgtgtggcatgactacatcattaggatcccattttagaggtgtgcaagccaaggtccagcaggcttataagacctgcagtatgaataggatcctcattttataggtgctttacccaaggctgctagcttccagagtttccggctagaaagctgcagagttggggtttcccgaaagaccaccaggctttagaggacctggcttcactgcctgggctgcctgccacctcccacacctaaagcatctccccccgccccaccccacccccagctttaaggccacccccgctctgcaggtcagcggctattaaatacatttctccaataaacatcgtatgttagacaggctaagaaacttgtcccagggcgtgcagctgagctgggagttttctgcaggtctcttgggtccccaaagccctaggtcttgtatgaacatgagggtaggagcaaaatcaggccttcccatgtgtattaatgttactctgttctcacactgctataaagaacttccctgagactgggtattctgtagaggaaagaggtttaattgacccacagttccacatggctggggaggcctcgggaaacttacagtcatggcagaaggggatggcaaggcagcaggagaaaggggcaaaggaggcacttgcaaacacttataaaaccttcagatctcactatcacgagaacagcatgggggaaaccaccccaacgatccaatcacctccctccctccacacttggggattacagttcgagattgtcaggcctctgagcccaagctaagccatcatatcccctgtgacctgcacgtatacatccagatggcctgaagcaactgaaaaaccacaaagtgaaaatagccacttcctgccttaatggatgacactccaccattgtgatttgttcctgccccaccctaactgattgaccttgtgacactccttctcctggacaatgagtctcagaagctcccccactgagcaccttgtgacccccacccctgcccgcaagagaacaaccccctttaactgtaattttccactacctacccaaatcctataaaactgccgcacccctatctccctttgctgactcctttttcggactcagtctgcctgtacccaggtgattaaaaagctttattgctcacacaaagcctgtttggtggtctcttcacagggctgcatgtaacagatgagatttaggtggggacacagccaaaccgtatcaccatatgtgcttcttaatgacagttggctcaaggtgttttccccgtaaataacgcaactcacagttataaaattgaagataggtccccatttgcatggtaagcaggtacagctccctgagagagcagttggggagaaaccctcgctttttatatctttgttgggtaaaacatcaaccactgtgcctcaggggcggacttagtgagcatttaagatacattttcagttataaaatgttacttgatttgcagcaattacccagtctccgccttagacagaaacttagaggccatcggcctagacttcctccaggcacagggcttccataacagttgaattaatttaagccttaatgcctcccataagcccccgggaactcaggctgcctctgaggatgaaaacacccgccagtctttgggccccagcctggggcaccctgtagcttcttcagagcttccacctccctgccaggctctccccctccccatgctgcccttgcagctactacagaagctgctctcaacatgccacacagattccagctgggaggaggggagtggtcacagtcacaagggatattttctaattctcctaaggagggtagtagtgtatgtggccctagcatgttaaaaacaatatgacctttcctggtaaaaaggaccctgaagcaatgttaaagctgcaagcttgttagtaagcagggaagaatatccatctgatggccctagtgcaagtgttttatgctcctttattttatttcagcatttttcctttcacaacgctgtccctttaagtgtgccatcatcaacagctgtagttatcatttgatctgaggagtttaattacttgtttagatcctttcttattccacggatttaggattattttatctaaatggtgaggaaaagtgtctgtctgcacagtcccctacagatttataatcccacagttctgtgtcttttaaattaaaagctccatgacattttaagctttaaataaacactgttggaagcatttttagaggatacagctgttttcctgcctttgtccacactcctttcttcctgttcgcacactcgccttagtcagagttccacggagcacctccatcgtcctgcctgccctctgttctgttccttcactcggcttttcaaacccgacagtggtgtctcacttgttcgatgcctgcagtttccttttgtcaatcttcctctctcaactactagaacaaacactcaaggaagtaaaatgtgccgcctcactgccaatccgtccatctccttgccctgagagccttggctctttctccccctcacagagaagaagaaaataaaaggagcgctcatgcctgggtaaccctcccttagaggaggcttttcaccactcagctgttgaggaggagggtgggccagcccttccttctgttctgcagcttctgtagggagaccgagtgcaggatggaatccaggaagccttgagttactcaggttgttacttgaacttcgacttctacaaaccagcccagacttttctaagagtcctgtcttttgtactctcctaaagggctttgagccctccattcagggattgggccttcacagtctgcagtatccagaacggtggaggttctgaggtttgtttggtgtgttttacagcaaacttaataaaatacagcttgtggccaggcgcagaggctcatgccttaatcccaacactgggagaccgaggctggagaatcacttgaggccaccagtttgagaccagcctgggccacagggcaaggcatcccatgtctacaaacaaaaaaataaatgaaaaaaatacagcttgtggtagaaaagcaaggagaaaaatattatagtgctgaaaatgaaatggcacctgcagatgcagctgtgggtggatttgccaagaaaagcagagaaagaacagaggagggctcttcttgttgctgttagcagtcaaaaccagagtatccatcaggaggtggagaagccaggggtcttctgcagggaagagggccacagagggggtcagtgcacagggggaggaaggaagatggggagtgcagggcaggggccacccaaaagcccaaggaagagcccagtccacaataaccagcctctcctggtctccagtgtccacagggtggactgggcccagcctcagccccatcccaggaggaagagccagagagttccccaggcaagtgcagtgagccctgggaccaggagagaagcgtgcacagaggcaaagtccacaccgtggcagccaaagcagtcagtgagcccagtcctctgagtataaggcggcaagagccctagccgatgctgcaggtgcagtcaagagatgcagtttggatgctgctgaaggaacatgatacagggccacacggaaaactttttctcaagacagcagcactctgcccttggttcattcaggaattttgcatataggtggtggatatgattgactgcccaggccttgtgtctacacagatgaccattcaccttctgtgagaaagatgcaggagacaaagcacaggtggccctaccattgcagcggctcacaagagaccttcccggcctcctccatgtgtgacacagcgaatcctgccgtgtggtgcaggcagctctctgcatgcctatctgggaggagcagatattttggagttaaaacctgccctaactctcttttttttgaagacataatttcgctcttgttgcccaggctggagtgcagtggcacgatcttggctcactgcaacctccgcctcttgggttcaagtgattctcctgccccagcctcctgagtagctgggattacagtcacatgccaccatgcccagctagttttttgtatttttaatacagacggggttttgccatgttgcccaggctggtcttgaactactgagctcgggcagtcctcctgccttgacctcccaaagtgctgggattataggcgtgagccaccgcgcccgccccataactctcctttagtcgcagttcataccttgccaactttcaaaacacatcgaggcaattacagacaagcatgcatacctatgtgcatgtaagcatgtgaacatacataggagtatgaagacttacatgcctcttggatacacatagccttctctgtgcgtacacgttacttccctcagtgtgtcctgggtctcccagatactatcttacagggaaaaaaactagtatttagggatgattattgtatttgtttatgtcattgtgggacagttaaaggccattgagatcgcctgctcttttcaggacttcttgttgggtccagctgtacagattcaaggtagactacgtcctgctaatgctgctccacaccctgtgggaaggtttcagtgctaaatctagaacaggtggtcagtctcctaactgaatttgaatccagatttttgtcagatgcatccgtgtgtcttcttcttaaatcagttgtgaacagggctatttccagcctctcgggttcagggactgcctctgtgccaccgcagactggaagacaaggactctgcccaggccttgggatagccttctgccttcactggggccttggggggattgtcatcaggcaacactcagctccatggagcttacctgggtttgaaattccacttggtagacattcctctgtgttgaagtatttctttttttttggcataatgcctcctagcaggtcagttagttggttcttcagtaaagtaatctttctaggcccacactggagacagagtggggaagacagctagtgtgtaacaagcatgctctaggaggctggcactagaatgttacttatgtgccctgaaatattcattctgtaaagtaggattatttcactgtagtagcatcctcagtagtattcttattggtaatatgagtgcaattgatactatgtatatattaaatatacatacagaaaaaacacatgaatagaaatgggtgtgagccagtactagttattatattgtatgtagtgtaatctagcgtatattagtggtactggtactattattagcagtattcctgttcatcttgtgtaagcgtgaggaaagcaggcacctgcaggctcactatgtttctgaggctgtgccctgagtaagtgccgagccgggagttaattctcaggtcagctttcaccatcccgtgacagcctgtgcattaaatgttctgttcttacctgggagcttcacagcagcatcctggccaggcatggtggggattcatcccactgggcagtggaaatgtccttaatactagtgggccatgcagtggactttgtcagctggtgctggcttccatgttgttgggaacaccgagtaatgatgccttgtgctatcgaatggaattgaccattccaaggatatatttagattcaaatacgtacatttaaacagaaaacacaataatacagatttcatttctctcctgagttctgaatttccagatcacaactccagacataactccagcagccttgagaggaggctgcccatagtataatttagtgagaatgacctgcaagcctttctcctgttcacttaggtctccacaaaagcctttgttcatggaatgagacctacacagtgtatgtttatgcggacctgatacaaacttactgttcatacagtatgcactctaaaaatctcttttttttttcctgcagatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggtgcggttgcctcgctgtttgcagggttatgtttgtgactattagcaatggttttgtaaatcacctttaaagtctagcatagggcatgcttagtttgtcctcttttcttcagtatctaaactaagtccctcctggtgctcctgaaagagtttggctgatgctgtgggatgctgtgattcaattttctctttaaaagcttcttaaaataatatgcgttagtttcagtgatttctgggttccaaaaacatttgagtattgtttatattactatatataaagattatgttaatgacagaatgtcttcaaagtttaccttaatagatggttttgcctttttcttttcaaaatcagatataggattaatatttcagcaactattcaaactttaacaaattgataagcagctaaatctccccaaagacgcttaattaaaaaaaaaaaaaagtaaaaagtcgaattcatttttagcctgtgtgtttatatgccgttcagccctttctttacttgtatccagttttcttcggaaaggaaaaacaactttgttccctccgtgcttgttaactgacattcaatcagaacgggcttgcctgacgctccttgttcaagaatattctagattacagaccttgaaaatagactatttgaagatttttctgggatatacaggatgaatactctgtctttagaattcctggtgctaggggagaaaaaaaacagcagttatgtgagtaatcttggatttaaaatgatattaatatgaagcatacctacttttgaaatgtatgttattatttatatttatacatatgtccaaacatgtggattgaccattcctgggcagcacacacacacatgcaaacacacaccctttgtaatcactctgtctgcatccactgaaaatggtagtgtttgtgaatctcaggcatgggtacgagcatcgtgatactcagttctctgcatctagtgtctttctgcaccatttgcacatgaagttaccttgataagtcttggtgaaacacatccatacagttactatatacaaatttaattgtggtaggacacagacacacacactaaaatttaccattttacctattttaaagtgggcagttcagtagtgataagtctattcatgttgctatacaattgacctccagaactttttcatcttgcaaatctgaaacttcgtgctcattgaacaagtccccatttcgccctgccctcaacccctggcagccaccattctactttctgtttctaagatttttactactctccatacctcaaataaggagaattatgtagtatttatctttttttgattggtttatttcacttagcataatgccctcaaggttcatccatgttagagcatgtgataggattttcctcctttttaaggctgaacaatattctatggtatgttagaccacattttgtttattcatagttcatttgttgagggacatttgggtggcatccacaccttggctgttcttgtgaataatgcttatataaacatgagtgtacaaatatctctttgagatcctgctttctagtctcttgggatatacccagaagtggaattgctggatcccatggtaattttattattaatttttgagtgaccaccatattgttttccatagttgttacaccattgtatattcccaccaaaaatctataagggttccaattactccacattctcatcaactcttgccatttcctggatttttttgatagtagtcatcctaatgggtgtgagttgatatctctttatggttttgatttgcatatctgatgattggggatggcaagaatcttttcatttgcttgttggccatttctgtattatctttgaagaaatgtctgtgcacatcctttgcttatttttgatttttgtgtttttgtttttatgttgtaggagttccttatgtattttgaatgttaaactgttatcagacatatgacttatgaccattttctcccattctggctcccttttcgcttagttgttggtgtgcataagtttttgattagatgaatttgacatatgtcatctcatttgtctaattttgctcttgttacctgtgcttttggtgtcatagccaagaaatgattgccaattccaatttcatgaaactttaatttatgttttcttcctggagttttagttttaggtcttacattcaggactttaatccatattgagttaattcttgtgtatggtgttaattagaatctagcttcattcttttgtacgtggatgtccagttttcccaacactgtttgttgaagagacttatcttttccccattgagtagtcttggctggctcgttgaagatcgtttgacaaatacgtgagagtgtatttctgggctatctattctattctattagtatgtaggccagtactgcactgttttgatgaatgtagctttgtaatatgtttggaaatcaggacatgtgagacctccgattttgttctttttcaagattgttatggctatttgggatcccttgagattttttatgaattttaggatgtatttctctgtttctgctcaaaatgccattgggattttgatagggattgcattgaatctgtaggattgctttgcatgctatgaatgtcttaatattaagtcttcccatccatgggcataagatgtctttcaatttatttgtgtctttctttcagtagtgttttgttttgtagtttcagtttataggtccttcacttctcttatttctaggtattttattcttttgatgctattataaatgggattgtttataattttctgttcaacttgttcattgttagtatattaaaatgcaactgatttttgtttgatgtgtattctacaactttgctgaattggcttattggttctaacaattgggtttttttttttaatatgttgaattgtagtgatttctatatatatgatcatgtaatctgtgaacaaagataattttgtttcttcctttccagtttggatgccttttgttgtgttttcttgcctaattgcctggctgagacttccattattatactgtctagtagtgacaagagtgtgtatccttgttgtgttcctgaacttagaagaaaagctttagtcttcattgagaatgatattagctgtgaacttctcatatatggcctttaatatgttgaggtagttttttttttctatccttaatttgactgtttttaatcgtgaaagggtgttggagcttttcaaatgcgttttctttctgcatcaattgcggtttttgtttttttttttttttttggttccttattctgtaaatgtggtttcatatgttgaaccatttttgcattccaggaataaacttcacttgttcatgtatatgatcctttcaatttgctgtggaattgtttgctaatatcttatttagactttttaacctgtgttcatcagggatattgatctgtattttgtttttcatatagtgttttccatgtttggtagggttctccagtgaagccatctggtcctgggcttttctttgtggggaggttttcttttattactgattcagtctccttactacttacagatctgttcagattttctatgtcttcattttttcccccttctcaaaatcatcagggattctctgtcttcatgattcagtttgggtaggttgtgtgtttctaggaattcttttatttcttttaggttatccaatttgttgtcaaaggatatgccaacaaatagtattctcctttatttttgtggcattggttgtagtgttgccccttgcatttctgattttagtcatatgagtgtttttgttttttgtttttttagttaatgtagctaaggtttgtccataaagttactctgtgactgagtgtcttttgtgactttacaaagcactcatgatgtatgaggcatgcacgtgtcttatttcttccatatctacccaagcctttcacatggttttctttctacactttttgttctatattctaagatatacttgaaatatgttctactgcaattcttaaaaagaaaaaaatgttttatctagatagtctggtagtttggctggagtgctagtgaatctgttttatggaatctacttggtgatcccatcaacgtagtgtcttcatttggctttctaagcgagcaggtatcagattaagtaaggtgccaatcatagaaactcatagaaggtgaacaaccagccaggagctagttcttcaaagatagttcagtcctatagaacttatctagatggctctcttttctttctttactactttttgacctctttaacttttttttttttgacttgacaaatcatgttttttggcatatgatttgtgtgtgcgcgtgtgtgtgcacacgcatatacttattttaacttttactagccgctcagttgcgagtagggacttcaatactgaaagtctctctttgaaaatgatcatatctacatgccatatacacaattagctgtgctttgacagagcagagcatgcagaagacttgaagagtatacagaaatgcacaaggtaatgctggagagaagaaacttaaaatcatgctgggatgctggctcagatgatgtgcagggacagtggtcagatgatgtgccgctttggtattctgaaacgagttaggtgtaggataagacaaaattattagaaatcatacttaacctgaagggaaagcaagccagaggaggacaatgttggactgaatgtatagagcagaaagacaggccgtgcctaattccaatccagaaatgtgttcttccttagggtttctgctcaatattataccagtcacaaaaatgaagataaaatagctcttctgtcctgaaagaacattcttggagacctagtttccattcattttgcactcctcccatctcctcttttatctgcgccaaacctgaattcccctcggaaggtgaccttatagcgtcattgctctggtgactagattcagagaaacttgctgctgtagtctttcttctaggtgttcattttgctcacttactactttgttcctgttcttaaggtgtagatgataatataacccttgactttgtttcttttccttctggaagtattttctggtagggtatgttaggttgtggaaatgaccttgagctctttagaaaagaaagctgtctgtagggagggctttttaattcaacgtcattctttttcacatgctttcagagcgacagccgaacccaaggaggtatttagcaagttaaattgccggagtgaatggtagattaccaggggaagcagcccctgatcatgctgcaggggctgtgtgctgtgattaggctgcaggagggtgtctgcttgggccagtcaccagggaatcagcttgattatgctgcagggacatgactacctgggccaataaccagggaatcagcttgattattcttgggggtgtgtctgtcttggccaatcaccgaggaatcagtccaattatgctgcaggggtgtgtctgccttggtcagtcaccaggggatcagcctgattatgctgttggtgggtgggtggtagggggccggggagggggacgggatggggtgaggtgggggacggatgggtgtctgccttggccagtcaccagggaatcagcctgattatgctgcgggagtgtgtctacctagaccaataaccagggaatcagcctgattatgctgcagggtgtgtctgccttggccaatcaccagggcatcagcctgagtatgatgtgggggcatgtctgcctgggccagtcaccaaggaatcagccccctgattatggtgcagaggtgtatctttggcttgatcatggtatagaagtgtatctttgccctgattatgaagcagaggtgagtctgcctggtcatggtataggagggctctttgcctgggccagtctagccactaagaagacaaggtggacctaatggacttgaaagacgaggcagagtggccctgatgcactcgcacatcagctgcctatttgctatcatcacatttctggaaggccctctctatgaaaaggtgggtgggcctacgatgtcctcagtgggaaatccttttgagcagttagttctgtaggcatttcttatatggcttcatggttccatgtaaactgtcggtcagccaaggcttaaattattttaggaaaataaacttttaaattgtggcacaaattttagaggaaaaaatgcatgtggttcatctcttgtgagttttctagggattttaaaaataggtaccgtattacaactggaaatgtatgtcacattacttaaaaaaaatcttcacttaggatatcagaaaatcttgtttaaaacatagcctatgctggttacctccattgtatcttgaacaaatcctttcagtaatgaattccttgggacagatgaaattctacatttcattataactcagcgagggtaatttggattcaaagaccaataagaagaaagttggtgccttttattgtgtagaatcccccaggagttttttctgttgtcccagctctctgctttcccatgtgttttcactaagcatgagattcctagaggaagagcccagggcatggtatctgggccagtagaaaggacagcctgccttgcagatgtgctcctcagcctggccggctctcccctgcatctcttggccggctctcccctgcatctcttggccggctctcccctgcatctcttggccggctctcccctgcatctcttggccggctctcccctgcatctcttggcccttaccgcctgcaccaggctctctggtgttaacttcctgccctctactttccccctctcagaccatctggagcagaaaaagcaaactagaaccctggccccctggagagtcgtggatgggtgccagagctccccttaggtggctgaggggagggagcaggtgtggcctgtgtggtagaaaggatgggtccagtcacagctctgcagcggagcactcctcctgctgtccagccccagtccccttaggacagtaggagtactgactgacatgcccactgtggggtactatgatctgaatgtgtcccccaaatctagtgttgaaacttaattgccagtgtgataggattaggatatggggccttcaggaggtgattaagtcctgaaggtggagcctcatggatgggattagggctgtcatgaaaggactagagggtaaggcctgctcttccattcctctgtcacctgaggatacagcattcctcccctctggagggtacagcaacaaggtaccatcttgaagcaaggagcagtcctctgcagagacagacctgctgatgccttgatcttggacttcccagcctccagaggtgtgagaaatacatttctgttctttacaagtgtccagtcccagatattttgttatagcagcacaaacagactaacacctggggcattgctgtaagacaaccttggagcatgtgtggttacacctggcccagtgagtggctcctagcaggcacttgtgtcatctcctaacccaggaggatccagtcctcaccctgaatcccaccttgaggagttagtaaggtcgttctccatccctgctcggcttcgttgaaaagcacacaccagccatgacatggacaccatgcacatgacatgggctctagtcctctttctgtccaagctgtgtcttcctcttgtaagtaagccttcctcctcaggctgacttaggtaattatggttgtttccatccttctactttttttctttttaattttgttcttggtttattttcttacaccgttgtcttcctggctgttaacagatacacccccaccctttccattaggagcatctggcaggaaggcactcatcctctggaagtcagctaacaacttgcctctctttcctctgaactctcgtgcatgtagtgctgagtgagtgctcggggggacacaggagaaaggtctctttcctaatggagtatgtcatccatttggggagaggggacaggcatatctgcagcatccaagtgaaaacccgtggtaggatattgttgcacagcaaaatgagaaattcaggaaagagatgccaaagggatgtagaattaagtaaagcaagatattcttggagtagtggccgctcctggggtagggggtgacctcgggggagtccacaagaacagaagagatacagatgggagaagccatttcaaaaggaaaacagcacctgtggaggattccagtcagccagtgagtttgcttctatacagcatgaagccaagcttctcatggctcacaagcttcagagaggaattgtggctctatgagttgagcttcttattccccagctcatctgtttgctttctggatagggagaaccattgggatttttaaaaggaggcgtgtcagaatgcaacctgcacttggggagaatcctctgggtttgtggcacacaacgcctgcagcctagaagagatgggccagaggaaggccagggtgatggtaaaagacatgcaccccccttgactgggccatgaggtgtccagacggaacattctttggagtgtgtgtgtgagggtttttctggaggagattagcatttgaattggtggattcagtaaaggagattttcctttccagtgtgtctcatgaaacacatcatttttcgcatcatgaaatttgtcactagaggaatgaaaggatgatcttaagtagggagaatatcccttcaggataaaaaaaaaaccacaatcatgatatgcttttttttccattggagacacagtctcattctgtcacccaggctgcagtgcagtggtgctatcatagttcactgcagcctcgaactgctgggctgaagcaatgctttcacctcagcttctggcgtggctaggactgcaattatatgccaccacacccactaaggtttttttctttttttctttgtagagacagagtcttgatatgttgcccagtctggtctcaaaagttctacctcaagcagtcctccttcctcagcctcccaaagtgctgggattacagacatgagccaccacactgggccttttttttttctttaattacacaaattacacttgtttcacacggtacaaaaatgtatagcattaaaattggaagcccttctaactcccactctcctactccctggagataaccgttactcagtgtttaactatttaaggtacctcatttcaccccttgtcttatgatgcctatgtgtttgtgtgtagacccacaggcacacagagatatgctcacctacactcacctacatgcacctttatggaatgaggccgctgacataattcaccaagatccagagcaagtacctatagattaatgggacagaaatcccaaatgctttaattaaattgttagtcaattttttttttttggaagtaggtctaacaaaagtgaggacatctttttcctagctcttaaatgaattgtcactgtggatccctgaaatgctggacatcccttgggatgggaaggcactcagagcacttcctgcctgggagcacttacaaggttgcattagtccatgcagtgctaacatgattcttgtgtcaaggacagcttccagaagacctcagcaggcaagctgtgctgctttggtttgtcctccttagtgatggaggtattgtgctgtccacacccttacagtcctgtagattttcatatgtccacactgacacagtcacatctcttgttccgtctcctgtgccagtggcttcagggccagctgttacctttaggaaccaggaagcacccaggtcagcttccaggccaagaaggaagccagcagaagaattatagcccttggtttataggccgctctgataatccattactttctaagtctgggcagcaggcctcagtgttgaggggcagtataacacctaggtggcaggagcctcacagagaagagggacccatttgtgtacatggcacaaactgtgtctccacctgcctgtcattcctggcctatcctcagccagatttcacagctcggtgctggggctatgccagttagatctacccagggtgttggggcttcgagtctcattaagatggacagtgcctaggaaccccagaacacattctctgtgccatgttcaggaaacatgcacctgaagggtattcatgccacttttccttgttggtgtccactatggtcgtgttggctcacaagcattgaggactcactgcatgtcatgctctcagtgctttcactcgtgggggtatgtgtcagcctcctgccgccgctaagaagcagtcgctcttagcacagggaatggcaggtaggactgcaggggtcaagttacttgtccaaaagcttgcagcctctgattatggaggctggcctcgaacccaggtggggaatgaagagtccatagctcttagccacggcgctctactgccccagatgatgtggcggtgaccttctgttgaggtagacaacatcagagtacaaaggggagaagatgtgttctgacacgggtcacagggctgagccctttaaggccatatataacccatgtggagaagtccccagtgctcggggactctgcctcgtccagctccgtttctggtggtggtctcgatttggggcactcagctgattctcagtcgctggagaggctctgctggcaaagctggacctcagggatttttacttaggcagattgtactccttggataacagcacaattaaaggacacacacaacaagcgaaaaggaaaattgtacgctgacagtcatggtaacacattcaacttacgctgtgttccttttccgtttaacaaatcgaattagccccatgttcaggaaaatttatgatcgtagggaggaagaagcccatttgccagtcaaatgtaaatgtaaatgaaaattcttaccccccttttcctttaaagtatcagcttattggccaggcgcggtggctcatgcctgtaatcccagcactttgggaggtcgagacgggcggatcacgaggtcaggagatcgatcgagaccatcctggctaacacggtgaaaccccgtctctactaaaaatacaaaaaattagccgggtgtggtggcaggcgcctgtagtcccagctacttgggaggctgaggcaggagaaaggcgtgaacccgcggggcggagcttgcagtgagccaagatcacgccactgcactccagcctgggcaatggagcgagactccgtctcaaaaaaaaaaaaaaaaaaaaatcagcttattcaatgatgtatatggacattattcctcttttctgaatatagtgactttcataggcagctaattgccttgttatttagtaaattgtaatgaagacatcctagactaaggagaataagatacaaatctttgcttctgatcatcctagatattacctcactgcgcatgtggagatgtttctcaaagaattacaatttatattttttgctttgtttgtttgacacaggatctcactctattgccaaggctggagtgtagtggtgcagtcatggctcactgcagccttgacctccctggctcaagtgatccccccaaacccaagcgatcctcccaccttggcctctcaagtagctgacacttcagatgtgtgccaccatgcccagctaattatttctttcttttctgtagagacagggccctactatattgttcaggctggtctcaaactcctgggctcaagtgatcctcctgcctcagcctcccaaagtgctaggattacaggaatgggccaccacacctggcccagtttctgtttctaaatgtgtggtggttctcctgtggatttctaagtctttaggagtataggataatgaacaagagaaatccttacctcaaggacctctcgattcaaaggagaggaaatgagtagataaatgaccacaatgggttgaatcaagtcactgtccctccgggaggggtgtgctcacagcataggacagcactgtggagctgcacagacaggctttgaggggtgttaggtgccagcactctctgcacactgcagtcaggacgagggagtggggagggcagtgacttttaggtgagcatccaggtgtagagcgctgccagcttgccccgagtcccagcacccgctcacagcctcctggcgccagtagtagaaatggttgcacaaagcaaccaatgagaaatactttcagttttccatctgccacacagagaaggtaggagaggcttgcaaagggaatagcatccagtccttttgttacttgggcatggaaagttggggttttccttttgattgagttctgggaagtcagcatgaatcagctttcggttccctgcctccagaccctattctcctgcttcagtatgatgtccctagagttgtcaaatccatagaggcagaaagtagaattgtgattgccaggggctgggggagggggatggaggttttagcatttaatggggacagagtttcaccttggggagatgaacacgttctggacatggatggtggtgatggctgtacaacaatgtgaatgtactgaatgccacagaattgtacactgagaaatcattaaaacagtacattttatattgtaggtgttttaccacatacaacaatagttattctttttcaaatggcaagaagccattcaaggattttggagttgtgttttggcaaagctcctgtgcagatgaggtagaaagcctgtagtgagtagacacaaatgtggtttttcacataagtgttgtggataagtgcatctccttatccccaacagaatcatacactcttatcagggaagacaggtgtctctcatacgccccaagcacctgggtcatggggacttgggcccagtgtcatgggcaggtttgagtgaggtcaggagtacctcgcaccacgcctactctcttgaggtggtttctgcaccacttctatacggtgggacctttcatctccatagcatggtagacacaagaatacagggaaagtcttactctctcctttctagaggattccttagagagtagactgtaagagcaagactttaatatttgagactattgacagagacaccatcaacagaaactcctcacaacaaagctctagccataaaactgaaatttctatgaaatatttgcaaaaaaaaattgacaataggaaactatgatattttatagtaagtagtccacaaattaggttaagaactttaaaattagtttgggattactataacttaaagtattctgttatttttgtcttattgttgaatgcataaggcaaaatgaatccatttttgatgtgagttatttaaaagaagaatacttttctgttacctcttatttgtgaagaaattgaaaactgaaactctttcccaatctttatatcatttgcacttttatgtttgttttgtgacgtagtcagggttgttcttatttgcattatgtaggtgaggatacaggttcagagaagtgaaacggagaaggagaagtttgaccctggccttgtaggccattaccaggctgcttttattgagaacctcaggtatggcattctctacgatgagttaaatgccttcttcagattgggttttataatacttgtgcttgtttaggtaagagaatttacattgtttaatcacgtagagagctatagtagaaaatcaggaaaattgaatgagctattatgttaacatttcctagtttgtatcttttcctttggctattaatcataagctatttaaatagctgttttatacatttattttgtagtgatagatccttagaagtagcaacccgaaaagtgattcaaagtaaatgaaattagtactgtaagcagctttctggcaaatcaaagaagacacaaaatcaaatatttttctgaggatggtcagtattttgagatagttggtcaggttctccagatcttaagaaagccaatgaaagaaaaagtccatttaaggccgggcgcggtggctcacacctgtaatcccagcattttgggaggccaaggcaggtggatcacttgaggtcaggagttcgagaccagcctggccaacatggtgaaaccctgtctgtataaaaatacaaaaaaaattagctgggcatggtggcgggcgcctgtagttccagctacttgagaggctgaggcaggagaattgcttgaactagggaggcagagattgcagtgagctgagatcatgcctctgcactccagcctggtgacagagtgagactctgtcttaaaaagaacgaataaaaagtccagttaaatgtgccttccctttgagtttccagagctttccacattctagtgaaacctaggagacctgagttaccacagtcaagtggtgaactaagtgtgtcctgatcagaacaaaatactgttcctcggtatctttccctttcttttttatttaccattgacagctggctacagagatcatataatctccagaaagaatgctggtatagcttctgtgaggacaggaggctcctgacgatcataaagtctttttcatggagtcaccattgaccctttggaagtgttcagtgccacttctttctcatatcaacgtaaaactctgcaaagtcatctccttctcatctgttacataatacaaaagaatgcattttacttgattttcagggcaaagagcagattctgaaactgatagcacatttgcacactgaactcagaatttgccagtggtagtaacctttgtcacatggcggggagcacaagattgtgtctgattgtgtctggcctggttggggtgaagtcggggctagtgggtcgcttacatggtagcctccagcctcttcattgtgacaacacaggagcttctggtgttgaaactgcctgtccctgtaagactgagatgagatgtgaggcatatgatcaaagggtcacttaccagctagctagggggaagtggacatttcctgaatgtcccacattttagaaaatagtacgaaattcccaatgcagatactgtctgggttgtatgagtcttattttactgagttttctttgtaccatgcacagcctattgtaagcgcaatttaataaggagattttaagcatgttggtatatcaaattgatttgatctttatatacatcctttttgtctattagggatttatatgaattcaatttcacagggctaagaaaaatttttttaaatttaaaaatttctgctcctttggttgcattgaaatggtgggtctatggctcataaaatattctatgcatggtaagctaaaatatatctgtatttggatttagctgcataagtacaggaactgaacatcagactttaataaacattaataaacccttatgctatatgtttttcaatgagttattatatagtatatataatatttagatactatatatactttaaattctcaacattgttttgataatttgctctaataacgctctaataatttgagcacttgtagagaatatttagttaagtggttaatggaagaaactcgttggggatttttggattccgtttctaggagggcagttctctcatgaggtaaatttcctatctggtctgtgcatgaatttcttgaagaactgacaataattcttcctattagtgtcacaggcaagggggcaaaggggttaggtgtcaatgcctggctgatttcctgcattacaaaatttacctcttacttttctgtcttcctgatgttaccccctcttttctttcacctcttgggcctgcacatgatttgtttgctatcaggggccaataagctttctctgtgttttcagctttacagaccccatggtatatgtgtgaagcctttagctttgctgtgttaagaagcaagtagctgtaaacagtgcgtgagtgggtgctggtgctgcactccagtcaaactgtctctacagacacagaaagtggaacttcatctcattttcacaggttataagatcatattttttgactcttttcatttaaaaacaggtagtaagttgaatttgtgtttcaaaaaaaaacaaaaggcaggataaaacgaagagctaaaacaccacagagcaggttgaaatcccggatgtgaagtagtggagccattgggccctccaccccaagctgtgcattcagaatgccacctggggcagaaaacaggtttatacacagagccagagagacttcagatctccggtgatcaggcacagtggaggacgtagataaaagatccctgcaccctgcgctgtgagcccaccaggtcccttcacctcactctcttttatgcacaaccaaaaaagatcctggagaactcttctctggggaaggaagttacctcatgacaacaactcttaaacaccaacatttcgaggcccactgatggaaaaactgactacaggtagtaacttcgagtttggagaaggctcccacctgtgcccccaggtggtgctgtgtagcttactgagaatctgcctggcggctcagcccccactcttctgttgtggcaacccacatctgaaatgttgtcctctggggaacatgcatcctttccagacactcctgtaatctatatatttgttcctccctttcaagaggcttagaacttaaactttggttgtcatttttgttgatattatgctgttcattcctagtatagccgttttctaaaaggagagagaagcaaggatcatggatcagtagccaacgttagagtcagagagcagtttgcatgcaggttgtcacagaggcacatctagaacacaaggaaactctcatgcattccatgtgcttattaaaagggcattatactgcgaagtactagtctaataattctctgcaagggatttaaaaaagggatcaggggttagtactacttgctagagtcagagggcaatttgtatgtaaattgttacagtggcaaatctggaacacaaggacactcacatgtatcccatgctattaataaaacggcattttattgtttaagtcctagtctagtcattctttataagggaaaacaaggatcaaggatcagtacaccatgctatagtgagagggaaattttcacgttaagttgttacagagacaaatctacagcacagggaaatattgagtcatttttaacattaaggtgtcaagtcctgcctggaggaggggcacttagggtcagtaggatcaggtggagaggcttttcttctaaagtcctagtgcttagcagaggaatgagagagaccattcagtcccactatcacattgtacacctgtagttgcagcactgtgggaggccaaggtaggcagattgcttgaggacaggagtttgagaccagcctggtaaaatcctgttgctacttaaaaaaaaaattacacgctgtagtcctacgtttacttcataaaaactaatgtagaaatgcaaaattaattttccttaaataaaatttctgcattactctctatattactttgtctcttttattttcaatggctgaaaaaaatagttttgttttaatttttattatttgatccatccttaattaccaggcattgatcagtggtttgaattgccctccctggctttccattttaatctaaaattctgctataagtctatgaaattggaccagaacacaagctgtgccatcagtgatactgataacgagattctagagaaaggtgcttctttggctggaggagtttaggccgatcacatttcagtgaccccggagaacattagacagcacctattgccacaaagcaagcagccagctgtgggtagaacagcaaaggcagtcggatgctcatcgcctgtattgccctgggaccagcagaccaaataaatgtaaactggactcttgcaactgtttgtttgaagatttgaaaggagttagtttatatttattttcataactgctttatttctgtcagtatttaatgtttgccaaaaaaggaaacacaggtttcccacactgtctccccatcaagtatcacaaatttgtgtgtcaagtaccagaatttgagaaagataattaagatggtttaaggtcatctcacagatagaacctcagtctatccaagttttctcctccagggtcaacccactgtattagcttcctggtagtgctgtgttaattaacaaactccgtggcttaaagcagcagaaacttaactgtctgacacctcagaaggctagaagtccgaagtcaaggtgtgagcagggctgcactccctctcaaggctctagggaaggatccttcctgcctcttttcagctgctggtagttgccggccacccttagctttccttggcttgtaccttcaactccccaatctctgtctccattttcacacgccctccctcgtcctgtgtgtctttgtctccaaatttccctctcctttctttggatttagggtccaaccttaatttagtatggcctcataataacttgattacatctgcaaagaccctatttccaactaaggtcctattcccacgttttaggtgaacatgaattttgtggggagagcactgtcaagccagtacacctccacccatactttcctactcccagctcagactgccactgttcaggttgccccaggagggccctgagctggggcgcggactcagtcagtcgtgtttggctggagtgttccatgaggttcagccagtcttgccagagccttgctcctcttccagcccctcaacccaattcctttctcctgtttcctttccttccacactaccacactgtcttacgtccaggatataggttagtcactcaattccataagccggatcctgtggtgcaaattccataagtggcgatccctgatattagctttgagttggtgccgggtccctagtaaattaggactgaagatctgcacacagccaagggccctctccctagcagcaagcaccttttcaaaagagcagaattcatttggaaggcctagaaaaaggaaggaggtgctctgccaaaatcaatgatgtctgagaaagaagcatgctccctagagcttggagaagatcagaagagggatagcctgaggcatggctctgcagtaaatcattaagagacgcccactcacagtggctgtggctaccagaggtttcctgtgagggaactaaaaagcgcacagtagtgtttgtaagtgatggttccattttaatagataaacatacagaacttataaaaaatcaagaatctatattagccagatttcctaaattagttaatatttcttttaaatttatacttaaagtcacagtttttaaaactatatatatgaatgtgaatactatatgctttggggaatttgactttggttattttctagtgtcaaggataaacacagccagacagtagttaaagcgatcagcacagattttcttccataatatactattgcaatagagaaaagagaccaatgtgaaactgggctcaacatcaattatcccagaggtgactgggcattttaaagggaaattcagggagtagggaggggtcagcaggggctcagcagagttggggaagtgaaaattgcagaaagcaggaagagggtttggtcagtgtgaagccatctgggtttcactggtgctgatagaagtcaggctcctgcccttccacagaggcttgtctgcaggagtggctggaaccaacaatcagttattttggcagccttgagttttcgtaggcaagtactttaagggggctagagtcatgtagcggtgtgaccttgagctgttgaacttgttcaagtctttataggccagtgtgggggccttgtggagaaaaagactcagagcagcctgagtagagtctggtccaggagacacttttgtcactgagcatgaccaatccatttatcacaatggtagcagcgtgtcctcatggaattatgtttccttcgataaatcttgaacaagaaataaatgcatcagcatatgtttttaaaagttaaacagatgttaaacttaaaggaagtttgctaaaatccatttcgtggacccctttgtaaatacctgacctacacagcttaccccttatgatttaaagttaacttgcatccattttatggaatcccaggtgcctgtttgacctgcagacatctttctcccttcttggtcactctctcagggcatcagctcttcacacagcaacagcttcctgcatgtggcccctgactgtccattgatgaccgaaggctcgtggacttgccaagttgcccacgtaaaacccagggttcagagagcgagacaagtccttgcattgtgaagtgccaacaattctagtattccaaagctcagtgttgttcagaacatggtacccttgtgagatcacgtgtgacatttgtgaagaacctggaactgatgtttccttaggaagcctcgcaacagtaagtgctttcagctcgctcaaggaacttcaagtaggcaagaaataagaatggaaaccctgcattactccatcagatcttgaaagttttctcttggataaatgtgcctgtcaatcacatcgaatcttatcccctgcctccatgtgctataccacaacagcgacgtctgctggaccgtgtgtgctctctgggtacacattttccaggaggcagcatcttattagagagtaacaggtctgtcttgtgtaaaggagaatgctaaccgcttcatgagaaggctccccaccatgaactcggataaccggatgctatttttttaacttatttattttttaattgacaaatagaaatcgtatatagttatcacacacaacgtgttttgaagtatgtatacattgtggagtggctgcgtcaaggtaatgaacacatgcatcatctcactttctcatcatgttttgtggggagaacacttaaaatctagaatctgagtgattttcacatagccaaatgttatttttaatgacctttgccttaattgtccattcaatatcggtcatagatatttattgagggcccagcatgtgccagccaagcgtggcctcctaattggaaacacaaaccctgagaaactctgagcattgttgtgtagtgcaggggccatcctcacacccccacagccagcattcagcttgcttcataagccatggatggagtcaaaggaaaactagctcaccttcccactatgtatctgaaatcactttctattccatgctgcacacatgtactgcaaggaaaaggaatgattcctgcccccaccactgccttccattcctaagaacagagaggatggagtacgaggatgaggaaaacagacggcaggaaataagcagtttattcactggatgtctgcatggggtcttgggagtgcagaggttgtgactcattcttgagtggaagtttctaaccacatacatacaaccgcaataactgcagccagctgctggaggtgttgtggtgaatcccagcgggttacaagggtgtgagaagcctggtaaagtttccaggaagtgaaagcacatgagctatgtcttcacccgcaaagatgcaggtaacagctcagattctgagtcttaggaagaggatggaggccggagggtgacagggtttctctgtagtcctcaggaagtgaaactgcctcacaggaaataaagcaatatcaatcaggcagtttctttctgtgtatatttgaatattgtcaatgttttaaaaatcacgacgtatttctttttttttccttctttttttttttgttgttgttgttgttgagacagtctttctctgtcgagtgcagtggtgtgatctcggctgactgcaacctccgtctcttgagttccagtgattctcctgcctcagcctctcgagtagctgggattacaagcatgtgcctccacgcctggctaatttttgtgtttttagtagagatgggatttcaccatgttggtcaggctggtctgcaactcctgacctcaagtaatccgcccacctcggcctcccaaagtgctgagattgtaggcatgagccaccatgcccagccaaaccggacatatttctaaggaacgagaaagagcagccgtctgtccaccacctgccccccacaactgtcttgaaccgcatcccagacagcttggtgtcgtagctgacattgcctgtgtcggccctcctctcctgatttattttaatcctcatatgttctttcttcttctgggaattgttcttttctagcattctgtttttgttttaaggactcagtaacttatatgtcttcatgaatactaattattatcatgactgttgcttcctcgcccacttttctctggattgtcatttttttctggcagattcctgtcttctgcctgtttgagtcttcttccacaaacacctggcagtgtctgttctgctcattcacattcaagaacagagcacctgtgtgttcatttcctggggctgctgccacaagatactgaaaactcagcaacttctaataacagaagttgactgtctcccagttctggagactggaagtctgaaatcaaggtgtctcagggccacactccctctgtaggctctaggggaggatccttcctgcctttcccagctcctgggggctctaggcatccctgggcttgtggccacatcacttcagtctctgcctccgtttccacgtggcaaagtgagctcatctcaagatttttaacttaattacatctccaaagaccctttttctaaacaagacagaagtaccatgggtgaggacttctgtttgggggctaccgttcaacccactgctctcagtcacacaaagcttttgaagcataacacctgctgttcaggcagttgcaaaagtagcccctaagaaagacagcatgccaaagcaccttccccatggtggggtggggtgacgggccaggcacccttaggatgcccatgcaggaagtggaggctcagcagaatcccacaggtgtgtctggtcctgggatagcatcagcgtcttctcacaggtagccaggtggcatccatcagctgaccacatcgtctgccccagtggcacgggctgtcttccatgtctcacttcatagagctcttctagactgaggcccaggacatggttctcggcacacagcgttaatgacatgcacggccctctaagcggttccctctcccactttgcgttgtcaacccccggtaccccccacttgattctgttgctcactgcaggtcttaggtagtacagagaatgttcaggcttgtagggttctgatggccagatcacccaacaaaagaatgccacgaacacctgagaccgcgcggcagctgcctgtcttctgcctctttcctttgtttaatcctgtttaattgcacatccctgttctcacccaccttgggtctctaggatggaggaaagcaggagcgtttcttcccactcacagtgctgattctccacattccccagttcttcccctggagatgtgtcctgtgagctgattgtttggagcaacagatacctagatatctgtctctctgcccttcctgtaaacccacggaagcacaccaaattctaggagctgggaactggagttcatttatacacataattaaccagcttctccctagaacagaactccatttgcattttttcgtcttttacttctcagggaaagccactgagtgagacaaagtttgtgtgcactctttaaaagatgaaaaactttgtgaaggcatcaggcagttttgaatcaggtgattaggatcgttcattcctgatgatacactggagctatatctgatgataacgacactacctaacatttatctggggcttcctcacccatgtcattttccaggcattgttcttcttgtgaattaattccatgaggaacgttaatcattgctctttgacagatgacaaaattgaggcccaaagagggcgtataattgacggatgtcccgtaatctctgactgtggtcatagtcttgtcttggctttcatcttcataggagtcccaagcattttggagatctcagtatgttgtggtggtgtaaagcagtcgtccaaaaccgtttttgattcattctccatcaataagaatgttgagctgcattccagtctagacacattggtgtgtgtttgtttatctactccaccttagaaataattcacagcaatagaaatgcaagaaggataagctaaaataaaataatcggccgggtacagtggctcacatctctaagcccagggctttgagaggccgaggcaagaggattacttgaagcagaacttcaagactagcttagctaacatagggagaccctgtctctacaaaacataaaaaaatttaccaggcatggtgacatgcacctgtagtcccagctattcgggaggctgaggctggagaatcgttttgagcccaggaggtcaaggctgctatgattgtttgactctgctccagcctgggtcacagagcaagatcctgtctcaaaacaataataataaaataatctgtttaagtttttaaaattaatagcaccaaagtactttaagaaaatttttatacagtgtgttttacagagccatgtgtttaagtgtgctccattttttaaaatattggtttaaaattgtgtgatctagcaatttaaaaatcttgttttaaattcagattgttttgatactcagctttaatcactgtttatatccagacagaagttcatgattggctaattttttttttttttttttgagatggagtctggctctgtcacccaggctggagtgcagtggcgctatgtcggctcactgcaacctccacttcctaggttcaagcgattctcctgcctctgcctcccaagtaacgggttacaggacgcactgccacacgtgactgtctcttttttaaaaaaattagagccttttatctcatccatcagttaggttaaggtttaaattgaaatttagctaataaatatagtcctctgtgatactaatcagtggttgttgcaaactaatgaaatagtgtggcattttagtatttttaactaatggattcaagttctgtagaagctctttaggtggagtacttctacactgattgaatattgtttttatgcgtggaggtatgtgtatgtatgttcatgagatctgtcgttttcttgtctggcttttgtctggttttgggatcagggaagtgctgatgtaaaatgtaaaatgagttgagaggtgttccctccaatttcctgaaaagtctgtttagaattggcatcctttttttcttgggaagttggtaaatttaccagcaaggccatttgatcctagatgtgggaaggaggtttttaattacaaattcaattcctttcataggcagaaggctattcaggttatttgtgtcttcttgagggagttttatatctttcaaagaattatctcatttcatctaaatggtcaaatgtgttgccattaatcctataataattaagtttttatcattttatcgatgttagaatctgtagtgatgtctgtcccctctttccctgctaatgttagtacatttggatcttctttatttttttgatcagtttagctaggagtctactaatttaattgctcttctcaaacaactcgcttttgatttagttggttttctgtattctacttttatttcattgattttctctctcatgtttattatttccttccttttatttgttttgggtttaatttgctcttttccttcactttcttaaggtaaaagcttaaatcattgaacttctttctttcaggttttcaatgtggcaacttagatcacttatttgagaccttattatttaacatatcactcaatgccatcagttttcatcgaagcaatgttttagccacatcccagaaattttggtagtttttagttctctacaaaatattacctagtttccctttgtgatttcatctttgacccatgtcttacatagaagtgtaacatccaaatatttgtgattttccacattcctattattaatgtctattttaattctaccatcgttagataaggtattctgtatgattttaagtattttataatttttgagaatagttttatccttataataggatatttcttgttgaatgttccacgtgcacttaaaaataatgtggtttctgctgttgttgggagaagtattacataaacgtcaattaggtcaggttgcttgacagtggttctgaagtctgctgtgtccttacttcttttctgtctacttgttttatcaattactgatagaggagttttaaacttccttctacgtttgtgtttctccattcagttctattggtttttgctttatgcattctgaagctctgctatttgatgtttacacatttagaattatgtcttattgatgaactgatctatttgtcattatgaaatgtccctatttatccctgatgatagtcattcattgttctaaaggcttgtttgttattaatgtaagtaacctggctctcttttgagcaatagttatgtggtatgtagttttctatccttttatcttcaatctatctgtgtagttatatttaaagtaggtttctgtagacaacatgtagttgggtcttttgtttttcttttttattctgatagtgtctatcttaggtgtgtttataatacttataaagccgttacataaggtcatgatctgctaattccatctgtctctatcatttctgtgtctatttctcctgattgtgggtggtatttgcttctttgcagcatggtaatttttgattgaatgttagacactatgaattctacacccagtggagtgctagattttgcttgatttcatttgctttatttaactttgtcctggaactacattatgatctgtccatgccttccttttaaaaatctttagagggtcaggtgctccagatatctgttaccttatcctgaatgactgtaggtgttcggaaaaaatgagtctgttgattgttttgtgtaacaattgacaaagtagggacattaaatcatgacattattaaaataggcatgattatacaattatttaaaataattttaggccaggcgtggtagctcatgcctgtaatcccagtactttgagaggctgaggcaggcgaatcacctgaggtcaggagtttgagaccagcctggccaacatggtgaaaccccatctctactaaaaatacaaaaattagctgggcgtggtggcacatgcctgtagtcccagctactctggaggctgaggcaggagaatcgcttgaacctgggaggccgaggttgcagtgagccaagatcagccattgcactccagcctgggcaacagagtgagaccctgtctgaaaaataaaatgaaattttaggcaaaccgtcacaccttgtgtggatttagatgttcctgttgtgctagtcgcataagttaaaggtaggaaggactcctggtatttttgattctttctgataactagtcctctcatgattggctctatgatgacctccatggacctgtgtggtccctgtagttaatccgtgtggctaatgacagtgtgaggatgctcttttcatatggcacgttgctgttgatcagctgtgttcagcagctttcttttgtcccctgatcccttgttaagtagcgctgcagcagtccctcagccacagccttcttcagcatctggtggacgcctttgtgtaatttcctctccttagcagggtgaagaatgattgaagtgttttctgtagaatacagcatttttgcagaaaacaccaaaagcatagtccttgtgtatttactgctctggaaaaaaaagtatggttcagcgaggccctgctgaagggccttccccggtgccctggccagatcccaggtccagtcacctcctgggcctgctctctgcccttctccacgtttcataaggaggcccagcaggcaaagcagcagtgcctcccagtgcgctcttcttctgttcctttgggaaacgtatcgctcaaccgccaatagcttttttgattttttggtttgttttatttgagcagggatgttgtggagctgacaaccgcttttagacaatctgtcctaggtcagaaattcctcaaaaggagcagcctgagagtgtgctgccacacagctggagggactgtccctgcaagaaggtcttatggtggaggcctcgcccctcacctcagtccttccctcctcctccccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaaggtaagtgggtgccggtgacacgggccgtgttccacaaccatgttccaccaaataatatccatgtagtgtttgctaaatgtgaaaagttgtggtttgtgctgttgaaggccactttgcaatgctccctagaacttgggtatgtgggcagggagatggtctggttggaagattttgtgaggaatcgtggccgcacctaagtcaccaggccagggagactcagccagaatccactgggtctcagggacaatctgagaagcttacagtgccagaacaaggcctattcagacattttccagggaagcggcggttttaatgatgtggggcttaaaacagtcttattgtctaggtgcaggctttaaggtgagtattcactgcagttcagatgtaaatcactaaaactcacttcccctccccaactgcttatagagtgctcgttggttgctgcagtttttgcttgtgtagtgacgctgggtttttatcgccaagtttttggacttccatccatttctccattggaaagtggcagctggtgggcttgtatgccgtggcaccccctgtcccgcaccacggctgcttgaccatgcagggtatgcagtggagacggcccctggctccctcttcttgttaaataaggctcctcctcaggtgacctgggcagagcgtttagagagccgaccgcttgtggtggctgggcctggctccagattcctctgaccgttctgtgactgccaagatggagtccttggcctgaacgatctgcaggtacagattccagaatcacaggaagtcacccttgaaaggggggctcccgctggcgatgtaagtgtaagcagctggggagggcatccgtcggggagtctctgcaaatgcctgcttcccctgggttcctgcatgtgaggacttttgtggtttgtggggaagagcctttcagtgagaggtctttttcaggcctcacctctcattactaaccagtgacaccaatcacgagctcagggaaattactcagaaaccttcccaataaagcggagctaccggagtagtcttgaaagacctgttttttgttgttgttgttttgttttgttttgttttttgcccagggtgcaacttactaccttgagcctatagaggcagccggaacctgtgcctcagtacacaggcctctgattctctgaagctaagtgggcatccagcaattcagttcagttctgacactgactcctacggttagcccagaccccgaaggttaaggccccagtcccacaagacgcccattgcacgttccaggggccacctgtacttctgattggctacaaattgggggttcctgcaatcctctcttcaggtctaataatcccctaacatgactgacagagctcaggaaaacactttcatacacttgctgctttgttatgaaggataaaactcagggacagccaaatggaagcaaggcattggccaatgtatggcgggtggttgcaatgctcccctgccctctctgggcacctgaccctcccagcacctccatgtgctcaccaaactcaaagctccccaggccccttatgtagaggtttttatggagctttcttacgtaggtgtgagtgatgacatcactgacgattgctcattgaactcaatccaggccaaggtgccctccctggagatgagggggagggctgaaagttccagtcttgtttgtttgtttgtttgtttgttttgagatggagtctcgttctgttgcccaggttggagtgcagtggcatgatctcggctcactgcaacctccacctcccgggttcaagcgattctcctgcctcaccctcctgagtacctgggattacaggcgtgtgccatcacgcctggctaatttttctatttttagtagagacagggtctcatcatgttggccaggctggtcttgaactcctgacctcgtgatccacccgcctcagcctcccaaagtgctgggattacaggcgtgagccaccgtgcccagacctaatcttctaatcgcatatttggtctttctgatgtccagaccctgtcctaaagctatcctgggtccactagaggcatcttattaggttgaaaatggcttattaatgactcagaaattccaagtgttttaggagctccatgtcatgaactggggacaaaaaccaggtgtgtagtttttatgatgccatagctataaacagtcattgaaagacagtggggcattcttagcaacacacatacctgggctgattgaaatctcattcttgatttaagtctcattattgaattcaacttgactgcaattgcttaacgtgggacgtgcctgagacctcccagctagtaagtcagagagtcaaggctgagcctccaggtgcggctggaacagctcccagtgggaacatgtatctgcttcttatgtctggacatgtgtatgtctgcatgcttggcaccctgttacaaattcctctgcaacatgttcatttttccttagaatttcccccttgtggaagaattattccatagcttcaggctataaagccttcttcccagaaacaccatttttgttgttgttgtttaacctgagttattgttcactagaaaagtgaaggtgctgcactccataaccatgtcccagaagcgatcagagtatgttggcacttgcattcagttctgtatttacaaactgataaagacaaggtgaaatatttgccttgttaacatgagctgttcctatagctaaggcaattaaacggaatttcaagtacaggcagtccttgttttgcaaggtactctgttaatggaaacatggtgtttcatgtggggttttttggttttggttttgttttccttttgtttttcagatagggtcccctttgttgtccaggccataggcggtggtagcacaatcgtagttcactgcaacctccatttcctgggcgtcagcaatccttctgcctctgcctcccaagtagctgggaccataggcacacaccaccatgcgcagccgggtgtggcagctcacacctgtaatcccagcactttgggatgctgaggcaggaggatgcttgagcccagtagcttgagaccagccaggtcaacatagccagaccctgtctccacaaaaaattagccatgttttaaaatgtatatggaagcaaagtgtatgtggaaaccacatgctgccattgcatgggaccagttatggtgaaacccacagagcaagggccctcatgaggaggaatttctctcacaaggtaccctgcaaagaggcccatggaatgaattgtgttttaacatcttggtgttctcattgacaatgtttgttttagacttgtcaaagaaaaatgagcagttgcattttttaaaagtcatttagcttttagaaagttctaaacattttccttattattaatctacatttacttacagatatatttctcttgcagaaatgaaatgtttcctctcatgcttcttacttagagacagtgacacattgtgggtcttcctcctgtgatgtgcatattgtaatactaaaggaagtttttcccaagctcctgtcagggaagcagccctggttttgtacttggcatttgtgtcaggaatacaggaggcagtggccaggggccgtgtggacgatcttggagctcttcagtcaggccctgctgctgcttcttgcccgcagtgtgggtgtgagctcacaggagcagcatgcctccagagttcaagggcattccattaaatcatcagtcactgaagagacttctgaatctcttagggaattgccttagggaattgatcatgccataggtgtcaccaggttaattaggcatagtagtagtagtagtcataggaaagtagtcaaaaacaagtaggatcaaagggttattaattatgttaaatattaattcccatcttactaggagaaagtgtccaacagagctgacattaaagaatcaagttttcactgagaatattttctaagttattcatgtatcattattttgttctaaaaaatatcaagcaaacataaggccaccttcagaagccccccagaaaccaccttcaggataatgagcacccatcgagtgaaagcacccgcccactgtgtgccaggcagggtgcgacatctgccaacacatcccctgaaggccagagacccagtgggtagagggcctccatgtgccgaacgccaggtcctgagacttgcgagtgtgagcacactcattgcttggtggggacttgagcgaccaagctgggaggcaccccagggctctctgttcccagccacaaaaatgccatcattgttgtgaaacaaaaatgatggcattgcttacatatcacttctagggttgatatttattacaagtaaaaccagaaatcggaaatcagttttgttttttttttttttttttgagacacagtcttgctctgttgcataggctggagtgcagtggcacgatctcggctcactgcaacctctgtctcctgggttcaagtgattctcctgtctcagcctcccaagtagctgggattacaggcacacgccaccacgcccggctaatttttttatttttagtagagatggggtttcaccatgttggccaggctggtcttgaattcctgacttcaggtgatctgcccacctcggcctcccaaagtgctgggattacaggagtgagccactgttccggctggaaatcaattttttacagcctagccatcactactttgcgtgttttagttttcttgtacttgttagtgttgttttaggagctgaatttcaggttttaaaaaaattatttttgtttttgtttttctgttctattttcaagaaagttatacatgttaaactgcataaacagatagagtagactcattttgccagcctaagttttgtgtatattcggtatctgtctttttttgtataataccagggttgaagttgtgagataatattcacaattaataaacaagggacgtggtagattctactctttttcgtggaaacctgcatatttcttaatgaataagggctaagtccacataaataggtagactgggctcatttcaaccagcctttagacatttctactcatagcccaaactattatgctatcaccttgttaagaatacagtcttacaggtggtggttcatgcctgtaatcccagcactttgggagtccaaggtgggaggatcacttgagctcaggagttaaagactagcctgggaaacatagtgaaaccgtgtctctacaaaatataataatgatgatgatgataaatttgccaggtgtggtggcgcctgcctgtagtctcagctacttaggaggctgaggtgggagaatcacctgagcctaggaggtggaagtttcagtgagccgagatcatgccactgccctccagcctgggtgacagagcaagactctgtctcaaaggaaaaaaaaaaaatagagagtacattctgggtggtgacttagggatacaggtgttctgtgaaattctttcaactctgctgtacgctggaccatctctacagtgcaatgttgggggaggcagctctgcctagtgtgacagtcagaccaaaagttcactcaggcacaaattagagcatcataggggaactggggatggcacagggcctgagataaatgctcagcgtttttacagagaagaacagagggtgggattagtgctgaacagaacaagtccaacaggagtgcagccaacacagaatcaatcgtgaggactttggaaaccaagcagaaaagtttacacatggtacaataggcatttgagctcactggaaattcttagaaggacacattggccatgtctgtgttttagagctcagtggagtactgggtgacagattagaaataggcagtaagggaggaggaagtgccaggtgtgattccaatgtgatttccttcagggaacttatagttcaattagaaaaaaataagtaatgtcaaaagttataggaggcttaggagaaagtgaaattaagaaaactgtcgctgggcatatattcatatcaacttgtaccaaatttgaagaactttttgcatctctgtgactctttcctagatttaaaaaaactgaaaaaaagatgtagctagttaaaaatacatgtatttttctaatacctgtaactgcatgtgacatttacacaaagtttcatcttaacttatccttatcgtacattgcatatgtcccaaaagaatgcagacaggagcaggcaggctgtcagtgtgagctgacctctgtaactggaacttcttttcctccgagaataatagagaacaaatagctgtatactacttatgtccaatttaaagttaatatttgggccaggcgtgatggctcacgcctgtaatcccagcactttgggaggccaaggtgggtggattacttgaggtcaggagtttgagacctgcctggccaacatggtgaaacctcatctctactaaaaatacaaaaatcagctaagtatggtggtgcacacctgtaatcccagctactcgggaggctgaggcaggagaatcgcctgaacccgggaggcagaggtgcagtgagccgagattgtgccattgcactccagcctgggtgacagagcaagactccttctccaaaaaaaaaaaaagttaatatttggtgaccagctgagctttgctggacctctggttttggggagattagatgttcttgaatcagcttcttaccctgcaacactgagttacgggcacagccacactggagctgctccagagggtgaggaccgtcacctgccattgtttgccaccctctgtgggcctcaggaccccacagcctgggtcctcattgctccagcctcaaggccacctcctcctgtcacccatcatcgctgaacaaaataggcatgcctctgctcacttgtccttggtattatttcatttccctttctcccttctttcgttatttaaaaaaccgtaataacaaggaccttcacggttactgtccttacacttcttttctttcattgaacttgcctttgggcttggtgtcccttctgaatttcctggcacgagggcacttgcttaaaccaaatttcactgtcagaggaaatgtgtttcctctaccctcttaggtgcagtgattgggggcctgtaaatcagactaacaaaagacagactatcaagagtaaagatagatttgtatttacatacaacgaaggagttcacagaaaaatgtgactcaaggaggcagttagaatttcggatttgtatgtcatcttaacatggatgggagagaggcagaaggacacacagaagaataaacttttaggaaaacttttaggaaaactaagtgggccgttaggagactagatggtggataagatagttttataacaacatcttttggggcgatttctcatctaggtgtgacaggtgctgacttcttatctttggtgataagactcacacttccctggttgtgaaactcctgagcattggatgtatgagggctgagggctgaattcttctggaaggctttccttagaaagggaagggagtgcagaagccttctgttcctgtacttgatgcttactgtcttcagctctaataaccctcatgccactgtggcatgttcctcagtccatggaggccccatctgcttctccccaacaccccatcattactcccctgcccccttctctgaatgcccagcacccagcactaataagaggccctctgcctgccgagcgcacgtggcatccttgtttctaaacaaccctgaggtgcccggcccctggttctcaggtcctgcctttatccagcccgagtagccttacgtccgtgtccagaacactagccttggggcatcttgctctcccagatgacctcggtgtccctcagtcttgttcccacattagctgccaggtgccacaatccctgtttctgactgcatcctcgcctcctcacctcgcctcggggggcatttcatcctggcatctgccgctcctgactgctgaaaccacagacatccgtttcccacgctcctctgcaacgtctccctctgctggctgcaccatgcccatccgccctcatccactgctcccactgtttctctctgcacttcctctcacccaggaactcggttcagcaatccccaaatgtcagcatctgtgtgtgtgcaggtgttgttttggtgttcatctcactctgtcccatccccctgggtgatcttatctgctacttgttgtcactgtgcctgactcaaatcttggtttctggacatgggtagagtcctgggcccagtggtctggaaaggggccttgggaaaatcttatgtaaaagttcagccaggccacacttactaggagtctcaatagaggttctcctaccttaaatctactcttggggaccctgctgcttgtctgagccccaggctcatgaatctgcactgcctggaagtcatgagcacctctgaaaacacggccaacactccattttcccacattttccttcagcctgctcctgtccctccaggcaccctggagtccctcagccaaccttgaagcttctcattgcacgaggattctctctcctcacatgccgtctgcagccagcaacctcctttatccatccacttcttaggccctctcttctgaaaacctcccttgtcctcatttgtacgtttcttcccttcctgaattgaggctgtaggtagcagctgctatgttgacttcaaggtctcattcccagcctgagaacacagactcctcccctgtccccacacccaaatcagaggctatcaatgcacgatatacggaagcagaagccaatagacacagaatccagtcactgattctgtaggtaaagaaacagattcacaccaagggactcaattcccctctgtaagcttttattgaacctttcgtgtacgtgccattttatcagattgcaagatgccaggaataccgagtgatttaggagcacacactgtcatttagttttaataatagccaatgtcatttcttattagaatttagtagttatttcttgctctttgattttcagttcttataaactttggcaaagaaaccctacattcccagctatagtgtggccttctatattagtctgttttcacgcttctaataaagacatacccaaaactgggtaatttatacaggaaagaggtttaacggactcacagttccacatgactggggaggcctcacaatcatggcggaaggcaaggagcagcaagtcatgtcttacatggatggcagtgggcaaaaagagagcttatgcagggaatctctcccttacaaaaccatcacatctcatgagacttactcactatcacgagaacagcatgagaaagacctacccccctgattcaattaccttccaccgagtccctcccataacatgtgggaattgtgggagctacaattcaagatgagatttgggtagggacacagccaaaccatatcaccttctttttcttttcccgtggtgttccccacaaatagagaaggcattcctcttctgtactgttatttcacaaaccctgactgacacttagtctcgtgatccttgtctccatctcctgccactacagctgcagtgatgtcaatggggaggctgtctttttcaccttcaggctctccctctccccttgggtacatcatcagctttgataggaggtggagctgtgctttggccaggtcacagctcagtaagtgttctggcttcttggcagacccacagccacctgcgttcctccagactggtttccagggcttacagtcagcggcagaatctgtcctcctttgatggagagctgctcgtcattcttggggaacttggggcactgcagtgttgatttctagttcacagccctgcagagacctcgacacaggttgcatgcacacgggcccctgtactgttctgcagaattacgccagagctgagccattcctggggcatgagggtctctgggaaaacacaaattagaggcatgaggcccttctgcactctgtcaaatgcagagaagtgaagaaataatttcactaaatgctagagaaaaacagcaaatctcagaacagaatgaagttctgtcctctcataattactcttcatatgtcttgccttcagatatcttctttatgcttggctggagaaattccaggatggcactgtgccctgtgctttgtgtggagaaaatatgatggatgaatccctggtccactatttcccttttaaaggcagatacttgtatgacaatggaaaatgtaacaaaacttcatttaatcagcactgtgtgtgtgtgcgcatgcatgtgcgcacacgtgtgtgtgtttatgtgtgtgtgattgatatgtgttatggaaaaagctcatgtctctggaaatactttccagcaaaaaacatctaatagcttaatctttatagcagtgctggttttggccctttaacttccccgaagttgtaaaccaaaaaattgcagtctccatatatgttttattgcatcctctaaaacaggagtccccaatcccctggccatggaccagtactccatggcccgttaggaagcagggcgcacagcaggaagtgagcggcgagtgagccagcattaccacctgagctccgcctcctgtctgatcagaggccacattagattctcacaggagcctgaaccctagtgtgaactgtacatgcaggggatctgagttgtgtgctccgtatgagaatctaatgcctgatgatctgaggtggaacagtttcatcccaaaaccagcccctttcaccccccacctatctaggaaaaattgtcctctacgaaaccggttcctggtgccaaaatgctggggaccactgctctaaaacatgtatttttttatttctggactgtcactcaaatgcctcaaaaaaatccatgcctcgtagttccttgaaacactttttaaaagaactagtagccactattagtacaaatgccactaccctactcggggcatttcattaggttggctggtgaccagctgtgcattttttgtaatgatactgtgttcactgagtctttttgatagcaaggtttcagacaactagccagtaaaaatacaatctagtcactattcccccatacactagtgcatcaagttcgttggtcctgcattaccagttatcttttacaattgtgtcaattttcaaaatatcttttagcttttaactagtaattattactaataattattggatgttttgggctaaaaccttgctaaatgtttagcatctcatttaatgtagtaccacagattattggcaaatttgggcattgtttctcttcactgcgattggaggagaatggtgtattgaatacagagaacacgtgacccataagtagcactagtgctgtttgtatgtatggctccccaccttgcattgcataacattgctgtagttgaggaatccgctttttaaaagtgtttggcctgggctaatttgcaataaagcccgtgaactctcccacccctggacatgttgtaccttccttgtaccttcctcacccgatctggcctccacaatgcttgtgtacacattctcggacttgccctcacccaaactagaatagggagaataaccagtgaattcagcctcgttatgtttggggatttatgcgaggatcaaggtggcatttcagattgttgtgaaacagatggatcagtcaggaaataataccggggtagatgtcttgccagtggagagggggacataaaccccaaggctctggcttacttccaacactaaggtgaatcctactccaatcaaatattaacatgtaaaactcgaaccaagtctccttctggtgataggacctaagcaagctgcgctaactctccccttaagaacagtgagaaaaactggacaaaaactcgaaagcatctttttgaagggatctgattacccagcaggtagggaacggtgggaccctttacccctagagctgtccccagaagaagtggctaatgagaatgagaagcccgagtttgttttttgttttttgttttttctttttttggtttgggggcaggggggctgaggtgggagaatcacttgaacccaggaggaggaggttgcagtgagctgagatcacgtctcttatatagaacctagtttgaaaaggaagggatattttaagtcttttaagataatgttaactatttttctttctttagctctatttctgtgtgtagctgttttactacaccagaattcagcaagtgatagtttcttaagagttagttgctatgtggaaattgaagccctatcagtaaccttttcctcctcgtgtatcttcaaatctattaccgagccttaaactttgaatggatcttgtatccctagcttattcaagggttaagaaaatacgttttctgtagaaaagaagacatgttctgtggctcatccagagtattatttgagctgcatgtctatagtttaatcacatactgttggaggtcttcctgggagatgctggaggcccaggagtcaaggggctctgtgtgccgttctccaaacacagctctctagaaagaaggttccagcatgactcaggagaggttggtgcaaactgggaccctctgggcacctctcagggacacagactgtccagctggttacggaagcacatctcccacctgatttattcctaaataggagcgaggagggggacaatctttcccttcacccccacatcttcctttcctcttccctacctccctgtattaatactgagaaaccacacctgaacaatgaaatgactaggaactacggtttctggttgtgttcccaagtgggaatatgggctgttcacgacctcggaatgtagaatgccctcattatttattcagtagacatccaataaatgcggatcaacagcttgcctatctttgatagtttttggcagtgtgtgctggttttaatctttgtacttgtcccataagtgaccccatgactagagagtgggctcttccatcttgtaagagccttctgttcacgttctgttctttttatgagaaggaagttccagtgcatatcccaacataaagagaaacgttgaatacgtactgtttttctcttatatatatgctcaaaataacgactgtagtaaacagtcgtcatgattataggatgaattacgcagccattcatagatttttgtagttgtcatttacaagtggactatgcaatagttcataggcttatgaatacataatctaacaatattagctgggtgcagtggctcacacctgaaatcccagcacttagcgaggccaaggtagcttgattgctagagcccaggagttcaagactagcccgggcaaagggcaaaaccccatctctacaaaaactacaaaaagaaattagccgggcatggtggtgcttcccggtagtcccagctacttgggaggcaaaggtgggaaggtcacctgagcctgggggtgtcaaggctgcagtgagctgtgattgcaccactgcacccgagcctgggcgacagagtgagaccctgtctcaaaaacaaacaaacaatattatacttgtagtatttaaaaaacataattatctggtattcccatagctaatagaatgaaaggggagactttatctccctagacaggaagcacggtacctcctacactctcttctccccacatcaactggataggtgtgtgaacgcatttcaaagtcaagtatggttagtaattacttgatctttttccagccccttcagataagctgaattgaacacccaaaagtgatagtaacatcattttcctttgcaattacaaagaccattaacccaacagaatctccatgctttacctgtttgtgatgtttttgttccattttattaagtatgactcctgataaatgaatcactacacaattaattttttctcattctttagattcatacacacagacacatatatcaagcaaactataaattgctaaaatgacaggccagcagtgactacttgttatcacgtgtgtaacatctcttgagggctgctttgtaattcatttgtatggtgttgttgtaccagtgtaactgctaagtggtttctctggttccatgtgcatttgtacatgaagttgtgcaatctccacataccagcagtttcaaagaatgacagtttgcatgaggccatcttaatagcaggtagcatgtaaccaacccatctgaattaagccaccattgcagaataaaacatttgacactaagccaggtatttcagtggatgagttgtattttggatttccaaaaaaaaaaaaaaaaaaaaaaattaagcagtcatgctctcgaataatcttactagacataaacaatactgctagggtaggggggcactgcctttaacaatggtcagagtttcttggtaaatcagtggttttgcttctttgatgtttctaaaacactgatatgcccagttgccctgctctgacctcatctcaccctccccagcttccctccccacccacctcgtaaagcacagacctctcagcctgaccccttgctccctacctcactcattacttctggtttccttttggggccttgtcttctgcctgcccccagtacaatgtttatttttctgcatgtccatctcatcctgacaagcctctccacactggagtgcagccagtagctgtctctgctaagctcttccctctgcctgcatttctcaccccacacacaccttccatttcccagtggctacatacatcatgtgcgattatgcctgtctttcatgacctgcctctgaccagaaatccctgagtcatcttccctaaacccactccttcaaatccaccttccaaatcctggtgaatggactgctgtccctgctccagaggactgtgtgcctcaaacagggctccccacagtgggcctgtattagcagggattccccagtgcatgtttcctgccttggagaccatgaactccagggaggctggagagctgtctgctctgctttctgtcttctgcctgcccaagacagtactttatgtaggtgttaatttcctaaaaatatgtctaacatgcttgaattgctgatagctattgattaaagcccagcttctaatataaatatgcatttctgatgaatctcacaaaaaaacaggaagaaacaaatgccattaatttgcagtttatcaatatcctggctagtaattgagatatttagtggcatagtcactagaatataaggtgctagtcccagtcccaacacgagcttgagtaattttaaacttcatagtgaattttttgtaacgtctacagaatggatcaccattatcataataatagctgatagcgacggagcatgtcccatctgccaagcactggatatcattgattcattcatttataaaatttgaagttggtgggagggcatatttaaagactgctacctggaatagtgttatttgtcagagattcatttgtttgttctccacattcttcaatatatgaattattccatgcaattgaacagctccccaagtacgtcatagttatgaaatgttgtgtgttgactttggaaggttacagttcatttgtgatcttccaggcagcgggggtgggggtggggggattcttctctgtagtgaaagtgtttttctctgaaatcttcagctactttcctactctgtgaagccttcttctcctgggtcagtgggacccttccttgagagtggtttcagtaggttctccaaaaactgttcaactgagtaaaattgaatagaatagtccatgcattttgtcccaaggtataaaaattggctttggggaggtgaaaatgaaaccttacttttttttaatgtatcaagcaccaatacacatacagaaaaatatagtgtatctgtgttattataacatgttatggggatagactgttggggaaaaataactggaaaagcttttttgggggtgatcatgaatgaaatggttgagaaacactgagttagtcatacacagtatcagacaagtactgtgtcagtagccccagtaatttccaccctcaggccaggccccacatccagcacattctcgctcttctctagcccccacagccaggtcagtcttctagcccaggctccatcagcatctcaggttagagaaaggaaggcaagatgccttccacctctgttttccaggattgagaatatgctcacgcccctctctatctaaaggaaaggagagagggatggaccaggccctgtgttgccctcacaggtgccctgggcgccattttgtcatgagtggtcagcagagcccattgccgaggggcctagggagggtgccctcacagagctggtcccttcagttctgaattaagcagtagcctcaatgccatgtaagcaaccattcctgcaagaggataggcatttaaggtgaaatctgcctcatctgtcgttatttacaggtaagattcagaatagttcaagaaaacaaggcaaatgaattgcatttgcattgacgtgagtcatgccacattcagctactctttgtgaaaacgtccccaaaatagattcctcggagtgctgctttgcgggaccttcatcgatttgctctgaagataggtgtccatgcctgagaggcctcagtgaggtttcaactacacagttatccatggcagcacttctggaaacatttctgtgctaattgtacatggcaggtccccagttcctcatttaatgggaggaatctcctttttctggaaaatttctctggactgctgtgtcacagaacattctagaaaccccttacctcatgaacattctactactagacaatttagaattgaacgttaatatgggcatgggaggccagtgaaaacaacataagcctcacctggtactgcaacacatctttgtttgggaaacactgactttgcaaccacagctataaacaccggcttttatttcaggagtcagcagttactatatttgcaggaaggagaactgagggcatccctgtgaaaaccagaaaataaatccatcctgaagggcattggctttgtaggcctctcatcccctgttgagtaggttgctgggccatgcacaacgggtgtcagtatggaaaggaccaaggagaggaccgaagagaggcctctgcattgccagctgccacgtgctcaccacacagacagctcattggctcatccaccagctcatttaatcacgaagtcttttaatcccctccaggtccaatgaattccttaggcttttttctctgtgtttatcagttcccattataaatggcagcttcttctacatggcacatttggagatgacatggaaaaatcactcacacaggccagcaaaggcactctctttatgctgtgataatcctgtttggggaagccccctctgtagcttctctcaaaagcaggcaaacatcgctgtgcttttgctgtcctgacaatgtgtggagtcatattatacagcaagcataccacaagcaagtcacatctaaggcacctaaatgtggtttttccataacgaaagtgctgttgaaaataaacacaacttgctgctctacaggttagagcattttaatcccgtacatggctaatcttcccgagtctgtctgaagtcataatgtccctctaaacacacaaaaccgataggggcctcccgtcacacttgcggatcatgagtctcatgcagaaggctacgtaagatgaattgatttcacatgttttactcagaggatgtggaaaaagaaaatgattctagtgaccatctagaaacttgcggtttgtttttgactttaagacagtcagcacctttcagggccttgctgggttttcactggtttctgacagattggtggacgcggcatctgtaccattaaaagaggaaatcaggaaggttttttgagctgtcttgaagtcttttgctcaccacttaatttacatacatacactttaatatgcatgctaagagtgcccgtaatgtacttttattgagtaaaatgacacagagagaattcgttaggaagctttcctgcccaccccccaaccaagtcgttaaataactttttcaaaggctgttctctataggagaaggaatcaatttaggggtgtagttcattcatttacctagcttgtaactctaaagggttttgttataaacatgtttatatcaataatggttttatagtttgattttcagagcactatcgattcagtaaaacagtagctctgcggtgcacaagggatactgacctccacctcagcactattacttagaggaatgcagcaccatatgtagcttactagtaggtaggtggatgtttggatgaaggaagggagagcaggaggaagggagggatggatagattgataaatagggatggatggacagatggatggattgatgaataatataaacaaaagtactaattaataacaaaatacacacatacctcagcagtcattttgacagcagtacttaaaagtttcatgtttaaacaaacatctaatagtgtatatgtatccaacatgacaacattgtggtacttatttacagatcactgtctgacaaggaacatgaagtcaaacagaacttaaaccttagatatgagcactgccaatcaaaattaaaaacaaagtttaaggcccccttgaagttttgatgtctcaccatgtgaaaattgaacttcatattacaaaattaatgcataggaaaaaacctcctatgaaaaagcctggttttggtgatgagattcagatcatacatggctttataattgatgaatagttgtgagcagctgctgtactttctgtgcttccatgtaattccaggaccgcttctgggagccctgaaagtacccttcagtgacttccttccaaatgttgtatttcactaagcaaaagggaaagctttattccttagagatgatatagtaatatttggaaagctcactagttccaatgaagcacataatttaaaacagacacatcatagtttaaaaggtaaaatcggttacgaaatgtgatcccaagtaggcacgggcagcactctgcctgtggcctggaggaggtcccggtgtgcaggattggaaaggggctggctccttccctgctgtgactgttctgtctgcttcccgatgggacgtgctgttgatcccagctgctgagaagaaatggtgggcaagtgccacggggacaggatttgcagcagggaggagccaaaggtggaagcatcaccgggaagtgagacctggggaggaacacgagagcatcacaagccgcgggcccttctccttccctcttgaaaacctaacctagctcctgacactgcctcctactgtgttcccttcctgcccaaactgtacctagagctccatccatagacctcgtctgctcaccgcacagaaatgccagggctgccgggatcccttctcagcgctcctccttctgtgtaatcaactgcttctctgctctgatgacacctgaccgcacctccagctcacagccacagtgcatggagaccccgagccttctacttgggtgtcccacgatggcctcaaacccaacttgtcacaaaagctacctctccttcctgccaccaaaatggcggccccaagacccaccacatcagaaacatgagaatcagcttctccatcaggcttaacatcccaggtatcatccagttccctattgcttctcagtttttcctctaatcccatccatttttattcattgctcttgtgtttggactgtttccctcccccaattcagatgctgaaatcctcacccccagtgtaatgcgttagggggagaccagggagccagagaccacgctggctccctgatctcacaccgcctggccccagacctatgggaaatccctgtctggggtttaagccacccagtctgtggtattttcttacagtaacctgaagggactaagacaccctgctgctgtcagacaaagatactcttatgtgcaacttgctagttataaaatggaacttttaagctatatgatatttgtcttttaagaaattaaagtacaaggactttttaagtcccctggacagagaccatccccaggtcgctgctgcgcttcaacatcgttggagaagtcagttcatcacctccaagtgataagccgccaaggtgcttcacctcccttgtcgttggaaatgtcatgctccctaaattaaatccctcaagctacagtttaattaagctcatctcctcgcctggagatggaaatcagatatattttagccttcagctgggtagagtgaaaagaacattggattctgcagacctggattctattcaagagttctgtcttccgcctgactgcatgacctccagcttgcctctgaacttcccttgcactaagcagaggagatgctgcatttgctctgtctattccctagcgctgactttccatggcccctttgtggctctaagtcctgtacccaggacacctccaccatcttcactaatttagcagacgttcatcagtgctcacgatttgccatggcatcctgggaaggtgcgtgaaaactgggccctgcctagttacagccgatatgtaggctgtacaagctgcgtcaagaatattcttgaccagatacttccttgaagatgtggaagtcagccttagaaggtccactaaatacactacaaaatgatcacaaaattaattaaaatcatatagaatatgcatgcatacacacacatccatgtgcatgtcctgacacagagatgatatgtggggtgaaggagggagatttcagggtaggccgcaggcctgccgggagcatgtgcaggtggcagcgccatcccctggaccaaaccccagttctccggcttcactgaaggtgcaggagccctgctagaaaagagaagggagccgtgggcacttccaccttccctgtccctggccaccaccctcaaaggagcaacccaccaagtccgtgcagagaaaagtcagtctgcctccactccccacttgcagaggctgaagtcccttggcttagagagaaaagtttctttctacagatgcaaacatacgaatccatgattcactgtatgggtggtggtatgaatgagttttaggtcaagtgtaattggtcagtcatggtgggacaggaagggctgccccctaagtgaaaacatgaggtgcttaaaaggaagcatgagagccaggtgcttaaaaggaagcatgagagccaggtgcttaaaaggaagcatgagagccaagttcagtcagggtgaacctcctttccctgtagctgggtgtggcagacggaaactgtgttgagatatttctgccttcgaagataagaaacatacttcttccttaattttatttgtgcaaaatataaactgtatttagcttatattcttctttctttttttgatgcttaagtcctgtgattaccagacacagttgttccaagatagcttttaaggatttattcttaaatccttaagtttcagtagacagacagccatgctgtgaacattctttaaatggttaggcttttagataccaggtacttttcttgtaggtgtggtcctatttacaagtgcattagatctttgggtgtaacgaagtctaaagacgacataaaaatcttttggggctgggcacggtgggtcacgcctgtaatcccagcactctgagaggccgagatgggtggatcagttgaggtcaagagttcaagaccagcctggccaacatggcgaaaccccatctctattaaaaatacaaaaaaaaattagccgagtgtggtggtgcatgcctgtaatcccagctactcgagaggctgaggcaggagaattgcttgaacccgggaggtggaggttgcagtgagctaagatcttgccattgcactccagcctgggtgacagagccagattatgtctcaaaaaacaacaaaaaaaaaagaaaataaataaaccttttgggacatttttaataggtgcttcaggacacagtagttgttctgctttataattctactgtttctaggggaaaaaaaccaaaccaacaaaacccaaacttccagatgctgtggcatgaccccgaatcatttcccacgtgcaggctgtgtgtgtggtgcagttgccatctgggcctagcaccagggggtttcttctcaggactcatgtttgatgtcttctctttgtcctgtgtctggggctttctttaaattttgtgtgcaaacaatgcctggtattacaggctgttttcctgtaaaccactcacttctgctccactcctgttctgttgagttttcctggcacgtttccatcatcgaccacctccagctgactattctatcagcttttgaaacttcaggttccgttttcaaattccatcttgatcaaatggaattctcgttagcggacatgaagtgtaagagtccggcaaatgtcggggaaaggtatctcctgacagctgttagcaaagcggccacatgagaggaggaagaagagggtttcaggtgccaggggtgtcatgtatcccattgctgtttgttttgggctgagatcacccatggctgtttacatcagaggctgtacttacttttgaccttttagaatagttaactttgcaagggtcttgtgctggaaaacccaagccaactggcctgtcttcctaggtttcccctcaatcatttgaacactgagggttttacttactcacatggacatatttcaaatggcccttctgttgcataagcttattatgtcaccttctctctttttttcttttttttttttgagacggagtctcactctgtggcccagtctggaatgcagtggcacgatcttgactcactgcaacctctacctcctgggttcaagccattctcctgccttagcttccagagtagctgggaatacaggcatgcgccaccatgcttggctaattttttaattttttggtagcgatgtgattttaccatgttggccaggctggtctggaactcctgacctcaagtgatccgcgtacctcggcctcccaaaatacaggtgtgagccactgcgcccagcctacgtcaccttcttattgtgattgattgtgatagcaaccagttaccaaccttgacttttcgccactcttcatgcttattcgagtcccccttactttatgtacgacatttgtcttacatgttgtgtgtagtattccagatgtcagtgccattttggattattcttaaaaataggtgaggacagattaattgaacacagaggaaccagcaaaacgtgaaagccatgagaaacagtaaaaaggtctccaagagctggtgtcagctgctcctgctgtcagtgccgcagacacttgcaagtttccctcctcactcacagccctcacttagttgcctttaaacaggggctgcctttgaaaagatttctcaggtgtgaagggacaccatggggcctgcatttccctccactgcagaccccctgtattagtccattttcacactgctgataaagacatacccaagactgggtaaattacaaagaaaaagaggtttaatggactcacagttccacatgaatgaggaggcctcacaatcatggcagaaggtgaaaggtatgtcttgcatggcagcaggcaagagagagaataagagccaagcgaaaggggtttccccttataaaaccatcagatcttgtgagacttattcactaccatgagaatagtatggggaaaactgcccccatgattcaattgtctcccaccaggtccctcccacaacacgtggggattctgggagctacatttcaagatgagatttgagtagggacacagcaaaactgtatgaccccctttaggtgagtgcaggtgtattgggtgccttccattatctctttgggaacagccacagtcagctactgatttcccgtcccacacacctgtcttgctccttggaagcagcctcacgcaaatagagaataaaagctgctttcacaacttagccaagcagtgttaccccaggggataatccatctcttcctctaccccagtccacatttcacaggtggaccctgcacaaagcttcagaatccccggagaaggtgacggatattttgaaatgtcatttgacatttaagtgcctatctctggtcccagataaaaacagtggagggcatttagaatacaatcaagtcataacttttaaaaaggcaagggcagaaatatcatgaacaggtagtcactgaatgagataacagagaaaaccaacttggacagtctaagtggagtcatttcttctcgcgtcctacggtgaccagtgtctcacaggagaaagaaaccagggggcatcagaggctgttggaagggaggtgttgggacggactactgtggcttgcctgggactgtccagggtgtagcacggaacatcctgccccacagctgacccttcagttccaagcaaaccgaaacagctgggccaaccaagttccctctgtgaaagtaaggtagcattcacattccattgtcacatggattaactcacttaatccagggttcagccctgttgggataagttggctaatatgatattttagccccagattgaaggaaagaatggggtaatggaaagaaaaagggagggagggaaaaagaaaaaagtcattgtgctggctacagcacagaccactagtagttaagactgtgtgtgtgtttcagtgttttctactgaaaacgccaaagaatgcagagcttctctttcagacctggcatcaggcttccgtgagccctttccaggacaccagtgcattgagtcgctgctatatacctggtgatgagccgaagaggacattttcataatgaaaggcaaagggggccaggtgtggtggcacacacctgtaatcccagcactttgggaggccgaggcgggcagatcacttgagtccaggagttggagaccagcctggccaacatggtgaaaccctgtctctactgaaaaatacaaaaaaaaattagccggcttggtgatgcatgcctgtagtcccagctgcttgggaggctgaggcatgagaattgcttgagcctgggaggtagaggctgcagtgagccaagatcgcaccactgcacttcagcctgggtgagagagcaagactctgtctcaccaaaaaaaaaaaaagaaaatgcagagggacaaaggagacaaagaagagatgagtggagagctgaaaggccccacctcaacaactcctggagttctaggccacatgtggagaagagcaggggagactcctcagcataggtcgccatggcgaggacctctcttcccttacagatgtctgggcctctgcagagtctcagttaaaaagcatcagtacatctgttttcacatgaagtgtgtgccattctaggaatgcagggaagaagcttccttcctaagtgtatgtcttcctgagagggtcggtgatatgaagatagcacatgtggattatgcttgtttatactatggagcaggctctggggtgtctcctttggagggagccctcatgtgaaacttactgtaacattgtcaatgtggtggcacctttaggagctcactgataaatgcagtgtacaaacaccccattttatgtattggtttttcttttagtactttatttttttcctttttaattttaatttttattttaatagtctgtagggtacaggtggcttttggttacatggataagttctttagcagtgatttctgagattttagcacacacgtcaaccgaacagtgtgcactgtacccagtatgtagtcttttcttcctcaccccgctagtccccaaaatgcattatatagaattcttatggcttcccatcctcatagcttagattccacttataagtgagagcatacgatatttggatttccattcctgagttacttagaataatggcctccagctccatccatgttgctgcagaagacattatttcattcctttttatgtctgagtagtattccatggtgtatatatgcctcattttctttatccgctcattggtggatgggcacttaggttggttccatatctttgcagttgccagtaggaaacaccccattttcaatgtgggtatctgaatgaagagaccacgggttttggatggtgttgtgtctgtaatcccaataataaagtggattttcgcgattatccaaaagagagcatgcacgcacactacgttttcgtgctcatttgtcacgtcacactagcacacacaggaactgaatttttaacttaaaagattctaaccatttaattttcaaaccacagtacataaaacaggagcagctctgaagtggttttatattttaagagcatgatttttagttttgcaattgcctctcacactctgaatgttcaattattgattgaacagattgttatgatcccaataaaataataaagttttaagctgagaatcttgcctcaccacacagctgcgctccatttcaacaatgctttggctgcaacagaaacctctcccctttaaaggagccacggcggggagacccccggagccagtaagaaacagcatgctgtcctcaccacaatctctactctggggagcccccactgtaattctgtctctttctgcacagttgcagagccaatggtgacgacgataataaacacttcatccacatgtctggttccataaaaggccatctcgactttctttttcttcctacagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactg

SEQ ID NO: 5447 - DNA, 98395 bp, human
cgcgcacttcctcctcgcccccacccagacccagaaggcgccaccatggcggcgcccccgcagcccgtcacccacctcatctttgacatggacggacttcttctgggtgggtagtgtgcagccgccgcctccagtaagggcggtcttgtgtgggcgtggggacggtcggcgcggggtacgtcacggcctgggggccgcggcggggcggtgttcatgcagggacgctcgggctcccgcgcgctctgcccccggctggccccgaagtcgggcggcggccaggagcgcccgcgggcccatgtccgggctggcgggcgcgcgtggccgcggcgtctacgcggccccagcacccgcttccggtcggcggcccgcgcgtggggccggagcacgtgggagcagtccctggggtccaccgggcgggcgcgcggctccgcgtcctctcctcagagcgaggcgcggcgggacctccgcgctctcttttcggttacgcatgcgtgcgaccttgagcggtgcccagcctcagcttccccgtctgcaaagtagcctggaggatacttgcctgcctgctccaaggttgctgctgtgggcgcactttgatggtagcatcctgcatggtagcggttctctacctggcggttttgcagccctgagggcatctggcaatggcgatgtcaggagacattttggctgtcacagctggcgaggagtgatggggtcactggcatctagtggagtccagaccagtgatactgttaaacttcccgcagtgcacaggagtgccctatgcaaccataaggaattatcccgcgccgtcaacagtgtagaggcacagaaggtccgtcaagtggcctggctgcctagggtgaccagcaccggggacatcacctgtgggctacttgtaaatgtagaagctggggccccaccctacccctgcccaatcagaatctgcattttaagcgcgtgaacgtttgagaacagctgctctatcaatccgaggcattaagaaacccttggcagtgtactaaggtagtcagtcttagcacatgtgaacttcaccagccaagaggaattcaagtagaattcaaagaataaaaccctgtttttaactcaagacagaactatgctgagctctaccgaaagccttgacacagttaacactatgacacataatcaccaggaggcttcatatatctataaacatgtctgcatactctttgtagacagctgacctgcttggttacgtatatcattccttcatttcaaaaccctgcaagttaggaggaagtatttgcatgtcactaattaaaaaaaaaaaaaaaaaaaaaaccctgcagctcagagaggtaaagctacttgcccaaggtcacacagctaataagccaagctgagaaacgattctggattgatccagttctaaatataaatgatgttgagctcatcttaaattgtgaatgtgaccttgtttctgctcatcatattgctgggtaattccctagcagtgtttccttttaaaaaggcatgcagaaaccattctcttcattttatgaacacagaggtgtaaactgatgaattccaaaggaaaaaaaaaatccccgtagaggtcactaattggagccaacggtgtatgcagctactaaatttgaaatgactcaatttcagaaagcttgtgggatacataggtatagtttgtagacatgaattttcctactccggtggtcaaaaagttaaattgtcaaataaatttcttatcctctaataaaggtccagagaacctgttctgggagtctcatgaattttaataccaaacaagatgtctcattaaaattaaatttattaaacttctaaatgagcttggtgcctaattctgattctagattcacacatagccatgccctgaagtgatgaatgtgacttaaatggcattacaagcattgacctcacattgttacccaatcctctgatctagtcagataaccaagaattagtgctatttggaaaaataagccctgcttctttttattcccccccctcattttctgcccatttcctcctttcctgccctacctcttctttgaggtggtaaggccttgcaaaactttcttggaaatatacctttgtttatcccattctttcaccaaatgtgtaaatataaaacacagctttccaagatgtgccactttaatttaatctaccagattatgcctgctgtcattctttagcacctcacttcagtgtatctgttgtttgcataacaatatactatcaatttataatgagttattttacaataggtctgtttttcgggaattttgaatgcatttttctaggaagttctgtttgtctatgtagccccaatacttgcatacttggggaagtaaaattgaaaacgaatagtttcatggaggattgttaacattagaggagaagattgtttaatcagaggagaatgaggaagtaaatggagattttagaggaaatgttgaccaggaagaaagccaggacactttcccatgcttttgacatgcacgatgctgttagttgtcctttaaaaaaaaaaaaaaatacacttcggtttctgtttctcatgaccaaggtaagagtcagttatgatttaggtaatattaataattttggctctcaaatgccattcagagaaagagagtaggggagtgggattagttaaaaactgggatgattttgaaataagaagatgacaattattaaacagtatctcagcagctggacagggaagattattctgtttgtaaataactgaaattaggaacacaaaagatggtcccaatttctttaaaagagaagacagtttgttgtccagagcagttctgtctcatagaattgagccaggtaaaaattttggggagcaatttttaataagtaaaaagatacagatgacattgatttggatgatgtatgttatgtaacctaatgtatcaaaaatattatttaatacaaagtcagtataagaaaatctttgaagtgtttgacattaattttgatactaggtcctcaaaatctgtgtgtgttttatacatacaacacatcttagtttgaactagcctcatttcaggcactctgtagcctcatttggtgggtggctactggcttggacagcatgggtctaggtctttgtggagcaacccaagatgtctgttgataatggctatgctgggagggtcaggcagagggtgggtgttaagaatattcagaattaggagttttggtgtatgtaaaatgtggtatgtgtaaaatgtgttttcttggagtctaatacagaattatttaaaatccttttaaaatcaaaggaaaataagcttatttccagtttcttaaatatcgtaaaataataaggtagatctgcgaagggtaataagaacatttgcagtgttgaccataatataccatatctttataaatccagattgcaggattttaatgagtgacttctacttcacctttagtaaaatgaagacctcttctgtgcctttttgcactcccgtagcttcctccttgccaaataatagcacttgagactataagtgcctgcctcactgtctggggcccaggagaccctaaaaggtcatggaggtagggtctctgtggggattaccaagcccagtactgatgggattgtgggctgcctgagacagttgacagtcatgtccactgtgtggccaaaattccacagacatagcgtgagtgtgttttgcgctgtcattctttgttaacttcatgtaggctgtttctttagacaccagaacatctatatagctgatgacaaaaatagatttttcttacgtaatattagcgcatgccctaggtggattgtcagaagaatctatgtatgttgtcatttgaccccatgaaatacgtctgaggtttaaaagtgcagctgacaagcttttcagcctcagtcggttcttactacttgatgttatcaagtcattcattccaagtgggatttctaagagttttggcacatttctgaggaaggtggagcaaagtgaaggatcattctgcatgcttccataggtggttattgtttaaccccagaacgtgcagtgatcctagttggaatgagatcgtaatcacaatctcccctccttccatcatttgtaatgggtcttgctctggatgtcaaagcaactctggtggtaggttcacattctttctttgccctgtcttccctggaggctgacagtgtacccttgggttttacccttgctaggtgaaatgtaggttctcttccacgtttgcaaaggagatggctgagggtggaggccagtgtgagggcttgggacagagatgaacccttatctcaggggccatgattggcctttcactacagggtgatcaatgagtaatctgttgtttctggaaactgaaaaggcttctggaatatagaaagcacaagacacgtgtgttcctattaagggtccgaagagatttagagtaagatgctatattgtatgttggagaaacagcatcagattatagatttagctccgtttggttctgttttctaattgacctgaaccatgccaaccttaagttcttgtagtaagtggttggttgtccactgcagctgtttctgtttctagaataattgagaagggggtaaaacttaaattgcaaaattctgcagataaataataagagttttgtccagctggcaacacaaatattcagcagattctaggcatgcaggtgtaaaatatccttttcttttttctagctctctctttcaaataaaagcaatatggttttatttagaatctttaagtaaactggatacaggcatgtgtgagaactattgtgggttcagttccagaccatcacagtaaagcaaacatcgcaataaaattagtcacatgaagtttttggtttcccagtacacataaggttaggtttatactatactgtattctattaggtgtacaatagcattatgtctaaaaaatgtacataaccttaaatacattttattgctttaaaaaaaaaagtgctagggatcatgtcatccttcagtgagttgtaattcttttgctggtggaaggtgttgtcttgatattgactgttgaccagagtagtggttgctgaaggttggggtggctgtggcaattttaaaaaataaaacagcaatgaagtttgccacatcacttgattctttcttttacaaaaaaattctcttttggcgaggcatggtggctcatgcctataatcccagcactttgggaggcagaggcaggcagatcacttgaggtcaggagttcgagaccagtctggccaacatggcaaaaccccatctctaccaaaaatacacacacaaaaattagccaggcatgatggtgcacacatgtagtcccagctactcaggaggctgaggcccgagaatcacttgaacccgggaggctgaggttgcagtgagccgagatcccaccactgcactccagcctggacgacagagtaagactctgtctcaaaaaaaaaaaaaaaaaaaaattggagtcctctcaaactctgctgctgctgctttaccaactaagtttatgttaatatagtgaatcctttgttgtcacttcaacaatgttcaacaacatcttcaccagaaatagatttttatctccagaaaccactttcttttcgcgtccctaagaagcagtgtctattcagttcaggtttcatcctgagattgcagcaactcagtcaaatcttcaggcttcacttctaattctagttctcttggtatttccatcacattctgcagttacttcctctgctgaagtcttgaacccctcaaagtcatccatgaggattggaatcaactccttacaaactcctgttaacattgatattttcatcttttcccatggatcatgaatgttgtgaatggcatctggaatgctaaatcctttcctgaaggttttccatttactttgcctagatgcatcagaggaatcactatctatggcatctataaccttaggaaatgcatatcctaagtaataagacttgaaagttgaagttactcctcaatccatgggctgcagagtagatgtcgtgttagcaggcctgaaaataacacgaatctccttgtacatctccatcagagctcttgggtgaccaggtacgttgtcagtgggcagaaatattttgaaagaaatatttgtttttgagcagtaattcttaatagtgggcttaaaatattcggtaaaccatgctgtaaacagatgtgctgtcatccaagctttgctgttccatttacaaagcccaggaagagaagattcagcatcatttttaagagcactaggattttcagaattgtaaatgagcactggcttcaagttaaagtcaccatctgcattagccactaacacaaaagtccgcctgtcctttaaagctttcaagccagacactgacttctcctctctagctatgaacgtcatgggtggcattttcttccaatagaaggctgttttgtctacattgaaaatctgtttagtgtagccactttcatcggtgatcttagctagctctcctggataacttgctgcggcctctccatcagcacttgctgcttcaaggagctgttcaaggacagagcaaggagcaattctttccttaaacctcatgaacttctgctagattcagacttttcttctgcagctttctcacatgcctcagtccccatagaagtgaagagagttagagccttgctctaggttaggctttggcttaagggaatgttgtgctggtttggtcttctacccagatcattaaaacttcctctatgtcagcaataaggctgtttcactctcatcattcacgtgttcactggggtagcacgtttaatttccttcaagaacttttcctttgcattcacaacttggctaattgggtgcaagagacctagctttcagcctatcagcttctgacatgtgttcctcactaagcttaaccatttctagcttttaatttaaagtgagagatgtgtgactcttcttttctcttgaactcttagaggccattgtagggttattaattagcctgatttcaatattagtgtgattcagggactagggaggcctggaggagaggaagagagatgggggtctatggagcaatcagaacacacacaacatttatcccttaagttctctgacttatatgggtgcggttcatggtgccctaaaacaatgacaatggtaacatcaaagatcactcatcacagattgacgtaacagatgtaataatgaaacgatttgacatattgcaagaattaccaaaacgtgacacagacacgtcacgtgagacatgctgttaggaaaatggtgttgatagactttctcgacgcagggttgccaaaaaccttgaatttgtaaaaactacaatctatgaagcacaataaaataagatatgcctgtataatatgggacagcagtgcatcgttttgttttgttttgttttttgagccagaatctatttttctccttgaaaagctatatattagagattatttggtcctttttatctttgcgattattcactccttactctgattctatttctttttttttaaactgctataatttatatactattttctgtcatttttcaggagtagatggagacttaaagcaatgtaaaggagcaaggtaaatgatatctcctaagaaatgtcccctgaaagcactccttatatagatgctcaggcgactggtcagaccttctgatgagatgtttgaaaagtgattgataggcagtctgtaggtagaaagcacaatagtgttattctggaatacattacgcttgaaaataatgctcctaccatcggctataagggaattttagtgattaataaatgcagcatttaatatattaagagcttccttcaatagtgttaaaatggtggaagggggcaaccttgattttgtgttgcagatatttgcagtttaaaattgccttgttggtgcttaaagagcatttttttgaagacatagtaatcctaacacatgcatttctactgtgtaagagcacaaaaaggaagacttttccccatggcttttcatagctgggccatccatgtggcttctcttcacatcccttttcagcaatgtctggcagatagatcaccacctttcctgatcctcctttatcctctgtctcccttgtgtcctttgctgtgatgccaacagtgagtagcagctaaggaccctggtgcagctggccacgtggcaaggtgcctgcgtatgagaggaggatggtcacctcttcacagccatgcctggcaggcagtttcatggcattgcttgtggcgcttggtggggcccttgactcttctctctctgagctctgggagctgggccgaatgatgtgcccttttgtgattgatggtgccttatttaaaaaacactgcagatgacatagctgttcaaggacagagcaaggagcaaaccaaagtttgctctttgactcccaatagactgttccatgtgtctatgaagtaagagcaaatggtcatagttggcacatcgaagcttatctgagccttcagacaaaagccaaaataagcaccaaccctctcccacttgtgtcagctgccatgcacatggaagagaagcacatggtccttgagcactgtgcgcctgtctgctctctagcccagcactgtgtatccagcaaatcttcctgccaggatggaaatgttctgtaactatactgcatccgatgggagccacagctggaaactgggttcatgagatgtgactcatgcaactgaggacctgaatttctcgtgttatttaaatagcccccaatgactaattgccaaaacgtaacatagagacacaaaatatagagtggacagcacaactctagaggaatgcattcactcatccttaatctatttagaaaatactctgctgggtgttacaaaggcttcaaaattagtctcttcctttaaggatcttagagtcctgctggaatctaaaacatgattggtaaaatctgtgaataattgctaatgatatacacaataagaatgtgttagcaacagtgcaggattttgaactgaaatcacatttggggtagcatactgtcaaggatagataggagccaagaagaaaaatggatattccagaccaggagaaatggccaagccataggcatctttactaaagcatagaagagagtcgttttttgttgttgttgtttttatcaagcaaagactgtattaaaaaagatcttgctaatgattacattgaagtgtggaggtgagaagagatttgaaaacataataatcctaacacatgcatttctcctgtgtaagaacacaagaaggaagactttgttttccccttgggtttgcatagctggagcacctgtgtagctcctcttcacatctcttttgagcaatgtctggcaggtagagattagaaatctctaatgtttcattgagaaatacgagactggggctggggacagtggttcacgcctatcatcccagcactttgggaggccgaggcaagtcgatcgcttgaggccaagagttcgagaccaccccggccaacatggcgaaaccccatctctactaaaaatacaaaaattagtctggcatggtgatgcgtgcctgtaatcccagctacttgggaggctgagacacgagaatcacttgagcctgggaggcggaggttgtagtgagctgagatcacgccactgcactccagcctgggcagtagagctagattctgtctcaaaaaaaaaaaaaaatactagattaatctctgtcaggctaagattagtatttcttaaactgggtgcccattggtaatatccctttagcctattttaaagtgaaaatctcaccccatcctgcaagcacacatcctgggttttccccctatgactttcagaagagtctaggatggttatcgagacaccagcctacattctggatttgtctgattgtttccacatgataccaccttacttgttcctctgtcccctgtatttcctctaatctagaaattatgcctagtgcttcagttggacacaggtcagctgcctctggcaagaataatgctgtgccccttcgtcacctttttggggagatgtttgtattcagtctatatagggtcagtaccttcatgctagccccagccctgcagagtagagttgtcctcaggaaagctggtgaactgactcctctcccatagtggtacatggaactttttagtgagaagttcagagcctgagatacaagttagaagtactggctataatgcctgtgtgtgtggacagccggaacccttaggcaggaagaggaggctgccggggacagaggtgtgccatgctgtgcacccttcgaagagaaggtactcacaggaacctaaataggtttcacgtgtatgggttcctctgttccatgcagtgggatacaggaaagaaagagcagccatgcagctgttttctcactgtgtcggagcacacaccacagtctctttgatgtttgctcatgagattgaaggacactcatggctttgtcacaagatgcctgagaaagcacagaggttttttgtttgtttgtgtgtttgtttttgagacagaatctcgcactgtcgcccaggctggagtgcagtggtgcgatctcggctcactgcaagctccgcctcccaggttcacgcctttctcctgcctcagcctcccgagaagctgggactgcaggtgcccgccaccacacccagctaattttttgtattttttttttagtagagacagggtttcaccatgttagccaggatggtctcgatctcctgacctcatgatccatctgcctcggcctcccaaagtgctgggattacaggtgaaccaccacacccggccttagttttattttttttttttgagatggagtctcgctcttgtcacccaggctggagtgcaatggcgcgatcttggctcactgcaatctccacctcccgggttcaagcaattctcctgccctagcctccctagtagctgggattacaggtgcctgccaccacacccagctaattttttgtatttttagtagagatggggtttcaccatgttggtcaggcaggtctcgaactcctgacctcagcacagagttattaaaatcaaatgcagttgcctacgctttgtctgcttttgaaaagtaaacttaatgtttcagactgaggtgtatttgtcattggggtcctatgttctgcacagtttgtaaatctacttcacccaaagtgatacagtgatactcaggagggcttaaaaaagattaaatccttcatttggaaacatcatgcccagtgaaaggaacacaggccctaaggagatgtggctgattctagggaccgggaccagtaaaatacaacatgagcacagagcactttctcatgccaggatgcagtgggcggggttgggggggggggtcccactggcacaatatgaaccatttgtaatcaaaagaataatgaccagaagagagtataatactctgtctatatattttttaagtctctgtgttatgattctcaaaagagtaaaagggtggctgggggtgagctcttttacagaagaatgccagttaataaatatggacagaatgggagaattagccaggtcaccattttgggatcccgactgtaagtggttcccacaagcattgtcagtggaagccaaaatcatagagtaatcatgcaggagacgaaggtgcccgcagtgccatgtcagaagtcactgactgataacagaggcaaacgggccttcagagcgggcagctctgggggccacaattgaccctgtggcccaactgatgtagctttgccatccagaaagcagcatgtcacgtcacgtgtgctttctgaagtgacctcagaaatggttaacctgaatccatctggacctctagcagtttcagaggggtagaggaacacgggagggggtgtcatgtggaaacagcaagacaaatcctgaatgtaggatgttccaccaggtacctggactgggtccttgaaaatgttgactatcatggggaaaaaataggggctggcttttccacttttaaagaggctaaagggacatagtcaaattcagtggaccttagattggggaaaaaaatctataaaagacatttttgtgacaattggagaggtgtgatgtgtgctatttagggggtactatgaaatattgctgatttgcctgggtttggcagtggtattatggctgtgtaggagagtgttattctgaggagaaacgtgcagagagctagaggaatgaagagttagggcatctgcatgttttcaggtgtgttgcgtgcaggtatagggtatgtagatgtttcctatcctactattgactcttctgtatacttgaaaagttaaaataggaaagggaagattaagtcttaagcatgaaccactaaaaacaaccccaaaagcagtattaagtagtagtcagttaattctgtttaagagacaagaatgtaaagcatgcatctttagaaaattgatgttggagatatggaagaaatagtttcagaaccttcagctctctcgaacattacagtggcaatgcattcattgcaatgtgtattatagcagaaaacattctgaaggaagagtcccatttcctagtgctcatttttcagttcctcgtctctctcatagtgcaggagatttgtagacaaatgtctacaggatttagacagatgtcaggaaaattgtcttttgttgatgtcttaattggaatccgatagtttgtcagggcatgatgcttataaaaggaataaaagctttctaaaattcttcaaagagtagccactggtacctgtgtgtcacatcatatgctgatgagacatgacagaaaatgctcctaagtagccttatagctgatcctgaggagctactgtgactgggctctcactgcacctctcagctgacttctgcctactgggtctgtgtcatccctttttactctgaggctaccaaggtcttaggaaactggaggttggagcttgaactgagtgatgggaggaaaagacttcctgaagtgctgcccacatctcatgtatgttctcttggacccagttgtatccctgccattccctggaggttacctgttcatacgcagacttctctttcccttatttacctcaattgcagtagcttggcaaccttttaactcttgctttttaaaaggaaaattatttggttatcgtagaaacattttgtgcagcaaagtgttacacatatttctgttctggcctcaaataatcatggatttcattaaatactaaacattttgctgattttaatacagtgctttagtgtattcttattttctttttgcatctcttatttgcctcgtttatcttaacataaagcatttcctttggttaagtagatccttatatctgctttttctttttgtatgactcctatttaggttggtgctaaagtaatgacggtttttgccattacaatacctgtagacataaaggtctagcttactttttgccatttgctaccctgtgtttagtactggcattttgctgactgctcatcagcttttgatacggtgtgcttacgtgacaagctctttaaagtgaaatcataatcagatttgagatttagaattgaggcgacttgtcctgtctacagtgaaactgaggcaggacaacctggggagctatgaatagtaggaaaatcccagtgaaaatccagcacttctaacttctactcctgggcgcttcatcacttagagttaccagcagtcttggtaccatttgttcatagttttgccagccctcacaggtacaggtacaattgtagatactgaaactctcaccagctgacatctaatttaccagctgatttaattttatctcattgatgattgagaggctctactgatagcccaaaaccactttagcttaggtgaaacatgagctgcgttggtaactgaagcctggcccatctcattgacaacttacttactgtactgatttagtaaaattacccatcctctgtgtccccgagtatggtttgcagcatatcacaggcaatgtgtgacatcttccaggatattgcatgcctaccaaaatataatcagattaaagaacatgttcagttcatatctgacctacggccccattgcactgtttaacatgattttgcaacagagatgtaaccatctgcacatgttatgcatccccttataccattagggtttatgctgagatcaagtaaaatcatatcctctcatagggaggggacgggacttctgtgaagtagcctgaagaaattaacatctttatatgatcacatctataatacagaataataaatgccatgtacctgttgctgtgtttattgcttctgctggctgggactagtgagtgtcccgattttaaggacgtgttttgaaactggcttgtctgtctttctgcctctcttctcagccaagtgtcttgctaaagtgggctgtgtttgccgaactcactcccccattttccttccctcgctatgagctggctttttggccctaccactcacagaaattgttctgacagaggtagcagtgatgtccgtgctgctaggtgcagagggcacccttttcttaaattgccagaacttccggcttcctttgccgcttctgcaccctccttggaaatctttctctttggcttcacggatagttcctcttctggcttccccatagctttcttttcctcctggtgcctgtttggcgtccctatggctttgttatgggccctgtcctcttgtggaaacctcttctgagctcatggcttcggcacatgcttctgctctgatgaccccttgacctccctggctgggcctcacctcttttgagttcctgtctacgtttcccagtgaccacaggctcttcctacccgcgtggccaagaggcagctctgaagcattgtattttaaacggggcctctagttctctgccagatctgctcttttcctgcattccacaccaggcagcaaaccccgaaagccccacagcagatggctgggagttatcttccagtcttcaattccttgccatccccacccacaccttccaggcacctcctgatttataaatatttcaaagccacttctgtgtcattccagctgccatttcctgcttcaggctttcaggcttttttctgatctaatagcaatatttactgagaacctttaccacatgcagttctgttggttacctgcagtgagatcagtggtggctgtggggttttgatgctcatgagggtgaaatcgcagagttctggggcccaggtgtatttgcatgaggtggctttggtgagagcatagccttcaccaggatgtttttggaggtttttctcctagtgtattttcctagattcctttgtcaaaggaatttggtcataaactggcccttaagtactttctaagagaagccttgttcatgtggatcacaatgaccttagactttgtgtgcgttgtcagtgctgccctctcctgggcattgcttctgcattcttaatgcaaatatgtgagttattcctgggtgtggctccatgacttgttcctttctggaagctctagccttatctcagccctcatcttgttaaaccagttgtgctgaccttgcttctctgacagcaacctgataaaagcctgtaaagttgcccacttcaagtcattgagcaatacaggtagccaagcagtagaggtggttacaataaatggcttaacattcccagcatttaggtggctccattcagatggcggaaggcaggtggcactttctgttgtggagaatttgaggagagagctttaagttcaaaaggaatttaagaaaagcctaagttggatctatgagggctctggaggagagattgagatgttcagggtgttccttcgattcatgaacccgactgacttttcacagcaggaccaccagttgccagatactgagacaactgagtcaaatgaatacaacagcatccctgttcttcaggggactgcaggcaggggtgctgtaatttgtacgggggcgggggtggacatgatctgttcttctatattatcatcattcatctgctagagacaactcgattttcttgggagccaggaaaaggaagttggccagtcggatgtgcctcacagcagagcaaacgcatcccaaatgagccaccggaagggttggggagtcactgaggtggaggaggaagggctgagggtatttcaggccaagaggactcggtgagaggcggagcacaggtaaaaaggcctgccaagggcagatggcggcgagccctgtgccaggctaaggaattcacattttatctcgtagccatcatacagcctggcgagcacacgatgtctagaagggtggtgcttctgatgatgtggactgttggcgcttagacactggagactggtagaaggctgttgccattgtccagatgaacgatagaaggactgcatgagttttccacaaactggggggcctaaaacaacaggagattactttatctcagctctggagacaagaagttggaagtcaggatatcagcagggctgcgtttttccttggcttgtagctgcatcgctccggtctcagcttctctccacgtggccttctcttctctccttttgtctcttataaataaggacccctgccattggatgtagggcccaccgggataatacagagtgccacatctccagatccttcacttaatcacatctgcaaaggtcttttttccaaataaggtccgattctcgggccctagggattaggacgtggacatatatttttgggagccacccttcaactgactacaaggacccacagggttggaatgaaaggaagaaaagtggctgattcagaggccgttcagctgacagctgggcatagagggatgggagggagaaggcaggtgaatagcagtgacttgtcctgaagtcgaaattagaggaagctgtgaggcctgaaaatagggatgagttccattttaggcatttggacatgttgagtttcaggaaactgaaagactgggcacctcttaggttgacagcattgatggaaacaaccatgatttcccatttaagacaaacaaaactcttggtgccgttaacccatgaagaaaactgacataggtggccatcgacctacactcgtctttgaacagctacagtacctagaagccattttagtttttacttttattattattattttttgagacagagtctcattctgttgtccaggctagaatgcaatggcacaatctcagctcattgcaacctctgcctcccaggctcaagtgatcctcctgcctcagcctcccaagtagctgggactactggtgtgcaccactgcacccggctaattgctgtatttttagtagagacggggttttgccatgttgcccaggctggtctcgagccgtgcacccggctaatttttgtatttttagtagagatggggttttgccatgttgcccaagctggtctcaaactcctggactcaagtgatccacctgcctcggcctcctaaagtgctgggattacaggtatgagccactgtgcctggcccctggaagccattttaaacttatttctaagtccccttcctcagagagaatacatgcacacacacagttggataattagcctaggaagggtctggaaatttagccatatgcccaccatgttttgtcctcctcctccttttgtgtgtgtgtgtgtgtgtgtgtagtatgtgcatctctgatacaaagggagcagctctggatccctagtcattctccaatcagcctccgaattccccctaaccctgcatcaaaacctgaatccccccaaccctgtgtgaaagcctgccacttcaggcttaatctttgttgacacgtaagggtgccgaactcacaactttgaagtccttttattctactcccttctccttttctcatcccagctgggttgtaaatgtcagggagaagtagagggcccagtcctccttcctggggtagggagattatttaaccatgggatgcaccatgatttccaaacacagttgattttccagagaagggagtgaaaagaaaagtgctttggaataacctttggactccacgcaccatgccggggataaacatggaaaataaccatttgttgggcggtgctccgtgtcacatattctagtatgtagttttatacccagccattgcccttaccctttcgatttttgttagagcgggacggtgccctgcatgctgtgtgctgtctgagtatgacatttctagtagtaaggaaggttaggatggctctttcctttgccttcattaaagttctcttgcccagatgtgagatctttaaaaggtcagtgtttttgaataaggaatgaaatcatattctaagataaaagttcagagagttatacaataaaataataaattagtaaatggcacttccctgagaggcgatggtcactggtcactgttgttgcatcccattcctcttgccttcagggaatatcccctcaggtatgagaatgctcagggctcaaagacagagaagagctgtacgtcacactgttggggctggcagcaaaatgctgagcaaccttgggctctacaacatgtcctccatggaggtcaggctctaggcctgttctgttgactgctggagtctcaacattcagaacacgggtccaacatggcatgtgtattgacagagaagcttcaggtaatttttatgtccttgaatgaatgggcacatgttacatgacagagcagggactagatggagccaatatattagatccccttctctccacacctcattttctatatagtgcagccagtatgagaatataaaatggaaaggaagaaggcatatcattttgtatgtgctctatgatctttaaatgttattaaatgttggtaatgaaatgctgtggtataactaattatatcctagcacctctttcccatatacttgcattctctaattatgttcaaagcaatggttgcccgaaggctaagggtactcggtcctttcctcccccatgaggactatgttttagcttgtaatttcacctgcaggagctcacaaaccagctgcatttgagtgcaattatactttattcatagtgactaataacagaaaagagacatcgtgggggtttgggctggagatttataatctcatataaaaaatacgaattcttgcttatttatgggttgagcaccttgggcccccgctgtttcatctgatggctgcctgatttttatccgcaaaatcattcattagtatctacactagaatgtaaacacagaatgtaagataaatttgttgtgcagtacttggatagttagaacacatttccccagatagaaacattaaaactagaggttattcactcccatattcacacaacctttatgcacctgaggaggttccgaatgtccctgaccatctcttatttcttatgggaaagtgtttgggtaccagcttggaatgccaggagtgtaattctccagggcagcgactgccgcccgtgccattgggtccctagccctttttcatgctctgctttctgatgagcttacacacacaggcatggtgtactgtgggtgcttagtattgctgtaggacttcttgtgtcctgagttcaccactaccctttaattctaaacatttataaactattgaagttagattcaaaactttcttttccctaagcttttactttctgcttattctgcttataaattagtaaatgttggccgggcgtggtggcacacatctgtaatcccagcactttgggaggccgaggcatgtggatcacttgagcccaggagttcaagactagcctgggcaacatggcgaaaccctgtctctacaaaaaatacaaaaatcagctgggtgtggtggtgcacgcctataatcccagctactcgggaggctgaggcatgagaatcgcttgaacctggaaggcagaggttgcagtgagccaagatcataccactgcactccagcctgggcaacagagtgagactctgttaccaaaaacaaaaaatctagtaaatgttaacagtcactgttcagaggccataacagtgtttgagtctcaacctttacaattttttcataaacttcacctttatactgttaactcacacttacaaaactctaatatattttatttctttgttgagtacttcagttgtctgaattaaagaatgaaactcttttagtcaataatcatcttaaacataataagtttataaaaatgatgaacctaaaattcttaatatttcaacatcattctgatcatgccttaaattgcaaatgtaaataattcaggtatgcatttaaatggttatttattagcattattgttctcataggccaaattcaattaaaaagtacaagtaataaaataataagtaacatggaaaatgtattcagtggtcttgctgcttttaagcatccctctaaatgatttgggagttgagagatgtctgttcattaaggaaaacagttccctcccaggtactttacattcccatgcaggtgattagagttttcatttcttaaaataagtaaatatctttccacctaactccagtaatctttgaacttgggaggaattctccattcttttatgcttctcaggtcagtacaagtcgtaggtacagctattaaaaggatatctgattgaattctggatatctttcatgtagtttgactgacagtaacacctcatagggccacattactgacatagttagaacattgtgctagccttagttatgtgtctgccaagcccctagctgttcaaagaaaaggcggtctcttaccagctgtccttccctggtaattggagctgtggaataaaggtcagttgctctttgagaatgtgagtgagcatttctgactcctcatccttcagtgcccccatgtgtggaaggcttggtaaattgagctgtgcctgcagttaccaagctatgcctccttttgtcaatataattcccactttgctactttgggtaccagaggtacactctgcatagcaggaaccataccctatgctttttggttcttttgagaaatcctaggtagaattagatacataaaatctgagatactcgaaccaatttatacatatgcaaatatgtattctttaaaaaaggatcttgatccttatttcttagtgatcttcttcatcccttccccatgttaagatagcaccttccattaacaaactgctcttgccttttatataaaaaaataaaaattaaaaaaaccaagtagatgaagatgaataacccagtgttacgggctgagtcatgtccccctcaaacttacgtggtggaggcctaaccccaggacctcagaatgtgactatatttggagataggtctttaaagggctaaacaatgtcctaatccaatgggactggtgtccttataagaggcgattaggacacagacacactacggacaaccacgtgaggacacagggagaggacagcatctactaaccaaggagagaggtctcagaagagaccaaccctgctgactgactctgatcttagacttccagcctccagaattgcaagaaaattaatttctatgtaagccacccattttgtgttattttgtgatggcggccctagcaaacttacagtcccaagaatctaagatttttgattgtgtgaaggatcaagccatctggaccaatgttttcctgaatttctgggcagacctttccaggaaggtgggcagcaaatggcccaggtctgttcagttagaggatcaccagagaagtttctccattctcagctcctatcatctttttacagctgaattttctgacattcctccacccccaccagcacacaaaaataagtgaaccaaaagcataacagctaaagaaatattcctgtgacatggtcactcatgtgtctttaggagagaagcactttgtactgtgtattgctgtttatattcttaatgtttttcttacatttcatgatgatttacattgccctaaattttttaaaaatgtaattttggcattatcttcatatatatgcatatatccctggtggtaattcctaacaggccattgatagggaatgctaagagtaaggatagtgatatggtttggctgtgtccccacccaaatctcatcttgaattgtagctcccacaattcctgtgtattgtgggagggacctggtgggaggtaattgaatcatgggggcaggtctttcccgtgctgttctcgtgatagtgaataagtctcatgagatctggtggttttatgaaaaggagttttcctgcacaagctcgctgtcacgtctgccgccaagtgagatgtgcctttcatcttctgccatgattgtgaggcctccccagccacgtggaactgtgagtccattaagcctctttttctttataaattacccattctcaggtatgtctttatcagcagcctgaaaatgactgatacagatagaaatggaagggtagcggagggcctgtcaccttcactgaaaaagaatagaagtgattgagttttggtaggaaagatgatctttaaataaagcctttgtgcatgttgtggaggacagttgctggttttcattaattcaaaaggcctagggatatgtgggtttggcattaatctataatgcctcagacactggaaaactagctctgagaagggtttaggcaaagtgacatccatctagagctctatgtttgtatatttagctcttaaaattcaaaaagaatttagattattgccattagctaaatggaagcatcatggtgcatcaataggaaatgggaaaaaaaatgattaatagtatttatacatatgtgttattctgtagcaataacgaaggcctagcatgctggggtttgttttcattttgtgaggactatactgtgctgttttttagtaaactggtgaactgcctcagataaattgtcacacatagttctgtaaactctgcctgtagctttcattgactttaggttgtgaatgaaacgtttaaaagtttatttttatgttttttttatgtttttttttaatatgtttgaaagtcattgtacagtagcccgatgagggaaaaacaaaaagatagccaaagttactttttttttgagacagagtctcactctgtcgcccaggctggagtgcagtggcgccatctccgctcactgcaagctccgcctcctgggttcacgccattctcctgcctcagcctcccgagtagctgggactacaggtgcccgccaccacgcctggctaatttttttgtattttttagtagagacagggtttcaccgtgttagccaggatggtctcgatctcctgacctcgtgatccacccgcctcggcctcccaaagtgctgggattacaggcgtgagccaccgcacttggcaacaagatagccaaagtttcttaaatgccttctatttctattgctgctgtaacaaattaccacaaactgaggcctgattttaccaatctcttggtaaaatcgggtgttggcaaggctctgtttgtttctggaggctctaatggggaatgttttcttgccttttccagctattagaggccacccacacgtcttgactcatcttcaaagctagcactgtttcacctctttgaacatacttttttagtgcagacgtttgtagccataatttccctccacgcagtgcttttgctgcatcccataagttttggtatgttgtgtttccatttttattcttctcaaagtatcttttaatttctctcataatttcatctttgacccacaaatttttaggagtatgttgtttaatttccacattatttgtgaatttcccaagttttcttcagttactgatttctaatttcattgttgattgggaaaatatatgatttcacttctttgtaaacttattgagacttatgacccagcatatggcctattctggataattttccatgtgcacttaagaataatgtatattctgttattattgggtcagttttgtatagatgtctgtcaagttttaatggtttacagtgtgtaagtggattaaatcaagtcttgtatttgtcttccgtctagttgttctgtccattgtcaagtgtggcattgaaatctccagctactattattggaatcagctatatcccctttcagttttgacagtttttgctgcttgtattttggggctctgtggttaggttcatatatgtttataattgttgcatcttcttgatggggtgacctttatcactataaaatgtttccattaaaattgtttggttttttttagtgaaatggtttgtcctaagtctactttgtctgatattactatagctacttcagctctctttgggctgttgtttgcaaggaatctcatttccatcattttactttcaatgcttttgtaccatttggtctaaattgtatctctattgtagatatcatatagttagatcatgtcttttttaaatccattcttcaatctctaccttttaattggcgtttttaatctatttacatacaatgcgattattggtaagacaggatttacgtgcggcatgctgctgttttctgtgttaagtcttcttgttaccttatttctttattactgccttttttaactttagatattttttagcgtgccattttaattattctgtcctttactgtatttcttagtgattgctctgtggactatgataaacatcttaaccacttattttaagtagttcacaaacctctgctcctatgtagttccgtttccgactctcttatttctgttgctgttgtcatacaaattacatgtttataccttgtttgcccatcaacacttataatttacttcacacaaaatttgatttacaaacaaaacataacgtttatactgtctttaatatctcccaaggggcaaaagcaaagcccagttgtgagccattgccttaaagtataaaaaataagtgttacagcattcttgtcctttatctcattttaaggtaacttagcacgatttagaaagaacaccagagacgtttttttaattggttattggataatgagaccccaaaaaaccctggataaaaaatgttccatttttaagtgtttccaaatctggcttgatagtttccagaacaaaaaataaagtaaaactttataacaatttttggtataaatacttcaagttagaactttgattcattaatctttattcaaatactgaaagtatgttgagaaggaaaatatatacaaactcataacgtaactctagtaataatctcaagtgagtttgacctggggagaaggtctgttcagagaaaggtgcatgtaatcgggtgatgagaatctgaatttgagccagctgtatccacacagtctttataagtcatccctaacactcagagcaattgcgcgggatagctgtttgccctggaaaaaagcttgactcttgctggtggagcccagattcaaaacgggggcagggggtggttacaaagcatatcaatctgttatttcatcacatacctgctgccttcttaaaggaaacaggaaagcattctttgatcagcatctacagggtctgagattctgctttgaaaaaatccatgtaggaaaagcgagaaggaaaggaagtacacaggaagggagagccaattcatctctgtgaccagaaaaattaaaagttctttttgcactggtcatctactgccaaatatgtgcttttaaatgggagagagaacaatatgcatgtacatagcagtattattcagtatcctgggctttttcctcttcattatggttatcagatttgtgtgcaaatgaatgtaaacacacacacacacacacacacacacacatatatgggtttttttttttgagacagggtcttactctgttgcacaggctagatagagtgcagtgcagtggtgcaaccatagctgactgtagcctcgaactcctgggctcaaccgattctcttacctcagctccccgagtagctgggaccagaggcacatgctaccacacccagctaatttttaaatgttttttgtagagacagggtctcgctgtattgtccaggctggtctcgaactcttggtctcaagcaatcctccttgccacagcttcccaggtgcctgggattacaggcatgagccacagcccccagctaacatattctttaaccccaatatctacaggatttaagactctctctgttggatagctcaacttaaagatatggtagagctctcctgaatttataaatccaaatcaacagttatttattctcccaagctagggacccaccctccttatggtcgcagggggttccctggcacactgcatgctagttagaaagccctcacactgaccccaggctcctccctatatgcctgtaccctttggccacctacctgtggatcttttctctctgggagcctccttgttctctgtgtttgggacaggctgtcaccttctgtcaactagggtaccttgctcttaaattatcccttcaatcccacctccaccataattaaagttaaaacagtagtgggacctgcttttagcctgcagtgtgtgggcgtggagggaaggcaccctgaagctccagggaaggaatggcgccatactttgtgcgctcaccagtgccccagaaaggatggcactggggacaagagccccaaaacatgggcatcccctcctccctaagaaggctcaacagagggtccccttcagggattccatcaataaagaaagcacattttatgaaggggagttgagaagtcccaggaagatttcctcacattggattccaggggtcatttatgagtgttgtgatggtcggtgggtattttttgtcattcagggctacttctattaacattgtaactgttcattttttcccaacctaataagtttttctttttaaaacaactttatggaggtttaattggagtacaataaactgcacataaagtatactgtgtgaccagttttggcatgcagttaccgtgacacagttcccacacccagatgacaaatcttcccacaactcccagaagtttcacgtgcccactgcaacccctgcctctctctgaccccatgccaaaggaaccactggtctgcttctgaaattaaagatttcctagaattgtatatagaaccacacagtatatgttctttttttaatctggcttctctcattgagcataattttgggaactcatgtcattgtgtgtaccagtagtttttatgccttttattcagttgtgtggctgcaccacaggctgaatatccattgacctattgacagtcttggcttctttccagtttttagctgttacaaatgaaactgccataaatatctgtgcctaagtctttgtgtaaacataggcttttctttcttgagtaaacatgtaggactggactgattccttcctgaggattgtatggtaaatttatagttaacttttaaagaaactgcccaaagagttgctatgttagccttttattactgctgtaaccagttgtcacaaacagtggcttaaaacaacacaaatgtattgtcttacagttctggacaccagaattggtctcagttggtaaaatcaaggtattggcagggctgtgttcctttctggaggctgtggggtattggctgtttccttgcctctccagctcctagagtggccgccattcctgggctctgactaccgctcctcttcataccttctctctctccctcctggccgcctcttataaggaccttgtgattatattgagtccacctggataatccagggtcacctccccacctcaagattcttaattacttttgcaaattccctgttgccatggaatttaacattcacaggttctgggaattaggacttggacatctttgggggacaattattctctctactgcagattgcgtcatcactgagttgtaaagttcagttccttacgtattctggatacgagtcctttgggtgtctgtgtgtgcatgtgtgtatgtatgtattgtaaatattttccctcagtctgtagcttgccttttgctttcttatgtgtatgtgccttttaattttgaagaaagcccctttatccatatgttctcgtacgacccttgctctttgcgttctatgtataaaaccttcacataatccaagcctccaagaatttttctcctgttttctttacagaggtttatgatcctagggatcaatatttttccccaatacagatatgttttcatacagataggtatggtctagcaacaccttttgaaccagttcattttttaagtgattttttaaatttaaatatggatgagaaaaaaattcttagaccaattcccatacctattaaatagaattgctaatgcctgtgaattatgccacatgctaatcaagagttttactttgcagatgatcactcaattatctttacagatctctattttaagcaatcatatttattattttttctctacagttcaaaaatgatagcttacagctacaggaagcgatatatcaaatacttaaatacttttttctaagcccactagagcaagcttctcatttgaggcaatattactgagactcttaattttatgcttaattattcatttcagtcctttaaattcctaaacacgagaaagcactagcatttacatgcaggctcatttgtaaaggtgaaacagtgacagcacggtgctgtggaagtttctatcctgtatatataaagcacaaaatacgttagtggttgtagggaaaagcgcggtagtgctcacagcgtgttaacaacttgcaacatttgttgaagaacagatgattgcacttctcatcatttgatgttctcatcaccgtgtcttctcccttctcatactgctaggaatttgtgcttggcttgtaacattgcttctacctgacttctgttttcgggtctgagaggacatttcttagataataggtcattgaaattagttagctgaaggtgacatatggataggtcttcaggtgagaaaaacattctgatttacatagtgatgtattcttaatcactgtttttgcaaggtttctctttgtcagtatttgtttcaaaatatattaatgaacttatcatttctgattactgatttatttaaccttgtaaggactgtctccatgtcagttgtcacatttttcttggtgcctagcacaaagtaggtacccagtcaacatttgtttaattaaactgattgtattctgagcatgtgccatttctgcatacccgggatatctggcttctcgagatttttcatctatgatttgaatcaatattacatgttatgtttacttgtgtgacacaggatggtcccaacttagaaatatttgtctcagaaggggctctgtgctcagtcactggaaacctggactgaattttaatttaaggggaaagtcaattttaggttcgtttggattctagttcatagcattacagttttgttcttcagtttccacagtgtaaatgaaataacacatatagcagcaaggagcagtgagccagtcatacgggtgcagtacagtacttaaccaaaacaagcaaaccataccgttaaattttgaaccaggtaggtttgggttttctcctagtttatagacaggtatttattcatggaaggcaagttggatggagattgcagaaaacctaaaagagaggaatatattttgtgtttttggactttaacagcactaactttgatttccttttcctgtgacatacttacctctgatttttgctcacactcagcctcactgttctatagttttggagtgtttcctgcaaatcacagtgtctttctgctatacattgggataagaaaatatatacatgaattagatctggtaatggcaggccttgagaatagagcaaagggtaaaacccaaatatgtcagcatccaagcccacataagtgtgacagttctccagactgtgttaaagtttcctgattgtattaggacatattgtattgctataaagaaatgcctgagtccacgtaatttgtaagaaaatgggtttaaatggctcacaattctgtaggctatacagaaagcaagccactaaggcgtgtggcttgtgtgcctacagagcaccaggatgagctccctttgagccctggctgaagcaggagcagtggggatgaggggagcagtgtcctgaggcagctgggccctgggcgtggctcaggaaaccacccttctcttctaggcccctgggcctgtgatgagagaggctgccttggagacttctgaaatacctgtgagacctttcccccactgttttggtgtcagcacttccctcctttttagatatgcaaatttctctggcaagtggttgctccacagcctgcttgaattcctctcctgaaaaagctttttcgttctctgccacatggccaggcagcatatttcctaaacttttttgctctaccttccctttaaatataacttccaactttgtcatttctttgcttctgcatctgagcgtagtctgttagaagaagccaggttacacatagcatgctttgctgcttagaaatttgttctgctagataacctaaaggattaccctgaagttctaacttccacagaaccctagggcatgaacagaatgcagccaagttctttgctaagaaataacatgtgtgacctttcctccagttctcagtttctcatttccatgtgagaccttgttggcctggacttcaccatccatatcactatcagcattttgatcacaaccatttaactgttctctaggaagctgcaacttttctctcatcttcctgtgttcttctgagccctccaaactcttccaacctctgcctgttacccaattccaaagtcacttccatattttcaggtatccttgtagcaacacgccacttctggtaccaattttctgtattaggccgtgcttgcattgccttaaagaaatggctgagtctagataatttagaagaacaacggtttaattggctcacatttctgcaggttatacaggaagcatagtggcagctgcttcgggggagtcctcaagaggcttacaatcacggtggacgggtaagcaggagcaggcatgtaacatggcaaaagcatgagccagagagagagttggggggaggtaccatgcacttttaaaccaccagctctcatgtgaactcagagcaagagctcactgatcaccaagtggaggatggcccaagcgaaggatctgcccccatgatcagtatacctcccaccaagccctgcctccaacattgagggctacaattcagcatgagatttgggagggaataaatatataaactctattactgaccaatgcagtttctcctcataaacactgacctgatgcagggtctttttggcgtagagggggcatggagattagttcattctgattggtcattaccaaaggctgggcaagggcatgtggtaagggatgcaggagtgcctgtggaatatagaatggtgaatgaggctgagcagggcaggggtcccagggcccagagagaagtgcctggcccaccatccacctgggaacatgctaggggtttgctaacggatggccaaggtggctgggaagaaaccaggaggcaggccagggtaggagggcagccacactcatcccatgagtctagtcggcagcccagggtccttggccagctcaatgacttatctcctttaagggacttgattgtctcaggcatgcctacagagtttccaccgccagccagagagccaaaatgtttcccaagccaatcccatgagatgcctcacttctagtgagccacccccagcccccacaacagcctccagtcagggcccacctgaagcctcccttttccaactgtaaagctttcccagctccccaacctgcatttgagcttctgccaaaggcaagtgctggtgtccaactttcttgctatgcaatctctgaatgaatagcctctgctcgttctcatttgaagagattttcatttaccttcacacatggacagttatctttataacttaactcagtgcctcctcatttaccagaatctggtcttttcgtgggcttctcttgtcttcccgcaaatgtaataatgccttcctatgacactaggatgctttgagcagatagactcttccagtccatgcaaagaggtggtgtggtttggcctcactcctcactgcaggcttaggccagctcccccttgcagccacgtgcgtggacgtgactctgggagtgaagtgaaatagcgctgccgacaggatctgggctctgtgctgtgtgccaggagcatagagagcaatgtgaaacagctgttgcccacagtgacctttcagaacagtttttgctgttagggttctagggattactaagtaagcttggctggttaagaaggtcaaaaaaagcccaaggcaaccccagctgtctgaactagccatttcagaaggctgaaacctttctgctgtgaagggctggatttcctagcttatgtagttcaaagctcagtttttaggattgctgtgctacttactgaccgaaagttggtttttggaaattgacccttattttccaatatctttcataaagctggaaatgctttcactagaagaaaaggaggatcttatgttagaacatatatatatagcgatgtaaaagtttcagtagttactctcaaaagaaggtcaccaaggacaactgtgatttcatatgtaatgattccagcctagaaaatgtttttttcttgatttccatttaagagagttgagccaattaactaatccttgcatatggtatgttccattaagttgtcagtgtttttattccaagatgcatgtttctttaaaagagctagcttattagggcatgtcttcataagcactttaccctggccatgtccgtgagaatgctgtgcataactttcattgaattctacatctcatttgatgcaggcctaattaactattattaactgagaactccaatttattggaatcatttgctgcagttaacttgagaaagaatggggcatgtttaagggtccttatttttaaatctctctttcattacaaacacattaacataagtctgatttgggggtgacagaaggaaataggaaaataaatgtaactaaaccataatggggtacaatataaaggaaagtaagtactgggatgaatatcatcatagattgtttattctttaatttgtactaatttgtacatttgtatatgtacaattaagcacttcttagttaagattgatatatttttaaaatcacaactttatagagcacaagtcttacatgaaaacataatgccaggtcagtggccctccacttgagcacacattcaaatcactgagagggctctgtaaaacacacattgctaggtcccaccccagcttctgattctgtagatctggggtagggcctgctgtgtggtttgaacgtttgttctctctgaaactcatgttgaaacttaatccccaatgtggcagtattgagaggtgtggggtctctaagaggtgttgggtcatgaaggctctgccctcatgaatggaccctttcgttcatggattaatagattagtgagttgttggatgaatgcgttatcaaaggagtgggactgctggctttgtaagaagaggaggaggctgggcactgtggctcacacctgtaatcccaggactttgggaggccgaggcaggtggatcatgaggtcaggagtttgggaccagcctggccaacatagtgaaaccccatctctactaaaccccatctctacaaaaaattagccaggcatggtggtgtgcacttgtaatcccagctactcgggaggctgaggcaggagaattgcatgaacctgggatgcagaggtttcagtgagctgagatcacgcctttgcactccagccctggctacagtgcgagactccgtctcaaagagagaaaaaagaaaaaaagaaaaagagagagagagagagagacctgagctagcatactcagccccctcaagatgtgatgctctgtgctgcctcgggactccatggagtccccaccagcaagaaggccctcccaaaatgtgtcccctcgacgttggacttctcagtccccataactgtaagaaatgaatgtcttcatacattaccacgttttaggcattctgttaataagcagcagaaaatggaataagacagagtccaagaatatgtagttggacagcatctcacttcatactgatgctgctggtccggggacctcatttcgagaatcaaggtgtttaggaaacaagcagtagaatatcttagatgaacaatactagtggtgtacattttaaataaattgaacaattactgattagctactatgtactgtcaaaatggttcagaaaaatgacaccaccacttctatcaaaatgtactggatgttgggttttttaattaaagcaacttcactttaaaatgtggttttacacacattcaaaacactgctgaccctctttcctcagctgccattaaggtgcttagcccttccgaggaagctaaggccttgtgaagctgtcactcattgggtgactagcaccctgcccggtggcaccagccccgcactcgcccacaccatggcctccatctttgtttgagctcacttgcatctactcggccctcattctacagtgcagtgtggtgaccatcacataagaccgtcgccctcattaaagcagctagtgtaaatggtgaaacttttgggcctgacctgtttgcaagggcctggccagtgtcaacatcgggagcctttttggtagcatgggggctggtggacctgtacctacaggcagttctgcccctgtaccatttccccagccagagtcaacattgggaacctcctctgcagcagcatgggggctgctggacctgtacctgtaggcagtcctgcccctccactgctgccccagctgagcagaaggaagtgcaagcaaggaaagaagcatctgagggatctacttaggacacgggctttaatctttttgaagaaacctcttttgtaacatgatcagtgaaaagctgaactcttggctgggcaccgtggctcacacctgtaatcccagcactttgggagtccatagtgggaggatcactccaggccaggagttcaagactagcctgggcaacatagggagaccgtgtctctacaaaaaaaattaaaaatcagcctggtgtggtggcgcacacctgtagccccagctacttgggaggctgaggcgggaggatcacttgagcccggggggtcagggctgcagtgggatgtgatcaccctactatactcaggtgagaccttgtctcaaaaagaaaagctgaactcttaaaacgtgcacacacacagtcagctaacatcttcataactgtcagattgtgacaatttgattctaactcaagatcagcctttcttgtagtttattttgtgtctttaaggaactagcctatctaacacaaaacactggctttaagttttttctcttttttgtaattgggaataaaaattatgctcaagatacatcaagattagttttggagaaaaaaagcattaagtagattcagttgtgcaagatgcacaaagtgtaacttcataagtaagcggtcacaaactcgggttcataatccgttacccaaaatctatggagccagatgtatttaaatataggttatttttaaaaggtattagaattcatatgttccatgacacagaacgttctcaggcagcacccgtaatcaaatccattagtatttctatagggaagtgcttgaagagtcgcactaagtatgataaatgtggaccattaaaaccacctcatgctagcccagtacagattttgcagtgttttcagaagcttttgggttatggaattgggaacagaggctgtgtttgttcctctgcagccccggcaattaagaagtgtttgtgaagctggtttaatgtgcctagcaggtgtgatgtattggtgaattccaaataattgatagttttgtttgcttttttttttttttaagcaaaatatttggtaggaggcactttagtttctcaagttcaatagctgtttgctcttactggagcgttgctgttaagggagacagcagatcttgtcaattccctataactcacggttaacaaaagcattccctaatgattccatatgttgatgctcagaggtaattctgggccaagcgctcagagcacaacacagattatttcactccatggacgcaaccgcctagaaggtgtgtggcatgactacatcattaggatcccattttagaggtgtgcaagccaaggtccagcaggcttataagacctgcagtatgaataggatcctcattttataggtgctttacccaaggctgctagcttccagagtttccggctagaaagctgcagagttggggtttcccgaaagaccaccaggctttagaggacctggcttcactgcctgggctgcctgccacctcccacacctaaagcatctccccccgccccaccccacccccagctttaaggccacccccgctctgcaggtcagcggctattaaatacatttctccaataaacatcgtatgttagacaggctaagaaacttgtcccagggcgtgcagctgagctgggagttttctgcaggtctcttgggtccccaaagccctaggtcttgtatgaacatgagggtaggagcaaaatcaggccttcccatgtgtattaatgttactctgttctcacactgctataaagaacttccctgagactgggtattctgtagaggaaagaggtttaattgacccacagttccacatggctggggaggcctcgggaaacttacagtcatggcagaaggggatggcaaggcagcaggagaaaggggcaaaggaggcacttgcaaacacttataaaaccttcagatctcactatcacgagaacagcatgggggaaaccaccccaacgatccaatcacctccctccctccacacttggggattacagttcgagattgtcaggcctctgagcccaagctaagccatcatatcccctgtgacctgcacgtatacatccagatggcctgaagcaactgaaaaaccacaaagtgaaaatagccacttcctgccttaatggatgacactccaccattgtgatttgttcctgccccaccctaactgattgaccttgtgacactccttctcctggacaatgagtctcagaagctcccccactgagcaccttgtgacccccacccctgcccgcaagagaacaaccccctttaactgtaattttccactacctacccaaatcctataaaactgccgcacccctatctccctttgctgactcctttttcggactcagtctgcctgtacccaggtgattaaaaagctttattgctcacacaaagcctgtttggtggtctcttcacagggctgcatgtaacagatgagatttaggtggggacacagccaaaccgtatcaccatatgtgcttcttaatgacagttggctcaaggtgttttccccgtaaataacgcaactcacagttataaaattgaagataggtccccatttgcatggtaagcaggtacagctccctgagagagcagttggggagaaaccctcgctttttatatctttgttgggtaaaacatcaaccactgtgcctcaggggcggacttagtgagcatttaagatacattttcagttataaaatgttacttgatttgcagcaattacccagtctccgccttagacagaaacttagaggccatcggcctagacttcctccaggcacagggcttccataacagttgaattaatttaagccttaatgcctcccataagcccccgggaactcaggctgcctctgaggatgaaaacacccgccagtctttgggccccagcctggggcaccctgtagcttcttcagagcttccacctccctgccaggctctccccctccccatgctgcccttgcagctactacagaagctgctctcaacatgccacacagattccagctgggaggaggggagtggtcacagtcacaagggatattttctaattctcctaaggagggtagtagtgtatgtggccctagcatgttaaaaacaatatgacctttcctggtaaaaaggaccctgaagcaatgttaaagctgcaagcttgttagtaagcagggaagaatatccatctgatggccctagtgcaagtgttttatgctcctttattttatttcagcatttttcctttcacaacgctgtccctttaagtgtgccatcatcaacagctgtagttatcatttgatctgaggagtttaattacttgtttagatcctttcttattccacggatttaggattattttatctaaatggtgaggaaaagtgtctgtctgcacagtcccctacagatttataatcccacagttctgtgtcttttaaattaaaagctccatgacattttaagctttaaataaacactgttggaagcatttttagaggatacagctgttttcctgcctttgtccacactcctttcttcctgttcgcacactcgccttagtcagagttccacggagcacctccatcgtcctgcctgccctctgttctgttccttcactcggcttttcaaacccgacagtggtgtctcacttgttcgatgcctgcagtttccttttgtcaatcttcctctctcaactactagaacaaacactcaaggaagtaaaatgtgccgcctcactgccaatccgtccatctccttgccctgagagccttggctctttctccccctcacagagaagaagaaaataaaaggagcgctcatgcctgggtaaccctcccttagaggaggcttttcaccactcagctgttgaggaggagggtgggccagcccttccttctgttctgcagcttctgtagggagaccgagtgcaggatggaatccaggaagccttgagttactcaggttgttacttgaacttcgacttctacaaaccagcccagacttttctaagagtcctgtcttttgtactctcctaaagggctttgagccctccattcagggattgggccttcacagtctgcagtatccagaacggtggaggttctgaggtttgtttggtgtgttttacagcaaacttaataaaatacagcttgtggccaggcgcagaggctcatgccttaatcccaacactgggagaccgaggctggagaatcacttgaggccaccagtttgagaccagcctgggccacagggcaaggcatcccatgtctacaaacaaaaaaataaatgaaaaaaatacagcttgtggtagaaaagcaaggagaaaaatattatagtgctgaaaatgaaatggcacctgcagatgcagctgtgggtggatttgccaagaaaagcagagaaagaacagaggagggctcttcttgttgctgttagcagtcaaaaccagagtatccatcaggaggtggagaagccaggggtcttctgcagggaagagggccacagagggggtcagtgcacagggggaggaaggaagatggggagtgcagggcaggggccacccaaaagcccaaggaagagcccagtccacaataaccagcctctcctggtctccagtgtccacagggtggactgggcccagcctcagccccatcccaggaggaagagccagagagttccccaggcaagtgcagtgagccctgggaccaggagagaagcgtgcacagaggcaaagtccacaccgtggcagccaaagcagtcagtgagcccagtcctctgagtataaggcggcaagagccctagccgatgctgcaggtgcagtcaagagatgcagtttggatgctgctgaaggaacatgatacagggccacacggaaaactttttctcaagacagcagcactctgcccttggttcattcaggaattttgcatataggtggtggatatgattgactgcccaggccttgtgtctacacagatgaccattcaccttctgtgagaaagatgcaggagacaaagcacaggtggccctaccattgcagcggctcacaagagaccttcccggcctcctccatgtgtgacacagcgaatcctgccgtgtggtgcaggcagctctctgcatgcctatctgggaggagcagatattttggagttaaaacctgccctaactctcttttttttgaagacataatttcgctcttgttgcccaggctggagtgcagtggcacgatcttggctcactgcaacctccgcctcttgggttcaagtgattctcctgccccagcctcctgagtagctgggattacagtcacatgccaccatgcccagctagttttttgtatttttaatacagacggggttttgccatgttgcccaggctggtcttgaactactgagctcgggcagtcctcctgccttgacctcccaaagtgctgggattataggcgtgagccaccgcgcccgccccataactctcctttagtcgcagttcataccttgccaactttcaaaacacatcgaggcaattacagacaagcatgcatacctatgtgcatgtaagcatgtgaacatacataggagtatgaagacttacatgcctcttggatacacatagccttctctgtgcgtacacgttacttccctcagtgtgtcctgggtctcccagatactatcttacagggaaaaaaactagtatttagggatgattattgtatttgtttatgtcattgtgggacagttaaaggccattgagatcgcctgctcttttcaggacttcttgttgggtccagctgtacagattcaaggtagactacgtcctgctaatgctgctccacaccctgtgggaaggtttcagtgctaaatctagaacaggtggtcagtctcctaactgaatttgaatccagatttttgtcagatgcatccgtgtgtcttcttcttaaatcagttgtgaacagggctatttccagcctctcgggttcagggactgcctctgtgccaccgcagactggaagacaaggactctgcccaggccttgggatagccttctgccttcactggggccttggggggattgtcatcaggcaacactcagctccatggagcttacctgggtttgaaattccacttggtagacattcctctgtgttgaagtatttctttttttttggcataatgcctcctagcaggtcagttagttggttcttcagtaaagtaatctttctaggcccacactggagacagagtggggaagacagctagtgtgtaacaagcatgctctaggaggctggcactagaatgttacttatgtgccctgaaatattcattctgtaaagtaggattatttcactgtagtagcatcctcagtagtattcttattggtaatatgagtgcaattgatactatgtatatattaaatatacatacagaaaaaacacatgaatagaaatgggtgtgagccagtactagttattatattgtatgtagtgtaatctagcgtatattagtggtactggtactattattagcagtattcctgttcatcttgtgtaagcgtgaggaaagcaggcacctgcaggctcactatgtttctgaggctgtgccctgagtaagtgccgagccgggagttaattctcaggtcagctttcaccatcccgtgacagcctgtgcattaaatgttctgttcttacctgggagcttcacagcagcatcctggccaggcatggtggggattcatcccactgggcagtggaaatgtccttaatactagtgggccatgcagtggactttgtcagctggtgctggcttccatgttgttgggaacaccgagtaatgatgccttgtgctatcgaatggaattgaccattccaaggatatatttagattcaaatacgtacatttaaacagaaaacacaataatacagatttcatttctctcctgagttctgaatttccagatcacaactccagacataactccagcagccttgagaggaggctgcccatagtataatttagtgagaatgacctgcaagcctttctcctgttcacttaggtctccacaaaagcctttgttcatggaatgagacctacacagtgtatgtttatgcggacctgatacaaacttactgttcatacagtatgcactctaaaaatctcttttttttttcctgcagatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggtgcggttgcctcgctgtttgcagggttatgtttgtgactattagcaatggttttgtaaatcacctttaaagtctagcatagggcatgcttagtttgtcctcttttcttcagtatctaaactaagtccctcctggtgctcctgaaagagtttggctgatgctgtgggatgctgtgattcaattttctctttaaaagcttcttaaaataatatgcgttagtttcagtgatttctgggttccaaaaacatttgagtattgtttatattactatatataaagattatgttaatgacagaatgtcttcaaagtttaccttaatagatggttttgcctttttcttttcaaaatcagatataggattaatatttcagcaactattcaaactttaacaaattgataagcagctaaatctccccaaagacgcttaattaaaaaaaaaaaaaagtaaaaagtcgaattcatttttagcctgtgtgtttatatgccgttcagccctttctttacttgtatccagttttcttcggaaaggaaaaacaactttgttccctccgtgcttgttaactgacattcaatcagaacgggcttgcctgacgctccttgttcaagaatattctagattacagaccttgaaaatagactatttgaagatttttctgggatatacaggatgaatactctgtctttagaattcctggtgctaggggagaaaaaaaacagcagttatgtgagtaatcttggatttaaaatgatattaatatgaagcatacctacttttgaaatgtatgttattatttatatttatacatatgtccaaacatgtggattgaccattcctgggcagcacacacacacatgcaaacacacaccctttgtaatcactctgtctgcatccactgaaaatggtagtgtttgtgaatctcaggcatgggtacgagcatcgtgatactcagttctctgcatctagtgtctttctgcaccatttgcacatgaagttaccttgataagtcttggtgaaacacatccatacagttactatatacaaatttaattgtggtaggacacagacacacacactaaaatttaccattttacctattttaaagtgggcagttcagtagtgataagtctattcatgttgctatacaattgacctccagaactttttcatcttgcaaatctgaaacttcgtgctcattgaacaagtccccatttcgccctgccctcaacccctggcagccaccattctactttctgtttctaagatttttactactctccatacctcaaataaggagaattatgtagtatttatctttttttgattggtttatttcacttagcataatgccctcaaggttcatccatgttagagcatgtgataggattttcctcctttttaaggctgaacaatattctatggtatgttagaccacattttgtttattcatagttcatttgttgagggacatttgggtggcatccacaccttggctgttcttgtgaataatgcttatataaacatgagtgtacaaatatctctttgagatcctgctttctagtctcttgggatatacccagaagtggaattgctggatcccatggtaattttattattaatttttgagtgaccaccatattgttttccatagttgttacaccattgtatattcccaccaaaaatctataagggttccaattactccacattctcatcaactcttgccatttcctggatttttttgatagtagtcatcctaatgggtgtgagttgatatctctttatggttttgatttgcatatctgatgattggggatggcaagaatcttttcatttgcttgttggccatttctgtattatctttgaagaaatgtctgtgcacatcctttgcttatttttgatttttgtgtttttgtttttatgttgtaggagttccttatgtattttgaatgttaaactgttatcagacatatgacttatgaccattttctcccattctggctcccttttcgcttagttgttggtgtgcataagtttttgattagatgaatttgacatatgtcatctcatttgtctaattttgctcttgttacctgtgcttttggtgtcatagccaagaaatgattgccaattccaatttcatgaaactttaatttatgttttcttcctggagttttagttttaggtcttacattcaggactttaatccatattgagttaattcttgtgtatggtgttaattagaatctagcttcattcttttgtacgtggatgtccagttttcccaacactgtttgttgaagagacttatcttttccccattgagtagtcttggctggctcgttgaagatcgtttgacaaatacgtgagagtgtatttctgggctatctattctattctattagtatgtaggccagtactgcactgttttgatgaatgtagctttgtaatatgtttggaaatcaggacatgtgagacctccgattttgttctttttcaagattgttatggctatttgggatcccttgagattttttatgaattttaggatgtatttctctgtttctgctcaaaatgccattgggattttgatagggattgcattgaatctgtaggattgctttgcatgctatgaatgtcttaatattaagtcttcccatccatgggcataagatgtctttcaatttatttgtgtctttctttcagtagtgttttgttttgtagtttcagtttataggtccttcacttctcttatttctaggtattttattcttttgatgctattataaatgggattgtttataattttctgttcaacttgttcattgttagtatattaaaatgcaactgatttttgtttgatgtgtattctacaactttgctgaattggcttattggttctaacaattgggtttttttttttaatatgttgaattgtagtgatttctatatatatgatcatgtaatctgtgaacaaagataattttgtttcttcctttccagtttggatgccttttgttgtgttttcttgcctaattgcctggctgagacttccattattatactgtctagtagtgacaagagtgtgtatccttgttgtgttcctgaacttagaagaaaagctttagtcttcattgagaatgatattagctgtgaacttctcatatatggcctttaatatgttgaggtagttttttttttctatccttaatttgactgtttttaatcgtgaaagggtgttggagcttttcaaatgcgttttctttctgcatcaattgcggtttttgtttttttttttttttttggttccttattctgtaaatgtggtttcatatgttgaaccatttttgcattccaggaataaacttcacttgttcatgtatatgatcctttcaatttgctgtggaattgtttgctaatatcttatttagactttttaacctgtgttcatcagggatattgatctgtattttgtttttcatatagtgttttccatgtttggtagggttctccagtgaagccatctggtcctgggcttttctttgtggggaggttttcttttattactgattcagtctccttactacttacagatctgttcagattttctatgtcttcattttttcccccttctcaaaatcatcagggattctctgtcttcatgattcagtttgggtaggttgtgtgtttctaggaattcttttatttcttttaggttatccaatttgttgtcaaaggatatgccaacaaatagtattctcctttatttttgtggcattggttgtagtgttgccccttgcatttctgattttagtcatatgagtgtttttgttttttgtttttttagttaatgtagctaaggtttgtccataaagttactctgtgactgagtgtcttttgtgactttacaaagcactcatgatgtatgaggcatgcacgtgtcttatttcttccatatctacccaagcctttcacatggttttctttctacactttttgttctatattctaagatatacttgaaatatgttctactgcaattcttaaaaagaaaaaaatgttttatctagatagtctggtagtttggctggagtgctagtgaatctgttttatggaatctacttggtgatcccatcaacgtagtgtcttcatttggctttctaagcgagcaggtatcagattaagtaaggtgccaatcatagaaactcatagaaggtgaacaaccagccaggagctagttcttcaaagatagttcagtcctatagaacttatctagatggctctcttttctttctttactactttttgacctctttaacttttttttttttgacttgacaaatcatgttttttggcatatgatttgtgtgtgcgcgtgtgtgtgcacacgcatatacttattttaacttttactagccgctcagttgcgagtagggacttcaatactgaaagtctctctttgaaaatgatcatatctacatgccatatacacaattagctgtgctttgacagagcagagcatgcagaagacttgaagagtatacagaaatgcacaaggtaatgctggagagaagaaacttaaaatcatgctgggatgctggctcagatgatgtgcagggacagtggtcagatgatgtgccgctttggtattctgaaacgagttaggtgtaggataagacaaaattattagaaatcatacttaacctgaagggaaagcaagccagaggaggacaatgttggactgaatgtatagagcagaaagacaggccgtgcctaattccaatccagaaatgtgttcttccttagggtttctgctcaatattataccagtcacaaaaatgaagataaaatagctcttctgtcctgaaagaacattcttggagacctagtttccattcattttgcactcctcccatctcctcttttatctgcgccaaacctgaattcccctcggaaggtgaccttatagcgtcattgctctggtgactagattcagagaaacttgctgctgtagtctttcttctaggtgttcattttgctcacttactactttgttcctgttcttaaggtgtagatgataatataacccttgactttgtttcttttccttctggaagtattttctggtagggtatgttaggttgtggaaatgaccttgagctctttagaaaagaaagctgtctgtagggagggctttttaattcaacgtcattctttttcacatgctttcagagcgacagccgaacccaaggaggtatttagcaagttaaattgccggagtgaatggtagattaccaggggaagcagcccctgatcatgctgcaggggctgtgtgctgtgattaggctgcaggagggtgtctgcttgggccagtcaccagggaatcagcttgattatgctgcagggacatgactacctgggccaataaccagggaatcagcttgattattcttgggggtgtgtctgtcttggccaatcaccgaggaatcagtccaattatgctgcaggggtgtgtctgccttggtcagtcaccaggggatcagcctgattatgctgttggtgggtgggtggtagggggccggggagggggacgggatggggtgaggtgggggacggatgggtgtctgccttggccagtcaccagggaatcagcctgattatgctgcgggagtgtgtctacctagaccaataaccagggaatcagcctgattatgctgcagggtgtgtctgccttggccaatcaccagggcatcagcctgagtatgatgtgggggcatgtctgcctgggccagtcaccaaggaatcagccccctgattatggtgcagaggtgtatctttggcttgatcatggtatagaagtgtatctttgccctgattatgaagcagaggtgagtctgcctggtcatggtataggagggctctttgcctgggccagtctagccactaagaagacaaggtggacctaatggacttgaaagacgaggcagagtggccctgatgcactcgcacatcagctgcctatttgctatcatcacatttctggaaggccctctctatgaaaaggtgggtgggcctacgatgtcctcagtgggaaatccttttgagcagttagttctgtaggcatttcttatatggcttcatggttccatgtaaactgtcggtcagccaaggcttaaattattttaggaaaataaacttttaaattgtggcacaaattttagaggaaaaaatgcatgtggttcatctcttgtgagttttctagggattttaaaaataggtaccgtattacaactggaaatgtatgtcacattacttaaaaaaaatcttcacttaggatatcagaaaatcttgtttaaaacatagcctatgctggttacctccattgtatcttgaacaaatcctttcagtaatgaattccttgggacagatgaaattctacatttcattataactcagcgagggtaatttggattcaaagaccaataagaagaaagttggtgccttttattgtgtagaatcccccaggagttttttctgttgtcccagctctctgctttcccatgtgttttcactaagcatgagattcctagaggaagagcccagggcatggtatctgggccagtagaaaggacagcctgccttgcagatgtgctcctcagcctggccggctctcccctgcatctcttggccggctctcccctgcatctcttggccggctctcccctgcatctcttggccggctctcccctgcatctcttggccggctctcccctgcatctcttggcccttaccgcctgcaccaggctctctggtgttaacttcctgccctctactttccccctctcagaccatctggagcagaaaaagcaaactagaaccctggccccctggagagtcgtggatgggtgccagagctccccttaggtggctgaggggagggagcaggtgtggcctgtgtggtagaaaggatgggtccagtcacagctctgcagcggagcactcctcctgctgtccagccccagtccccttaggacagtaggagtactgactgacatgcccactgtggggtactatgatctgaatgtgtcccccaaatctagtgttgaaacttaattgccagtgtgataggattaggatatggggccttcaggaggtgattaagtcctgaaggtggagcctcatggatgggattagggctgtcatgaaaggactagagggtaaggcctgctcttccattcctctgtcacctgaggatacagcattcctcccctctggagggtacagcaacaaggtaccatcttgaagcaaggagcagtcctctgcagagacagacctgctgatgccttgatcttggacttcccagcctccagaggtgtgagaaatacatttctgttctttacaagtgtccagtcccagatattttgttatagcagcacaaacagactaacacctggggcattgctgtaagacaaccttggagcatgtgtggttacacctggcccagtgagtggctcctagcaggcacttgtgtcatctcctaacccaggaggatccagtcctcaccctgaatcccaccttgaggagttagtaaggtcgttctccatccctgctcggcttcgttgaaaagcacacaccagccatgacatggacaccatgcacatgacatgggctctagtcctctttctgtccaagctgtgtcttcctcttgtaagtaagccttcctcctcaggctgacttaggtaattatggttgtttccatccttctactttttttctttttaattttgttcttggtttattttcttacaccgttgtcttcctggctgttaacagatacacccccaccctttccattaggagcatctggcaggaaggcactcatcctctggaagtcagctaacaacttgcctctctttcctctgaactctcgtgcatgtagtgctgagtgagtgctcggggggacacaggagaaaggtctctttcctaatggagtatgtcatccatttggggagaggggacaggcatatctgcagcatccaagtgaaaacccgtggtaggatattgttgcacagcaaaatgagaaattcaggaaagagatgccaaagggatgtagaattaagtaaagcaagatattcttggagtagtggccgctcctggggtagggggtgacctcgggggagtccacaagaacagaagagatacagatgggagaagccatttcaaaaggaaaacagcacctgtggaggattccagtcagccagtgagtttgcttctatacagcatgaagccaagcttctcatggctcacaagcttcagagaggaattgtggctctatgagttgagcttcttattccccagctcatctgtttgctttctggatagggagaaccattgggatttttaaaaggaggcgtgtcagaatgcaacctgcacttggggagaatcctctgggtttgtggcacacaacgcctgcagcctagaagagatgggccagaggaaggccagggtgatggtaaaagacatgcaccccccttgactgggccatgaggtgtccagacggaacattctttggagtgtgtgtgtgagggtttttctggaggagattagcatttgaattggtggattcagtaaaggagattttcctttccagtgtgtctcatgaaacacatcatttttcgcatcatgaaatttgtcactagaggaatgaaaggatgatcttaagtagggagaatatcccttcaggataaaaaaaaaaccacaatcatgatatgcttttttttccattggagacacagtctcattctgtcacccaggctgcagtgcagtggtgctatcatagttcactgcagcctcgaactgctgggctgaagcaatgctttcacctcagcttctggcgtggctaggactgcaattatatgccaccacacccactaaggtttttttctttttttctttgtagagacagagtcttgatatgttgcccagtctggtctcaaaagttctacctcaagcagtcctccttcctcagcctcccaaagtgctgggattacagacatgagccaccacactgggccttttttttttctttaattacacaaattacacttgtttcacacggtacaaaaatgtatagcattaaaattggaagcccttctaactcccactctcctactccctggagataaccgttactcagtgtttaactatttaaggtacctcatttcaccccttgtcttatgatgcctatgtgtttgtgtgtagacccacaggcacacagagatatgctcacctacactcacctacatgcacctttatggaatgaggccgctgacataattcaccaagatccagagcaagtacctatagattaatgggacagaaatcccaaatgctttaattaaattgttagtcaattttttttttttggaagtaggtctaacaaaagtgaggacatctttttcctagctcttaaatgaattgtcactgtggatccctgaaatgctggacatcccttgggatgggaaggcactcagagcacttcctgcctgggagcacttacaaggttgcattagtccatgcagtgctaacatgattcttgtgtcaaggacagcttccagaagacctcagcaggcaagctgtgctgctttggtttgtcctccttagtgatggaggtattgtgctgtccacacccttacagtcctgtagattttcatatgtccacactgacacagtcacatctcttgttccgtctcctgtgccagtggcttcagggccagctgttacctttaggaaccaggaagcacccaggtcagcttccaggccaagaaggaagccagcagaagaattatagcccttggtttataggccgctctgataatccattactttctaagtctgggcagcaggcctcagtgttgaggggcagtataacacctaggtggcaggagcctcacagagaagagggacccatttgtgtacatggcacaaactgtgtctccacctgcctgtcattcctggcctatcctcagccagatttcacagctcggtgctggggctatgccagttagatctacccagggtgttggggcttcgagtctcattaagatggacagtgcctaggaaccccagaacacattctctgtgccatgttcaggaaacatgcacctgaagggtattcatgccacttttccttgttggtgtccactatggtcgtgttggctcacaagcattgaggactcactgcatgtcatgctctcagtgctttcactcgtgggggtatgtgtcagcctcctgccgccgctaagaagcagtcgctcttagcacagggaatggcaggtaggactgcaggggtcaagttacttgtccaaaagcttgcagcctctgattatggaggctggcctcgaacccaggtggggaatgaagagtccatagctcttagccacggcgctctactgccccagatgatgtggcggtgaccttctgttgaggtagacaacatcagagtacaaaggggagaagatgtgttctgacacgggtcacagggctgagccctttaaggccatatataacccatgtggagaagtccccagtgctcggggactctgcctcgtccagctccgtttctggtggtggtctcgatttggggcactcagctgattctcagtcgctggagaggctctgctggcaaagctggacctcagggatttttacttaggcagattgtactccttggataacagcacaattaaaggacacacacaacaagcgaaaaggaaaattgtacgctgacagtcatggtaacacattcaacttacgctgtgttccttttccgtttaacaaatcgaattagccccatgttcaggaaaatttatgatcgtagggaggaagaagcccatttgccagtcaaatgtaaatgtaaatgaaaattcttaccccccttttcctttaaagtatcagcttattggccaggcgcggtggctcatgcctgtaatcccagcactttgggaggtcgagacgggcggatcacgaggtcaggagatcgatcgagaccatcctggctaacacggtgaaaccccgtctctactaaaaatacaaaaaattagccgggtgtggtggcaggcgcctgtagtcccagctacttgggaggctgaggcaggagaaaggcgtgaacccgcggggcggagcttgcagtgagccaagatcacgccactgcactccagcctgggcaatggagcgagactccgtctcaaaaaaaaaaaaaaaaaaaaatcagcttattcaatgatgtatatggacattattcctcttttctgaatatagtgactttcataggcagctaattgccttgttatttagtaaattgtaatgaagacatcctagactaaggagaataagatacaaatctttgcttctgatcatcctagatattacctcactgcgcatgtggagatgtttctcaaagaattacaatttatattttttgctttgtttgtttgacacaggatctcactctattgccaaggctggagtgtagtggtgcagtcatggctcactgcagccttgacctccctggctcaagtgatccccccaaacccaagcgatcctcccaccttggcctctcaagtagctgacacttcagatgtgtgccaccatgcccagctaattatttctttcttttctgtagagacagggccctactatattgttcaggctggtctcaaactcctgggctcaagtgatcctcctgcctcagcctcccaaagtgctaggattacaggaatgggccaccacacctggcccagtttctgtttctaaatgtgtggtggttctcctgtggatttctaagtctttaggagtataggataatgaacaagagaaatccttacctcaaggacctctcgattcaaaggagaggaaatgagtagataaatgaccacaatgggttgaatcaagtcactgtccctccgggaggggtgtgctcacagcataggacagcactgtggagctgcacagacaggctttgaggggtgttaggtgccagcactctctgcacactgcagtcaggacgagggagtggggagggcagtgacttttaggtgagcatccaggtgtagagcgctgccagcttgccccgagtcccagcacccgctcacagcctcctggcgccagtagtagaaatggttgcacaaagcaaccaatgagaaatactttcagttttccatctgccacacagagaaggtaggagaggcttgcaaagggaatagcatccagtccttttgttacttgggcatggaaagttggggttttccttttgattgagttctgggaagtcagcatgaatcagctttcggttccctgcctccagaccctattctcctgcttcagtatgatgtccctagagttgtcaaatccatagaggcagaaagtagaattgtgattgccaggggctgggggagggggatggaggttttagcatttaatggggacagagtttcaccttggggagatgaacacgttctggacatggatggtggtgatggctgtacaacaatgtgaatgtactgaatgccacagaattgtacactgagaaatcattaaaacagtacattttatattgtaggtgttttaccacatacaacaatagttattctttttcaaatggcaagaagccattcaaggattttggagttgtgttttggcaaagctcctgtgcagatgaggtagaaagcctgtagtgagtagacacaaatgtggtttttcacataagtgttgtggataagtgcatctccttatccccaacagaatcatacactcttatcagggaagacaggtgtctctcatacgccccaagcacctgggtcatggggacttgggcccagtgtcatgggcaggtttgagtgaggtcaggagtacctcgcaccacgcctactctcttgaggtggtttctgcaccacttctatacggtgggacctttcatctccatagcatggtagacacaagaatacagggaaagtcttactctctcctttctagaggattccttagagagtagactgtaagagcaagactttaatatttgagactattgacagagacaccatcaacagaaactcctcacaacaaagctctagccataaaactgaaatttctatgaaatatttgcaaaaaaaaattgacaataggaaactatgatattttatagtaagtagtccacaaattaggttaagaactttaaaattagtttgggattactataacttaaagtattctgttatttttgtcttattgttgaatgcataaggcaaaatgaatccatttttgatgtgagttatttaaaagaagaatacttttctgttacctcttatttgtgaagaaattgaaaactgaaactctttcccaatctttatatcatttgcacttttatgtttgttttgtgacgtagtcagggttgttcttatttgcattatgtaggtgaggatacaggttcagagaagtgaaacggagaaggagaagtttgaccctggccttgtaggccattaccaggctgcttttattgagaacctcaggtatggcattctctacgatgagttaaatgccttcttcagattgggttttataatacttgtgcttgtttaggtaagagaatttacattgtttaatcacgtagagagctatagtagaaaatcaggaaaattgaatgagctattatgttaacatttcctagtttgtatcttttcctttggctattaatcataagctatttaaatagctgttttatacatttattttgtagtgatagatccttagaagtagcaacccgaaaagtgattcaaagtaaatgaaattagtactgtaagcagctttctggcaaatcaaagaagacacaaaatcaaatatttttctgaggatggtcagtattttgagatagttggtcaggttctccagatcttaagaaagccaatgaaagaaaaagtccatttaaggccgggcgcggtggctcacacctgtaatcccagcattttgggaggccaaggcaggtggatcacttgaggtcaggagttcgagaccagcctggccaacatggtgaaaccctgtctgtataaaaatacaaaaaaaattagctgggcatggtggcgggcgcctgtagttccagctacttgagaggctgaggcaggagaattgcttgaactagggaggcagagattgcagtgagctgagatcatgcctctgcactccagcctggtgacagagtgagactctgtcttaaaaagaacgaataaaaagtccagttaaatgtgccttccctttgagtttccagagctttccacattctagtgaaacctaggagacctgagttaccacagtcaagtggtgaactaagtgtgtcctgatcagaacaaaatactgttcctcggtatctttccctttcttttttatttaccattgacagctggctacagagatcatataatctccagaaagaatgctggtatagcttctgtgaggacaggaggctcctgacgatcataaagtctttttcatggagtcaccattgaccctttggaagtgttcagtgccacttctttctcatatcaacgtaaaactctgcaaagtcatctccttctcatctgttacataatacaaaagaatgcattttacttgattttcagggcaaagagcagattctgaaactgatagcacatttgcacactgaactcagaatttgccagtggtagtaacctttgtcacatggcggggagcacaagattgtgtctgattgtgtctggcctggttggggtgaagtcggggctagtgggtcgcttacatggtagcctccagcctcttcattgtgacaacacaggagcttctggtgttgaaactgcctgtccctgtaagactgagatgagatgtgaggcatatgatcaaagggtcacttaccagctagctagggggaagtggacatttcctgaatgtcccacattttagaaaatagtacgaaattcccaatgcagatactgtctgggttgtatgagtcttattttactgagttttctttgtaccatgcacagcctattgtaagcgcaatttaataaggagattttaagcatgttggtatatcaaattgatttgatctttatatacatcctttttgtctattagggatttatatgaattcaatttcacagggctaagaaaaatttttttaaatttaaaaatttctgctcctttggttgcattgaaatggtgggtctatggctcataaaatattctatgcatggtaagctaaaatatatctgtatttggatttagctgcataagtacaggaactgaacatcagactttaataaacattaataaacccttatgctatatgtttttcaatgagttattatatagtatatataatatttagatactatatatactttaaattctcaacattgttttgataatttgctctaataacgctctaataatttgagcacttgtagagaatatttagttaagtggttaatggaagaaactcgttggggatttttggattccgtttctaggagggcagttctctcatgaggtaaatttcctatctggtctgtgcatgaatttcttgaagaactgacaataattcttcctattagtgtcacaggcaagggggcaaaggggttaggtgtcaatgcctggctgatttcctgcattacaaaatttacctcttacttttctgtcttcctgatgttaccccctcttttctttcacctcttgggcctgcacatgatttgtttgctatcaggggccaataagctttctctgtgttttcagctttacagaccccatggtatatgtgtgaagcctttagctttgctgtgttaagaagcaagtagctgtaaacagtgcgtgagtgggtgctggtgctgcactccagtcaaactgtctctacagacacagaaagtggaacttcatctcattttcacaggttataagatcatattttttgactcttttcatttaaaaacaggtagtaagttgaatttgtgtttcaaaaaaaaacaaaaggcaggataaaacgaagagctaaaacaccacagagcaggttgaaatcccggatgtgaagtagtggagccattgggccctccaccccaagctgtgcattcagaatgccacctggggcagaaaacaggtttatacacagagccagagagacttcagatctccggtgatcaggcacagtggaggacgtagataaaagatccctgcaccctgcgctgtgagcccaccaggtcccttcacctcactctcttttatgcacaaccaaaaaagatcctggagaactcttctctggggaaggaagttacctcatgacaacaactcttaaacaccaacatttcgaggcccactgatggaaaaactgactacaggtagtaacttcgagtttggagaaggctcccacctgtgcccccaggtggtgctgtgtagcttactgagaatctgcctggcggctcagcccccactcttctgttgtggcaacccacatctgaaatgttgtcctctggggaacatgcatcctttccagacactcctgtaatctatatatttgttcctccctttcaagaggcttagaacttaaactttggttgtcatttttgttgatattatgctgttcattcctagtatagccgttttctaaaaggagagagaagcaaggatcatggatcagtagccaacgttagagtcagagagcagtttgcatgcaggttgtcacagaggcacatctagaacacaaggaaactctcatgcattccatgtgcttattaaaagggcattatactgcgaagtactagtctaataattctctgcaagggatttaaaaaagggatcaggggttagtactacttgctagagtcagagggcaatttgtatgtaaattgttacagtggcaaatctggaacacaaggacactcacatgtatcccatgctattaataaaacggcattttattgtttaagtcctagtctagtcattctttataagggaaaacaaggatcaaggatcagtacaccatgctatagtgagagggaaattttcacgttaagttgttacagagacaaatctacagcacagggaaatattgagtcatttttaacattaaggtgtcaagtcctgcctggaggaggggcacttagggtcagtaggatcaggtggagaggcttttcttctaaagtcctagtgcttagcagaggaatgagagagaccattcagtcccactatcacattgtacacctgtagttgcagcactgtgggaggccaaggtaggcagattgcttgaggacaggagtttgagaccagcctggtaaaatcctgttgctacttaaaaaaaaaattacacgctgtagtcctacgtttacttcataaaaactaatgtagaaatgcaaaattaattttccttaaataaaatttctgcattactctctatattactttgtctcttttattttcaatggctgaaaaaaatagttttgttttaatttttattatttgatccatccttaattaccaggcattgatcagtggtttgaattgccctccctggctttccattttaatctaaaattctgctataagtctatgaaattggaccagaacacaagctgtgccatcagtgatactgataacgagattctagagaaaggtgcttctttggctggaggagtttaggccgatcacatttcagtgaccccggagaacattagacagcacctattgccacaaagcaagcagccagctgtgggtagaacagcaaaggcagtcggatgctcatcgcctgtattgccctgggaccagcagaccaaataaatgtaaactggactcttgcaactgtttgtttgaagatttgaaaggagttagtttatatttattttcataactgctttatttctgtcagtatttaatgtttgccaaaaaaggaaacacaggtttcccacactgtctccccatcaagtatcacaaatttgtgtgtcaagtaccagaatttgagaaagataattaagatggtttaaggtcatctcacagatagaacctcagtctatccaagttttctcctccagggtcaacccactgtattagcttcctggtagtgctgtgttaattaacaaactccgtggcttaaagcagcagaaacttaactgtctgacacctcagaaggctagaagtccgaagtcaaggtgtgagcagggctgcactccctctcaaggctctagggaaggatccttcctgcctcttttcagctgctggtagttgccggccacccttagctttccttggcttgtaccttcaactccccaatctctgtctccattttcacacgccctccctcgtcctgtgtgtctttgtctccaaatttccctctcctttctttggatttagggtccaaccttaatttagtatggcctcataataacttgattacatctgcaaagaccctatttccaactaaggtcctattcccacgttttaggtgaacatgaattttgtggggagagcactgtcaagccagtacacctccacccatactttcctactcccagctcagactgccactgttcaggttgccccaggagggccctgagctggggcgcggactcagtcagtcgtgtttggctggagtgttccatgaggttcagccagtcttgccagagccttgctcctcttccagcccctcaacccaattcctttctcctgtttcctttccttccacactaccacactgtcttacgtccaggatataggttagtcactcaattccataagccggatcctgtggtgcaaattccataagtggcgatccctgatattagctttgagttggtgccgggtccctagtaaattaggactgaagatctgcacacagccaagggccctctccctagcagcaagcaccttttcaaaagagcagaattcatttggaaggcctagaaaaaggaaggaggtgctctgccaaaatcaatgatgtctgagaaagaagcatgctccctagagcttggagaagatcagaagagggatagcctgaggcatggctctgcagtaaatcattaagagacgcccactcacagtggctgtggctaccagaggtttcctgtgagggaactaaaaagcgcacagtagtgtttgtaagtgatggttccattttaatagataaacatacagaacttataaaaaatcaagaatctatattagccagatttcctaaattagttaatatttcttttaaatttatacttaaagtcacagtttttaaaactatatatatgaatgtgaatactatatgctttggggaatttgactttggttattttctagtgtcaaggataaacacagccagacagtagttaaagcgatcagcacagattttcttccataatatactattgcaatagagaaaagagaccaatgtgaaactgggctcaacatcaattatcccagaggtgactgggcattttaaagggaaattcagggagtagggaggggtcagcaggggctcagcagagttggggaagtgaaaattgcagaaagcaggaagagggtttggtcagtgtgaagccatctgggtttcactggtgctgatagaagtcaggctcctgcccttccacagaggcttgtctgcaggagtggctggaaccaacaatcagttattttggcagccttgagttttcgtaggcaagtactttaagggggctagagtcatgtagcggtgtgaccttgagctgttgaacttgttcaagtctttataggccagtgtgggggccttgtggagaaaaagactcagagcagcctgagtagagtctggtccaggagacacttttgtcactgagcatgaccaatccatttatcacaatggtagcagcgtgtcctcatggaattatgtttccttcgataaatcttgaacaagaaataaatgcatcagcatatgtttttaaaagttaaacagatgttaaacttaaaggaagtttgctaaaatccatttcgtggacccctttgtaaatacctgacctacacagcttaccccttatgatttaaagttaacttgcatccattttatggaatcccaggtgcctgtttgacctgcagacatctttctcccttcttggtcactctctcagggcatcagctcttcacacagcaacagcttcctgcatgtggcccctgactgtccattgatgaccgaaggctcgtggacttgccaagttgcccacgtaaaacccagggttcagagagcgagacaagtccttgcattgtgaagtgccaacaattctagtattccaaagctcagtgttgttcagaacatggtacccttgtgagatcacgtgtgacatttgtgaagaacctggaactgatgtttccttaggaagcctcgcaacagtaagtgctttcagctcgctcaaggaacttcaagtaggcaagaaataagaatggaaaccctgcattactccatcagatcttgaaagttttctcttggataaatgtgcctgtcaatcacatcgaatcttatcccctgcctccatgtgctataccacaacagcgacgtctgctggaccgtgtgtgctctctgggtacacattttccaggaggcagcatcttattagagagtaacaggtctgtcttgtgtaaaggagaatgctaaccgcttcatgagaaggctccccaccatgaactcggataaccggatgctatttttttaacttatttattttttaattgacaaatagaaatcgtatatagttatcacacacaacgtgttttgaagtatgtatacattgtggagtggctgcgtcaaggtaatgaacacatgcatcatctcactttctcatcatgttttgtggggagaacacttaaaatctagaatctgagtgattttcacatagccaaatgttatttttaatgacctttgccttaattgtccattcaatatcggtcatagatatttattgagggcccagcatgtgccagccaagcgtggcctcctaattggaaacacaaaccctgagaaactctgagcattgttgtgtagtgcaggggccatcctcacacccccacagccagcattcagcttgcttcataagccatggatggagtcaaaggaaaactagctcaccttcccactatgtatctgaaatcactttctattccatgctgcacacatgtactgcaaggaaaaggaatgattcctgcccccaccactgccttccattcctaagaacagagaggatggagtacgaggatgaggaaaacagacggcaggaaataagcagtttattcactggatgtctgcatggggtcttgggagtgcagaggttgtgactcattcttgagtggaagtttctaaccacatacatacaaccgcaataactgcagccagctgctggaggtgttgtggtgaatcccagcgggttacaagggtgtgagaagcctggtaaagtttccaggaagtgaaagcacatgagctatgtcttcacccgcaaagatgcaggtaacagctcagattctgagtcttaggaagaggatggaggccggagggtgacagggtttctctgtagtcctcaggaagtgaaactgcctcacaggaaataaagcaatatcaatcaggcagtttctttctgtgtatatttgaatattgtcaatgttttaaaaatcacgacgtatttctttttttttccttctttttttttttgttgttgttgttgttgagacagtctttctctgtcgagtgcagtggtgtgatctcggctgactgcaacctccgtctcttgagttccagtgattctcctgcctcagcctctcgagtagctgggattacaagcatgtgcctccacgcctggctaatttttgtgtttttagtagagatgggatttcaccatgttggtcaggctggtctgcaactcctgacctcaagtaatccgcccacctcggcctcccaaagtgctgagattgtaggcatgagccaccatgcccagccaaaccggacatatttctaaggaacgagaaagagcagccgtctgtccaccacctgccccccacaactgtcttgaaccgcatcccagacagcttggtgtcgtagctgacattgcctgtgtcggccctcctctcctgatttattttaatcctcatatgttctttcttcttctgggaattgttcttttctagcattctgtttttgttttaaggactcagtaacttatatgtcttcatgaatactaattattatcatgactgttgcttcctcgcccacttttctctggattgtcatttttttctggcagattcctgtcttctgcctgtttgagtcttcttccacaaacacctggcagtgtctgttctgctcattcacattcaagaacagagcacctgtgtgttcatttcctggggctgctgccacaagatactgaaaactcagcaacttctaataacagaagttgactgtctcccagttctggagactggaagtctgaaatcaaggtgtctcagggccacactccctctgtaggctctaggggaggatccttcctgcctttcccagctcctgggggctctaggcatccctgggcttgtggccacatcacttcagtctctgcctccgtttccacgtggcaaagtgagctcatctcaagatttttaacttaattacatctccaaagaccctttttctaaacaagacagaagtaccatgggtgaggacttctgtttgggggctaccgttcaacccactgctctcagtcacacaaagcttttgaagcataacacctgctgttcaggcagttgcaaaagtagcccctaagaaagacagcatgccaaagcaccttccccatggtggggtggggtgacgggccaggcacccttaggatgcccatgcaggaagtggaggctcagcagaatcccacaggtgtgtctggtcctgggatagcatcagcgtcttctcacaggtagccaggtggcatccatcagctgaccacatcgtctgccccagtggcacgggctgtcttccatgtctcacttcatagagctcttctagactgaggcccaggacatggttctcggcacacagcgttaatgacatgcacggccctctaagcggttccctctcccactttgcgttgtcaacccccggtaccccccacttgattctgttgctcactgcaggtcttaggtagtacagagaatgttcaggcttgtagggttctgatggccagatcacccaacaaaagaatgccacgaacacctgagaccgcgcggcagctgcctgtcttctgcctctttcctttgtttaatcctgtttaattgcacatccctgttctcacccaccttgggtctctaggatggaggaaagcaggagcgtttcttcccactcacagtgctgattctccacattccccagttcttcccctggagatgtgtcctgtgagctgattgtttggagcaacagatacctagatatctgtctctctgcccttcctgtaaacccacggaagcacaccaaattctaggagctgggaactggagttcatttatacacataattaaccagcttctccctagaacagaactccatttgcattttttcgtcttttacttctcagggaaagccactgagtgagacaaagtttgtgtgcactctttaaaagatgaaaaactttgtgaaggcatcaggcagttttgaatcaggtgattaggatcgttcattcctgatgatacactggagctatatctgatgataacgacactacctaacatttatctggggcttcctcacccatgtcattttccaggcattgttcttcttgtgaattaattccatgaggaacgttaatcattgctctttgacagatgacaaaattgaggcccaaagagggcgtataattgacggatgtcccgtaatctctgactgtggtcatagtcttgtcttggctttcatcttcataggagtcccaagcattttggagatctcagtatgttgtggtggtgtaaagcagtcgtccaaaaccgtttttgattcattctccatcaataagaatgttgagctgcattccagtctagacacattggtgtgtgtttgtttatctactccaccttagaaataattcacagcaatagaaatgcaagaaggataagctaaaataaaataatcggccgggtacagtggctcacatctctaagcccagggctttgagaggccgaggcaagaggattacttgaagcagaacttcaagactagcttagctaacatagggagaccctgtctctacaaaacataaaaaaatttaccaggcatggtgacatgcacctgtagtcccagctattcgggaggctgaggctggagaatcgttttgagcccaggaggtcaaggctgctatgattgtttgactctgctccagcctgggtcacagagcaagatcctgtctcaaaacaataataataaaataatctgtttaagtttttaaaattaatagcaccaaagtactttaagaaaatttttatacagtgtgttttacagagccatgtgtttaagtgtgctccattttttaaaatattggtttaaaattgtgtgatctagcaatttaaaaatcttgttttaaattcagattgttttgatactcagctttaatcactgtttatatccagacagaagttcatgattggctaattttttttttttttttttgagatggagtctggctctgtcacccaggctggagtgcagtggcgctatgtcggctcactgcaacctccacttcctaggttcaagcgattctcctgcctctgcctcccaagtaacgggttacaggacgcactgccacacgtgactgtctcttttttaaaaaaattagagccttttatctcatccatcagttaggttaaggtttaaattgaaatttagctaataaatatagtcctctgtgatactaatcagtggttgttgcaaactaatgaaatagtgtggcattttagtatttttaactaatggattcaagttctgtagaagctctttaggtggagtacttctacactgattgaatattgtttttatgcgtggaggtatgtgtatgtatgttcatgagatctgtcgttttcttgtctggcttttgtctggttttgggatcagggaagtgctgatgtaaaatgtaaaatgagttgagaggtgttccctccaatttcctgaaaagtctgtttagaattggcatcctttttttcttgggaagttggtaaatttaccagcaaggccatttgatcctagatgtgggaaggaggtttttaattacaaattcaattcctttcataggcagaaggctattcaggttatttgtgtcttcttgagggagttttatatctttcaaagaattatctcatttcatctaaatggtcaaatgtgttgccattaatcctataataattaagtttttatcattttatcgatgttagaatctgtagtgatgtctgtcccctctttccctgctaatgttagtacatttggatcttctttatttttttgatcagtttagctaggagtctactaatttaattgctcttctcaaacaactcgcttttgatttagttggttttctgtattctacttttatttcattgattttctctctcatgtttattatttccttccttttatttgttttgggtttaatttgctcttttccttcactttcttaaggtaaaagcttaaatcattgaacttctttctttcaggttttcaatgtggcaacttagatcacttatttgagaccttattatttaacatatcactcaatgccatcagttttcatcgaagcaatgttttagccacatcccagaaattttggtagtttttagttctctacaaaatattacctagtttccctttgtgatttcatctttgacccatgtcttacatagaagtgtaacatccaaatatttgtgattttccacattcctattattaatgtctattttaattctaccatcgttagataaggtattctgtatgattttaagtattttataatttttgagaatagttttatccttataataggatatttcttgttgaatgttccacgtgcacttaaaaataatgtggtttctgctgttgttgggagaagtattacataaacgtcaattaggtcaggttgcttgacagtggttctgaagtctgctgtgtccttacttcttttctgtctacttgttttatcaattactgatagaggagttttaaacttccttctacgtttgtgtttctccattcagttctattggtttttgctttatgcattctgaagctctgctatttgatgtttacacatttagaattatgtcttattgatgaactgatctatttgtcattatgaaatgtccctatttatccctgatgatagtcattcattgttctaaaggcttgtttgttattaatgtaagtaacctggctctcttttgagcaatagttatgtggtatgtagttttctatccttttatcttcaatctatctgtgtagttatatttaaagtaggtttctgtagacaacatgtagttgggtcttttgtttttcttttttattctgatagtgtctatcttaggtgtgtttataatacttataaagccgttacataaggtcatgatctgctaattccatctgtctctatcatttctgtgtctatttctcctgattgtgggtggtatttgcttctttgcagcatggtaatttttgattgaatgttagacactatgaattctacacccagtggagtgctagattttgcttgatttcatttgctttatttaactttgtcctggaactacattatgatctgtccatgccttccttttaaaaatctttagagggtcaggtgctccagatatctgttaccttatcctgaatgactgtaggtgttcggaaaaaatgagtctgttgattgttttgtgtaacaattgacaaagtagggacattaaatcatgacattattaaaataggcatgattatacaattatttaaaataattttaggccaggcgtggtagctcatgcctgtaatcccagtactttgagaggctgaggcaggcgaatcacctgaggtcaggagtttgagaccagcctggccaacatggtgaaaccccatctctactaaaaatacaaaaattagctgggcgtggtggcacatgcctgtagtcccagctactctggaggctgaggcaggagaatcgcttgaacctgggaggccgaggttgcagtgagccaagatcagccattgcactccagcctgggcaacagagtgagaccctgtctgaaaaataaaatgaaattttaggcaaaccgtcacaccttgtgtggatttagatgttcctgttgtgctagtcgcataagttaaaggtaggaaggactcctggtatttttgattctttctgataactagtcctctcatgattggctctatgatgacctccatggacctgtgtggtccctgtagttaatccgtgtggctaatgacagtgtgaggatgctcttttcatatggcacgttgctgttgatcagctgtgttcagcagctttcttttgtcccctgatcccttgttaagtagcgctgcagcagtccctcagccacagccttcttcagcatctggtggacgcctttgtgtaatttcctctccttagcagggtgaagaatgattgaagtgttttctgtagaatacagcatttttgcagaaaacaccaaaagcatagtccttgtgtatttactgctctggaaaaaaaagtatggttcagcgaggccctgctgaagggccttccccggtgccctggccagatcccaggtccagtcacctcctgggcctgctctctgcccttctccacgtttcataaggaggcccagcaggcaaagcagcagtgcctcccagtgcgctcttcttctgttcctttgggaaacgtatcgctcaaccgccaatagcttttttgattttttggtttgttttatttgagcagggatgttgtggagctgacaaccgcttttagacaatctgtcctaggtcagaaattcctcaaaaggagcagcctgagagtgtgctgccacacagctggagggactgtccctgcaagaaggtcttatggtggaggcctcgcccctcacctcagtccttccctcctcctccccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaaggtaagtgggtgccggtgacacgggccgtgttccacaaccatgttccaccaaataatatccatgtagtgtttgctaaatgtgaaaagttgtggtttgtgctgttgaaggccactttgcaatgctccctagaacttgggtatgtgggcagggagatggtctggttggaagattttgtgaggaatcgtggccgcacctaagtcaccaggccagggagactcagccagaatccactgggtctcagggacaatctgagaagcttacagtgccagaacaaggcctattcagacattttccagggaagcggcggttttaatgatgtggggcttaaaacagtcttattgtctaggtgcaggctttaaggtgagtattcactgcagttcagatgtaaatcactaaaactcacttcccctccccaactgcttatagagtgctcgttggttgctgcagtttttgcttgtgtagtgacgctgggtttttatcgccaagtttttggacttccatccatttctccattggaaagtggcagctggtgggcttgtatgccgtggcaccccctgtcccgcaccacggctgcttgaccatgcagggtatgcagtggagacggcccctggctccctcttcttgttaaataaggctcctcctcaggtgacctgggcagagcgtttagagagccgaccgcttgtggtggctgggcctggctccagattcctctgaccgttctgtgactgccaagatggagtccttggcctgaacgatctgcaggtacagattccagaatcacaggaagtcacccttgaaaggggggctcccgctggcgatgtaagtgtaagcagctggggagggcatccgtcggggagtctctgcaaatgcctgcttcccctgggttcctgcatgtgaggacttttgtggtttgtggggaagagcctttcagtgagaggtctttttcaggcctcacctctcattactaaccagtgacaccaatcacgagctcagggaaattactcagaaaccttcccaataaagcggagctaccggagtagtcttgaaagacctgttttttgttgttgttgttttgttttgttttgttttttgcccagggtgcaacttactaccttgagcctatagaggcagccggaacctgtgcctcagtacacaggcctctgattctctgaagctaagtgggcatccagcaattcagttcagttctgacactgactcctacggttagcccagaccccgaaggttaaggccccagtcccacaagacgcccattgcacgttccaggggccacctgtacttctgattggctacaaattgggggttcctgcaatcctctcttcaggtctaataatcccctaacatgactgacagagctcaggaaaacactttcatacacttgctgctttgttatgaaggataaaactcagggacagccaaatggaagcaaggcattggccaatgtatggcgggtggttgcaatgctcccctgccctctctgggcacctgaccctcccagcacctccatgtgctcaccaaactcaaagctccccaggccccttatgtagaggtttttatggagctttcttacgtaggtgtgagtgatgacatcactgacgattgctcattgaactcaatccaggccaaggtgccctccctggagatgagggggagggctgaaagttccagtcttgtttgtttgtttgtttgtttgttttgagatggagtctcgttctgttgcccaggttggagtgcagtggcatgatctcggctcactgcaacctccacctcccgggttcaagcgattctcctgcctcaccctcctgagtacctgggattacaggcgtgtgccatcacgcctggctaatttttctatttttagtagagacagggtctcatcatgttggccaggctggtcttgaactcctgacctcgtgatccacccgcctcagcctcccaaagtgctgggattacaggcgtgagccaccgtgcccagacctaatcttctaatcgcatatttggtctttctgatgtccagaccctgtcctaaagctatcctgggtccactagaggcatcttattaggttgaaaatggcttattaatgactcagaaattccaagtgttttaggagctccatgtcatgaactggggacaaaaaccaggtgtgtagtttttatgatgccatagctataaacagtcattgaaagacagtggggcattcttagcaacacacatacctgggctgattgaaatctcattcttgatttaagtctcattattgaattcaacttgactgcaattgcttaacgtgggacgtgcctgagacctcccagctagtaagtcagagagtcaaggctgagcctccaggtgcggctggaacagctcccagtgggaacatgtatctgcttcttatgtctggacatgtgtatgtctgcatgcttggcaccctgttacaaattcctctgcaacatgttcatttttccttagaatttcccccttgtggaagaattattccatagcttcaggctataaagccttcttcccagaaacaccatttttgttgttgttgtttaacctgagttattgttcactagaaaagtgaaggtgctgcactccataaccatgtcccagaagcgatcagagtatgttggcacttgcattcagttctgtatttacaaactgataaagacaaggtgaaatatttgccttgttaacatgagctgttcctatagctaaggcaattaaacggaatttcaagtacaggcagtccttgttttgcaaggtactctgttaatggaaacatggtgtttcatgtggggttttttggttttggttttgttttccttttgtttttcagatagggtcccctttgttgtccaggccataggcggtggtagcacaatcgtagttcactgcaacctccatttcctgggcgtcagcaatccttctgcctctgcctcccaagtagctgggaccataggcacacaccaccatgcgcagccgggtgtggcagctcacacctgtaatcccagcactttgggatgctgaggcaggaggatgcttgagcccagtagcttgagaccagccaggtcaacatagccagaccctgtctccacaaaaaattagccatgttttaaaatgtatatggaagcaaagtgtatgtggaaaccacatgctgccattgcatgggaccagttatggtgaaacccacagagcaagggccctcatgaggaggaatttctctcacaaggtaccctgcaaagaggcccatggaatgaattgtgttttaacatcttggtgttctcattgacaatgtttgttttagacttgtcaaagaaaaatgagcagttgcattttttaaaagtcatttagcttttagaaagttctaaacattttccttattattaatctacatttacttacagatatatttctcttgcagaaatgaaatgtttcctctcatgcttcttacttagagacagtgacacattgtgggtcttcctcctgtgatgtgcatattgtaatactaaaggaagtttttcccaagctcctgtcagggaagcagccctggttttgtacttggcatttgtgtcaggaatacaggaggcagtggccaggggccgtgtggacgatcttggagctcttcagtcaggccctgctgctgcttcttgcccgcagtgtgggtgtgagctcacaggagcagcatgcctccagagttcaagggcattccattaaatcatcagtcactgaagagacttctgaatctcttagggaattgccttagggaattgatcatgccataggtgtcaccaggttaattaggcatagtagtagtagtagtcataggaaagtagtcaaaaacaagtaggatcaaagggttattaattatgttaaatattaattcccatcttactaggagaaagtgtccaacagagctgacattaaagaatcaagttttcactgagaatattttctaagttattcatgtatcattattttgttctaaaaaatatcaagcaaacataaggccaccttcagaagccccccagaaaccaccttcaggataatgagcacccatcgagtgaaagcacccgcccactgtgtgccaggcagggtgcgacatctgccaacacatcccctgaaggccagagacccagtgggtagagggcctccatgtgccgaacgccaggtcctgagacttgcgagtgtgagcacactcattgcttggtggggacttgagcgaccaagctgggaggcaccccagggctctctgttcccagccacaaaaatgccatcattgttgtgaaacaaaaatgatggcattgcttacatatcacttctagggttgatatttattacaagtaaaaccagaaatcggaaatcagttttgttttttttttttttttttgagacacagtcttgctctgttgcataggctggagtgcagtggcacgatctcggctcactgcaacctctgtctcctgggttcaagtgattctcctgtctcagcctcccaagtagctgggattacaggcacacgccaccacgcccggctaatttttttatttttagtagagatggggtttcaccatgttggccaggctggtcttgaattcctgacttcaggtgatctgcccacctcggcctcccaaagtgctgggattacaggagtgagccactgttccggctggaaatcaattttttacagcctagccatcactactttgcgtgttttagttttcttgtacttgttagtgttgttttaggagctgaatttcaggttttaaaaaaattatttttgtttttgtttttctgttctattttcaagaaagttatacatgttaaactgcataaacagatagagtagactcattttgccagcctaagttttgtgtatattcggtatctgtctttttttgtataataccagggttgaagttgtgagataatattcacaattaataaacaagggacgtggtagattctactctttttcgtggaaacctgcatatttcttaatgaataagggctaagtccacataaataggtagactgggctcatttcaaccagcctttagacatttctactcatagcccaaactattatgctatcaccttgttaagaatacagtcttacaggtggtggttcatgcctgtaatcccagcactttgggagtccaaggtgggaggatcacttgagctcaggagttaaagactagcctgggaaacatagtgaaaccgtgtctctacaaaatataataatgatgatgatgataaatttgccaggtgtggtggcgcctgcctgtagtctcagctacttaggaggctgaggtgggagaatcacctgagcctaggaggtggaagtttcagtgagccgagatcatgccactgccctccagcctgggtgacagagcaagactctgtctcaaaggaaaaaaaaaaaatagagagtacattctgggtggtgacttagggatacaggtgttctgtgaaattctttcaactctgctgtacgctggaccatctctacagtgcaatgttgggggaggcagctctgcctagtgtgacagtcagaccaaaagttcactcaggcacaaattagagcatcataggggaactggggatggcacagggcctgagataaatgctcagcgtttttacagagaagaacagagggtgggattagtgctgaacagaacaagtccaacaggagtgcagccaacacagaatcaatcgtgaggactttggaaaccaagcagaaaagtttacacatggtacaataggcatttgagctcactggaaattcttagaaggacacattggccatgtctgtgttttagagctcagtggagtactgggtgacagattagaaataggcagtaagggaggaggaagtgccaggtgtgattccaatgtgatttccttcagggaacttatagttcaattagaaaaaaataagtaatgtcaaaagttataggaggcttaggagaaagtgaaattaagaaaactgtcgctgggcatatattcatatcaacttgtaccaaatttgaagaactttttgcatctctgtgactctttcctagatttaaaaaaactgaaaaaaagatgtagctagttaaaaatacatgtatttttctaatacctgtaactgcatgtgacatttacacaaagtttcatcttaacttatccttatcgtacattgcatatgtcccaaaagaatgcagacaggagcaggcaggctgtcagtgtgagctgacctctgtaactggaacttcttttcctccgagaataatagagaacaaatagctgtatactacttatgtccaatttaaagttaatatttgggccaggcgtgatggctcacgcctgtaatcccagcactttgggaggccaaggtgggtggattacttgaggtcaggagtttgagacctgcctggccaacatggtgaaacctcatctctactaaaaatacaaaaatcagctaagtatggtggtgcacacctgtaatcccagctactcgggaggctgaggcaggagaatcgcctgaacccgggaggcagaggtgcagtgagccgagattgtgccattgcactccagcctgggtgacagagcaagactccttctccaaaaaaaaaaaaagttaatatttggtgaccagctgagctttgctggacctctggttttggggagattagatgttcttgaatcagcttcttaccctgcaacactgagttacgggcacagccacactggagctgctccagagggtgaggaccgtcacctgccattgtttgccaccctctgtgggcctcaggaccccacagcctgggtcctcattgctccagcctcaaggccacctcctcctgtcacccatcatcgctgaacaaaataggcatgcctctgctcacttgtccttggtattatttcatttccctttctcccttctttcgttatttaaaaaaccgtaataacaaggaccttcacggttactgtccttacacttcttttctttcattgaacttgcctttgggcttggtgtcccttctgaatttcctggcacgagggcacttgcttaaaccaaatttcactgtcagaggaaatgtgtttcctctaccctcttaggtgcagtgattgggggcctgtaaatcagactaacaaaagacagactatcaagagtaaagatagatttgtatttacatacaacgaaggagttcacagaaaaatgtgactcaaggaggcagttagaatttcggatttgtatgtcatcttaacatggatgggagagaggcagaaggacacacagaagaataaacttttaggaaaacttttaggaaaactaagtgggccgttaggagactagatggtggataagatagttttataacaacatcttttggggcgatttctcatctaggtgtgacaggtgctgacttcttatctttggtgataagactcacacttccctggttgtgaaactcctgagcattggatgtatgagggctgagggctgaattcttctggaaggctttccttagaaagggaagggagtgcagaagccttctgttcctgtacttgatgcttactgtcttcagctctaataaccctcatgccactgtggcatgttcctcagtccatggaggccccatctgcttctccccaacaccccatcattactcccctgcccccttctctgaatgcccagcacccagcactaataagaggccctctgcctgccgagcgcacgtggcatccttgtttctaaacaaccctgaggtgcccggcccctggttctcaggtcctgcctttatccagcccgagtagccttacgtccgtgtccagaacactagccttggggcatcttgctctcccagatgacctcggtgtccctcagtcttgttcccacattagctgccaggtgccacaatccctgtttctgactgcatcctcgcctcctcacctcgcctcggggggcatttcatcctggcatctgccgctcctgactgctgaaaccacagacatccgtttcccacgctcctctgcaacgtctccctctgctggctgcaccatgcccatccgccctcatccactgctcccactgtttctctctgcacttcctctcacccaggaactcggttcagcaatccccaaatgtcagcatctgtgtgtgtgcaggtgttgttttggtgttcatctcactctgtcccatccccctgggtgatcttatctgctacttgttgtcactgtgcctgactcaaatcttggtttctggacatgggtagagtcctgggcccagtggtctggaaaggggccttgggaaaatcttatgtaaaagttcagccaggccacacttactaggagtctcaatagaggttctcctaccttaaatctactcttggggaccctgctgcttgtctgagccccaggctcatgaatctgcactgcctggaagtcatgagcacctctgaaaacacggccaacactccattttcccacattttccttcagcctgctcctgtccctccaggcaccctggagtccctcagccaaccttgaagcttctcattgcacgaggattctctctcctcacatgccgtctgcagccagcaacctcctttatccatccacttcttaggccctctcttctgaaaacctcccttgtcctcatttgtacgtttcttcccttcctgaattgaggctgtaggtagcagctgctatgttgacttcaaggtctcattcccagcctgagaacacagactcctcccctgtccccacacccaaatcagaggctatcaatgcacgatatacggaagcagaagccaatagacacagaatccagtcactgattctgtaggtaaagaaacagattcacaccaagggactcaattcccctctgtaagcttttattgaacctttcgtgtacgtgccattttatcagattgcaagatgccaggaataccgagtgatttaggagcacacactgtcatttagttttaataatagccaatgtcatttcttattagaatttagtagttatttcttgctctttgattttcagttcttataaactttggcaaagaaaccctacattcccagctatagtgtggccttctatattagtctgttttcacgcttctaataaagacatacccaaaactgggtaatttatacaggaaagaggtttaacggactcacagttccacatgactggggaggcctcacaatcatggcggaaggcaaggagcagcaagtcatgtcttacatggatggcagtgggcaaaaagagagcttatgcagggaatctctcccttacaaaaccatcacatctcatgagacttactcactatcacgagaacagcatgagaaagacctacccccctgattcaattaccttccaccgagtccctcccataacatgtgggaattgtgggagctacaattcaagatgagatttgggtagggacacagccaaaccatatcaccttctttttcttttcccgtggtgttccccacaaatagagaaggcattcctcttctgtactgttatttcacaaaccctgactgacacttagtctcgtgatccttgtctccatctcctgccactacagctgcagtgatgtcaatggggaggctgtctttttcaccttcaggctctccctctccccttgggtacatcatcagctttgataggaggtggagctgtgctttggccaggtcacagctcagtaagtgttctggcttcttggcagacccacagccacctgcgttcctccagactggtttccagggcttacagtcagcggcagaatctgtcctcctttgatggagagctgctcgtcattcttggggaacttggggcactgcagtgttgatttctagttcacagccctgcagagacctcgacacaggttgcatgcacacgggcccctgtactgttctgcagaattacgccagagctgagccattcctggggcatgagggtctctgggaaaacacaaattagaggcatgaggcccttctgcactctgtcaaatgcagagaagtgaagaaataatttcactaaatgctagagaaaaacagcaaatctcagaacagaatgaagttctgtcctctcataattactcttcatatgtcttgccttcagatatcttctttatgcttggctggagaaattccaggatggcactgtgccctgtgctttgtgtggagaaaatatgatggatgaatccctggtccactatttcccttttaaaggcagatacttgtatgacaatggaaaatgtaacaaaacttcatttaatcagcactgtgtgtgtgtgcgcatgcatgtgcgcacacgtgtgtgtgtttatgtgtgtgtgattgatatgtgttatggaaaaagctcatgtctctggaaatactttccagcaaaaaacatctaatagcttaatctttatagcagtgctggttttggccctttaacttccccgaagttgtaaaccaaaaaattgcagtctccatatatgttttattgcatcctctaaaacaggagtccccaatcccctggccatggaccagtactccatggcccgttaggaagcagggcgcacagcaggaagtgagcggcgagtgagccagcattaccacctgagctccgcctcctgtctgatcagaggccacattagattctcacaggagcctgaaccctagtgtgaactgtacatgcaggggatctgagttgtgtgctccgtatgagaatctaatgcctgatgatctgaggtggaacagtttcatcccaaaaccagcccctttcaccccccacctatctaggaaaaattgtcctctacgaaaccggttcctggtgccaaaatgctggggaccactgctctaaaacatgtatttttttatttctggactgtcactcaaatgcctcaaaaaaatccatgcctcgtagttccttgaaacactttttaaaagaactagtagccactattagtacaaatgccactaccctactcggggcatttcattaggttggctggtgaccagctgtgcattttttgtaatgatactgtgttcactgagtctttttgatagcaaggtttcagacaactagccagtaaaaatacaatctagtcactattcccccatacactagtgcatcaagttcgttggtcctgcattaccagttatcttttacaattgtgtcaattttcaaaatatcttttagcttttaactagtaattattactaataattattggatgttttgggctaaaaccttgctaaatgtttagcatctcatttaatgtagtaccacagattattggcaaatttgggcattgtttctcttcactgcgattggaggagaatggtgtattgaatacagagaacacgtgacccataagtagcactagtgctgtttgtatgtatggctccccaccttgcattgcataacattgctgtagttgaggaatccgctttttaaaagtgtttggcctgggctaatttgcaataaagcccgtgaactctcccacccctggacatgttgtaccttccttgtaccttcctcacccgatctggcctccacaatgcttgtgtacacattctcggacttgccctcacccaaactagaatagggagaataaccagtgaattcagcctcgttatgtttggggatttatgcgaggatcaaggtggcatttcagattgttgtgaaacagatggatcagtcaggaaataataccggggtagatgtcttgccagtggagagggggacataaaccccaaggctctggcttacttccaacactaaggtgaatcctactccaatcaaatattaacatgtaaaactcgaaccaagtctccttctggtgataggacctaagcaagctgcgctaactctccccttaagaacagtgagaaaaactggacaaaaactcgaaagcatctttttgaagggatctgattacccagcaggtagggaacggtgggaccctttacccctagagctgtccccagaagaagtggctaatgagaatgagaagcccgagtttgttttttgttttttgttttttctttttttggtttgggggcaggggggctgaggtgggagaatcacttgaacccaggaggaggaggttgcagtgagctgagatcacgtctcttatatagaacctagtttgaaaaggaagggatattttaagtcttttaagataatgttaactatttttctttctttagctctatttctgtgtgtagctgttttactacaccagaattcagcaagtgatagtttcttaagagttagttgctatgtggaaattgaagccctatcagtaaccttttcctcctcgtgtatcttcaaatctattaccgagccttaaactttgaatggatcttgtatccctagcttattcaagggttaagaaaatacgttttctgtagaaaagaagacatgttctgtggctcatccagagtattatttgagctgcatgtctatagtttaatcacatactgttggaggtcttcctgggagatgctggaggcccaggagtcaaggggctctgtgtgccgttctccaaacacagctctctagaaagaaggttccagcatgactcaggagaggttggtgcaaactgggaccctctgggcacctctcagggacacagactgtccagctggttacggaagcacatctcccacctgatttattcctaaataggagcgaggagggggacaatctttcccttcacccccacatcttcctttcctcttccctacctccctgtattaatactgagaaaccacacctgaacaatgaaatgactaggaactacggtttctggttgtgttcccaagtgggaatatgggctgttcacgacctcggaatgtagaatgccctcattatttattcagtagacatccaataaatgcggatcaacagcttgcctatctttgatagtttttggcagtgtgtgctggttttaatctttgtacttgtcccataagtgaccccatgactagagagtgggctcttccatcttgtaagagccttctgttcacgttctgttctttttatgagaaggaagttccagtgcatatcccaacataaagagaaacgttgaatacgtactgtttttctcttatatatatgctcaaaataacgactgtagtaaacagtcgtcatgattataggatgaattacgcagccattcatagatttttgtagttgtcatttacaagtggactatgcaatagttcataggcttatgaatacataatctaacaatattagctgggtgcagtggctcacacctgaaatcccagcacttagcgaggccaaggtagcttgattgctagagcccaggagttcaagactagcccgggcaaagggcaaaaccccatctctacaaaaactacaaaaagaaattagccgggcatggtggtgcttcccggtagtcccagctacttgggaggcaaaggtgggaaggtcacctgagcctgggggtgtcaaggctgcagtgagctgtgattgcaccactgcacccgagcctgggcgacagagtgagaccctgtctcaaaaacaaacaaacaatattatacttgtagtatttaaaaaacataattatctggtattcccatagctaatagaatgaaaggggagactttatctccctagacaggaagcacggtacctcctacactctcttctccccacatcaactggataggtgtgtgaacgcatttcaaagtcaagtatggttagtaattacttgatctttttccagccccttcagataagctgaattgaacacccaaaagtgatagtaacatcattttcctttgcaattacaaagaccattaacccaacagaatctccatgctttacctgtttgtgatgtttttgttccattttattaagtatgactcctgataaatgaatcactacacaattaattttttctcattctttagattcatacacacagacacatatatcaagcaaactataaattgctaaaatgacaggccagcagtgactacttgttatcacgtgtgtaacatctcttgagggctgctttgtaattcatttgtatggtgttgttgtaccagtgtaactgctaagtggtttctctggttccatgtgcatttgtacatgaagttgtgcaatctccacataccagcagtttcaaagaatgacagtttgcatgaggccatcttaatagcaggtagcatgtaaccaacccatctgaattaagccaccattgcagaataaaacatttgacactaagccaggtatttcagtggatgagttgtattttggatttccaaaaaaaaaaaaaaaaaaaaaaattaagcagtcatgctctcgaataatcttactagacataaacaatactgctagggtaggggggcactgcctttaacaatggtcagagtttcttggtaaatcagtggttttgcttctttgatgtttctaaaacactgatatgcccagttgccctgctctgacctcatctcaccctccccagcttccctccccacccacctcgtaaagcacagacctctcagcctgaccccttgctccctacctcactcattacttctggtttccttttggggccttgtcttctgcctgcccccagtacaatgtttatttttctgcatgtccatctcatcctgacaagcctctccacactggagtgcagccagtagctgtctctgctaagctcttccctctgcctgcatttctcaccccacacacaccttccatttcccagtggctacatacatcatgtgcgattatgcctgtctttcatgacctgcctctgaccagaaatccctgagtcatcttccctaaacccactccttcaaatccaccttccaaatcctggtgaatggactgctgtccctgctccagaggactgtgtgcctcaaacagggctccccacagtgggcctgtattagcagggattccccagtgcatgtttcctgccttggagaccatgaactccagggaggctggagagctgtctgctctgctttctgtcttctgcctgcccaagacagtactttatgtaggtgttaatttcctaaaaatatgtctaacatgcttgaattgctgatagctattgattaaagcccagcttctaatataaatatgcatttctgatgaatctcacaaaaaaacaggaagaaacaaatgccattaatttgcagtttatcaatatcctggctagtaattgagatatttagtggcatagtcactagaatataaggtgctagtcccagtcccaacacgagcttgagtaattttaaacttcatagtgaattttttgtaacgtctacagaatggatcaccattatcataataatagctgatagcgacggagcatgtcccatctgccaagcactggatatcattgattcattcatttataaaatttgaagttggtgggagggcatatttaaagactgctacctggaatagtgttatttgtcagagattcatttgtttgttctccacattcttcaatatatgaattattccatgcaattgaacagctccccaagtacgtcatagttatgaaatgttgtgtgttgactttggaaggttacagttcatttgtgatcttccaggcagcgggggtgggggtggggggattcttctctgtagtgaaagtgtttttctctgaaatcttcagctactttcctactctgtgaagccttcttctcctgggtcagtgggacccttccttgagagtggtttcagtaggttctccaaaaactgttcaactgagtaaaattgaatagaatagtccatgcattttgtcccaaggtataaaaattggctttggggaggtgaaaatgaaaccttacttttttttaatgtatcaagcaccaatacacatacagaaaaatatagtgtatctgtgttattataacatgttatggggatagactgttggggaaaaataactggaaaagcttttttgggggtgatcatgaatgaaatggttgagaaacactgagttagtcatacacagtatcagacaagtactgtgtcagtagccccagtaatttccaccctcaggccaggccccacatccagcacattctcgctcttctctagcccccacagccaggtcagtcttctagcccaggctccatcagcatctcaggttagagaaaggaaggcaagatgccttccacctctgttttccaggattgagaatatgctcacgcccctctctatctaaaggaaaggagagagggatggaccaggccctgtgttgccctcacaggtgccctgggcgccattttgtcatgagtggtcagcagagcccattgccgaggggcctagggagggtgccctcacagagctggtcccttcagttctgaattaagcagtagcctcaatgccatgtaagcaaccattcctgcaagaggataggcatttaaggtgaaatctgcctcatctgtcgttatttacaggtaagattcagaatagttcaagaaaacaaggcaaatgaattgcatttgcattgacgtgagtcatgccacattcagctactctttgtgaaaacgtccccaaaatagattcctcggagtgctgctttgcgggaccttcatcgatttgctctgaagataggtgtccatgcctgagaggcctcagtgaggtttcaactacacagttatccatggcagcacttctggaaacatttctgtgctaattgtacatggcaggtccccagttcctcatttaatgggaggaatctcctttttctggaaaatttctctggactgctgtgtcacagaacattctagaaaccccttacctcatgaacattctactactagacaatttagaattgaacgttaatatgggcatgggaggccagtgaaaacaacataagcctcacctggtactgcaacacatctttgtttgggaaacactgactttgcaaccacagctataaacaccggcttttatttcaggagtcagcagttactatatttgcaggaaggagaactgagggcatccctgtgaaaaccagaaaataaatccatcctgaagggcattggctttgtaggcctctcatcccctgttgagtaggttgctgggccatgcacaacgggtgtcagtatggaaaggaccaaggagaggaccgaagagaggcctctgcattgccagctgccacgtgctcaccacacagacagctcattggctcatccaccagctcatttaatcacgaagtcttttaatcccctccaggtccaatgaattccttaggcttttttctctgtgtttatcagttcccattataaatggcagcttcttctacatggcacatttggagatgacatggaaaaatcactcacacaggccagcaaaggcactctctttatgctgtgataatcctgtttggggaagccccctctgtagcttctctcaaaagcaggcaaacatcgctgtgcttttgctgtcctgacaatgtgtggagtcatattatacagcaagcataccacaagcaagtcacatctaaggcacctaaatgtggtttttccataacgaaagtgctgttgaaaataaacacaacttgctgctctacaggttagagcattttaatcccgtacatggctaatcttcccgagtctgtctgaagtcataatgtccctctaaacacacaaaaccgataggggcctcccgtcacacttgcggatcatgagtctcatgcagaaggctacgtaagatgaattgatttcacatgttttactcagaggatgtggaaaaagaaaatgattctagtgaccatctagaaacttgcggtttgtttttgactttaagacagtcagcacctttcagggccttgctgggttttcactggtttctgacagattggtggacgcggcatctgtaccattaaaagaggaaatcaggaaggttttttgagctgtcttgaagtcttttgctcaccacttaatttacatacatacactttaatatgcatgctaagagtgcccgtaatgtacttttattgagtaaaatgacacagagagaattcgttaggaagctttcctgcccaccccccaaccaagtcgttaaataactttttcaaaggctgttctctataggagaaggaatcaatttaggggtgtagttcattcatttacctagcttgtaactctaaagggttttgttataaacatgtttatatcaataatggttttatagtttgattttcagagcactatcgattcagtaaaacagtagctctgcggtgcacaagggatactgacctccacctcagcactattacttagaggaatgcagcaccatatgtagcttactagtaggtaggtggatgtttggatgaaggaagggagagcaggaggaagggagggatggatagattgataaatagggatggatggacagatggatggattgatgaataatataaacaaaagtactaattaataacaaaatacacacatacctcagcagtcattttgacagcagtacttaaaagtttcatgtttaaacaaacatctaatagtgtatatgtatccaacatgacaacattgtggtacttatttacagatcactgtctgacaaggaacatgaagtcaaacagaacttaaaccttagatatgagcactgccaatcaaaattaaaaacaaagtttaaggcccccttgaagttttgatgtctcaccatgtgaaaattgaacttcatattacaaaattaatgcataggaaaaaacctcctatgaaaaagcctggttttggtgatgagattcagatcatacatggctttataattgatgaatagttgtgagcagctgctgtactttctgtgcttccatgtaattccaggaccgcttctgggagccctgaaagtacccttcagtgacttccttccaaatgttgtatttcactaagcaaaagggaaagctttattccttagagatgatatagtaatatttggaaagctcactagttccaatgaagcacataatttaaaacagacacatcatagtttaaaaggtaaaatcggttacgaaatgtgatcccaagtaggcacgggcagcactctgcctgtggcctggaggaggtcccggtgtgcaggattggaaaggggctggctccttccctgctgtgactgttctgtctgcttcccgatgggacgtgctgttgatcccagctgctgagaagaaatggtgggcaagtgccacggggacaggatttgcagcagggaggagccaaaggtggaagcatcaccgggaagtgagacctggggaggaacacgagagcatcacaagccgcgggcccttctccttccctcttgaaaacctaacctagctcctgacactgcctcctactgtgttcccttcctgcccaaactgtacctagagctccatccatagacctcgtctgctcaccgcacagaaatgccagggctgccgggatcccttctcagcgctcctccttctgtgtaatcaactgcttctctgctctgatgacacctgaccgcacctccagctcacagccacagtgcatggagaccccgagccttctacttgggtgtcccacgatggcctcaaacccaacttgtcacaaaagctacctctccttcctgccaccaaaatggcggccccaagacccaccacatcagaaacatgagaatcagcttctccatcaggcttaacatcccaggtatcatccagttccctattgcttctcagtttttcctctaatcccatccatttttattcattgctcttgtgtttggactgtttccctcccccaattcagatgctgaaatcctcacccccagtgtaatgcgttagggggagaccagggagccagagaccacgctggctccctgatctcacaccgcctggccccagacctatgggaaatccctgtctggggtttaagccacccagtctgtggtattttcttacagtaacctgaagggactaagacaccctgctgctgtcagacaaagatactcttatgtgcaacttgctagttataaaatggaacttttaagctatatgatatttgtcttttaagaaattaaagtacaaggactttttaagtcccctggacagagaccatccccaggtcgctgctgcgcttcaacatcgttggagaagtcagttcatcacctccaagtgataagccgccaaggtgcttcacctcccttgtcgttggaaatgtcatgctccctaaattaaatccctcaagctacagtttaattaagctcatctcctcgcctggagatggaaatcagatatattttagccttcagctgggtagagtgaaaagaacattggattctgcagacctggattctattcaagagttctgtcttccgcctgactgcatgacctccagcttgcctctgaacttcccttgcactaagcagaggagatgctgcatttgctctgtctattccctagcgctgactttccatggcccctttgtggctctaagtcctgtacccaggacacctccaccatcttcactaatttagcagacgttcatcagtgctcacgatttgccatggcatcctgggaaggtgcgtgaaaactgggccctgcctagttacagccgatatgtaggctgtacaagctgcgtcaagaatattcttgaccagatacttccttgaagatgtggaagtcagccttagaaggtccactaaatacactacaaaatgatcacaaaattaattaaaatcatatagaatatgcatgcatacacacacatccatgtgcatgtcctgacacagagatgatatgtggggtgaaggagggagatttcagggtaggccgcaggcctgccgggagcatgtgcaggtggcagcgccatcccctggaccaaaccccagttctccggcttcactgaaggtgcaggagccctgctagaaaagagaagggagccgtgggcacttccaccttccctgtccctggccaccaccctcaaaggagcaacccaccaagtccgtgcagagaaaagtcagtctgcctccactccccacttgcagaggctgaagtcccttggcttagagagaaaagtttctttctacagatgcaaacatacgaatccatgattcactgtatgggtggtggtatgaatgagttttaggtcaagtgtaattggtcagtcatggtgggacaggaagggctgccccctaagtgaaaacatgaggtgcttaaaaggaagcatgagagccaggtgcttaaaaggaagcatgagagccaggtgcttaaaaggaagcatgagagccaagttcagtcagggtgaacctcctttccctgtagctgggtgtggcagacggaaactgtgttgagatatttctgccttcgaagataagaaacatacttcttccttaattttatttgtgcaaaatataaactgtatttagcttatattcttctttctttttttgatgcttaagtcctgtgattaccagacacagttgttccaagatagcttttaaggatttattcttaaatccttaagtttcagtagacagacagccatgctgtgaacattctttaaatggttaggcttttagataccaggtacttttcttgtaggtgtggtcctatttacaagtgcattagatctttgggtgtaacgaagtctaaagacgacataaaaatcttttggggctgggcacggtgggtcacgcctgtaatcccagcactctgagaggccgagatgggtggatcagttgaggtcaagagttcaagaccagcctggccaacatggcgaaaccccatctctattaaaaatacaaaaaaaaattagccgagtgtggtggtgcatgcctgtaatcccagctactcgagaggctgaggcaggagaattgcttgaacccgggaggtggaggttgcagtgagctaagatcttgccattgcactccagcctgggtgacagagccagattatgtctcaaaaaacaacaaaaaaaaaagaaaataaataaaccttttgggacatttttaataggtgcttcaggacacagtagttgttctgctttataattctactgtttctaggggaaaaaaaccaaaccaacaaaacccaaacttccagatgctgtggcatgaccccgaatcatttcccacgtgcaggctgtgtgtgtggtgcagttgccatctgggcctagcaccagggggtttcttctcaggactcatgtttgatgtcttctctttgtcctgtgtctggggctttctttaaattttgtgtgcaaacaatgcctggtattacaggctgttttcctgtaaaccactcacttctgctccactcctgttctgttgagttttcctggcacgtttccatcatcgaccacctccagctgactattctatcagcttttgaaacttcaggttccgttttcaaattccatcttgatcaaatggaattctcgttagcggacatgaagtgtaagagtccggcaaatgtcggggaaaggtatctcctgacagctgttagcaaagcggccacatgagaggaggaagaagagggtttcaggtgccaggggtgtcatgtatcccattgctgtttgttttgggctgagatcacccatggctgtttacatcagaggctgtacttacttttgaccttttagaatagttaactttgcaagggtcttgtgctggaaaacccaagccaactggcctgtcttcctaggtttcccctcaatcatttgaacactgagggttttacttactcacatggacatatttcaaatggcccttctgttgcataagcttattatgtcaccttctctctttttttcttttttttttttgagacggagtctcactctgtggcccagtctggaatgcagtggcacgatcttgactcactgcaacctctacctcctgggttcaagccattctcctgccttagcttccagagtagctgggaatacaggcatgcgccaccatgcttggctaattttttaattttttggtagcgatgtgattttaccatgttggccaggctggtctggaactcctgacctcaagtgatccgcgtacctcggcctcccaaaatacaggtgtgagccactgcgcccagcctacgtcaccttcttattgtgattgattgtgatagcaaccagttaccaaccttgacttttcgccactcttcatgcttattcgagtcccccttactttatgtacgacatttgtcttacatgttgtgtgtagtattccagatgtcagtgccattttggattattcttaaaaataggtgaggacagattaattgaacacagaggaaccagcaaaacgtgaaagccatgagaaacagtaaaaaggtctccaagagctggtgtcagctgctcctgctgtcagtgccgcagacacttgcaagtttccctcctcactcacagccctcacttagttgcctttaaacaggggctgcctttgaaaagatttctcaggtgtgaagggacaccatggggcctgcatttccctccactgcagaccccctgtattagtccattttcacactgctgataaagacatacccaagactgggtaaattacaaagaaaaagaggtttaatggactcacagttccacatgaatgaggaggcctcacaatcatggcagaaggtgaaaggtatgtcttgcatggcagcaggcaagagagagaataagagccaagcgaaaggggtttccccttataaaaccatcagatcttgtgagacttattcactaccatgagaatagtatggggaaaactgcccccatgattcaattgtctcccaccaggtccctcccacaacacgtggggattctgggagctacatttcaagatgagatttgagtagggacacagcaaaactgtatgaccccctttaggtgagtgcaggtgtattgggtgccttccattatctctttgggaacagccacagtcagctactgatttcccgtcccacacacctgtcttgctccttggaagcagcctcacgcaaatagagaataaaagctgctttcacaacttagccaagcagtgttaccccaggggataatccatctcttcctctaccccagtccacatttcacaggtggaccctgcacaaagcttcagaatccccggagaaggtgacggatattttgaaatgtcatttgacatttaagtgcctatctctggtcccagataaaaacagtggagggcatttagaatacaatcaagtcataacttttaaaaaggcaagggcagaaatatcatgaacaggtagtcactgaatgagataacagagaaaaccaacttggacagtctaagtggagtcatttcttctcgcgtcctacggtgaccagtgtctcacaggagaaagaaaccagggggcatcagaggctgttggaagggaggtgttgggacggactactgtggcttgcctgggactgtccagggtgtagcacggaacatcctgccccacagctgacccttcagttccaagcaaaccgaaacagctgggccaaccaagttccctctgtgaaagtaaggtagcattcacattccattgtcacatggattaactcacttaatccagggttcagccctgttgggataagttggctaatatgatattttagccccagattgaaggaaagaatggggtaatggaaagaaaaagggagggagggaaaaagaaaaaagtcattgtgctggctacagcacagaccactagtagttaagactgtgtgtgtgtttcagtgttttctactgaaaacgccaaagaatgcagagcttctctttcagacctggcatcaggcttccgtgagccctttccaggacaccagtgcattgagtcgctgctatatacctggtgatgagccgaagaggacattttcataatgaaaggcaaagggggccaggtgtggtggcacacacctgtaatcccagcactttgggaggccgaggcgggcagatcacttgagtccaggagttggagaccagcctggccaacatggtgaaaccctgtctctactgaaaaatacaaaaaaaaattagccggcttggtgatgcatgcctgtagtcccagctgcttgggaggctgaggcatgagaattgcttgagcctgggaggtagaggctgcagtgagccaagatcgcaccactgcacttcagcctgggtgagagagcaagactctgtctcaccaaaaaaaaaaaaagaaaatgcagagggacaaaggagacaaagaagagatgagtggagagctgaaaggccccacctcaacaactcctggagttctaggccacatgtggagaagagcaggggagactcctcagcataggtcgccatggcgaggacctctcttcccttacagatgtctgggcctctgcagagtctcagttaaaaagcatcagtacatctgttttcacatgaagtgtgtgccattctaggaatgcagggaagaagcttccttcctaagtgtatgtcttcctgagagggtcggtgatatgaagatagcacatgtggattatgcttgtttatactatggagcaggctctggggtgtctcctttggagggagccctcatgtgaaacttactgtaacattgtcaatgtggtggcacctttaggagctcactgataaatgcagtgtacaaacaccccattttatgtattggtttttcttttagtactttatttttttcctttttaattttaatttttattttaatagtctgtagggtacaggtggcttttggttacatggataagttctttagcagtgatttctgagattttagcacacacgtcaaccgaacagtgtgcactgtacccagtatgtagtcttttcttcctcaccccgctagtccccaaaatgcattatatagaattcttatggcttcccatcctcatagcttagattccacttataagtgagagcatacgatatttggatttccattcctgagttacttagaataatggcctccagctccatccatgttgctgcagaagacattatttcattcctttttatgtctgagtagtattccatggtgtatatatgcctcattttctttatccgctcattggtggatgggcacttaggttggttccatatctttgcagttgccagtaggaaacaccccattttcaatgtgggtatctgaatgaagagaccacgggttttggatggtgttgtgtctgtaatcccaataataaagtggattttcgcgattatccaaaagagagcatgcacgcacactacgttttcgtgctcatttgtcacgtcacactagcacacacaggaactgaatttttaacttaaaagattctaaccatttaattttcaaaccacagtacataaaacaggagcagctctgaagtggttttatattttaagagcatgatttttagttttgcaattgcctctcacactctgaatgttcaattattgattgaacagattgttatgatcccaataaaataataaagttttaagctgagaatcttgcctcaccacacagctgcgctccatttcaacaatgctttggctgcaacagaaacctctcccctttaaaggagccacggcggggagacccccggagccagtaagaaacagcatgctgtcctcaccacaatctctactctggggagcccccactgtaattctgtctctttctgcacagttgcagagccaatggtgacgacgataataaacacttcatccacatgtctggttccataaaaggccatctcgactttctttttcttcctacagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatat

SEQ ID NO: 5448 - DNA, 90604 bp, human
ctcagtgcgcgtgcgcggggcgggcgggtgcgcgcgcacttcctcctcgcccccacccagacccagaaggcgccaccatggcggcgcccccgcagcccgtcacccacctcatctttgacatggacggacttcttctgggtgggtagtgtgcagccgccgcctccagtaagggcggtcttgtgtgggcgtggggacggtcggcgcggggtacgtcacggcctgggggccgcggcggggcggtgttcatgcagggacgctcgggctcccgcgcgctctgcccccggctggccccgaagtcgggcggcggccaggagcgcccgcgggcccatgtccgggctggcgggcgcgcgtggccgcggcgtctacgcggccccagcacccgcttccggtcggcggcccgcgcgtggggccggagcacgtgggagcagtccctggggtccaccgggcgggcgcgcggctccgcgtcctctcctcagagcgaggcgcggcgggacctccgcgctctcttttcggttacgcatgcgtgcgaccttgagcggtgcccagcctcagcttccccgtctgcaaagtagcctggaggatacttgcctgcctgctccaaggttgctgctgtgggcgcactttgatggtagcatcctgcatggtagcggttctctacctggcggttttgcagccctgagggcatctggcaatggcgatgtcaggagacattttggctgtcacagctggcgaggagtgatggggtcactggcatctagtggagtccagaccagtgatactgttaaacttcccgcagtgcacaggagtgccctatgcaaccataaggaattatcccgcgccgtcaacagtgtagaggcacagaaggtccgtcaagtggcctggctgcctagggtgaccagcaccggggacatcacctgtgggctacttgtaaatgtagaagctggggccccaccctacccctgcccaatcagaatctgcattttaagcgcgtgaacgtttgagaacagctgctctatcaatccgaggcattaagaaacccttggcagtgtactaaggtagtcagtcttagcacatgtgaacttcaccagccaagaggaattcaagtagaattcaaagaataaaaccctgtttttaactcaagacagaactatgctgagctctaccgaaagccttgacacagttaacactatgacacataatcaccaggaggcttcatatatctataaacatgtctgcatactctttgtagacagctgacctgcttggttacgtatatcattccttcatttcaaaaccctgcaagttaggaggaagtatttgcatgtcactaattaaaaaaaaaaaaaaaaaaaaaaccctgcagctcagagaggtaaagctacttgcccaaggtcacacagctaataagccaagctgagaaacgattctggattgatccagttctaaatataaatgatgttgagctcatcttaaattgtgaatgtgaccttgtttctgctcatcatattgctgggtaattccctagcagtgtttccttttaaaaaggcatgcagaaaccattctcttcattttatgaacacagaggtgtaaactgatgaattccaaaggaaaaaaaaaatccccgtagaggtcactaattggagccaacggtgtatgcagctactaaatttgaaatgactcaatttcagaaagcttgtgggatacataggtatagtttgtagacatgaattttcctactccggtggtcaaaaagttaaattgtcaaataaatttcttatcctctaataaaggtccagagaacctgttctgggagtctcatgaattttaataccaaacaagatgtctcattaaaattaaatttattaaacttctaaatgagcttggtgcctaattctgattctagattcacacatagccatgccctgaagtgatgaatgtgacttaaatggcattacaagcattgacctcacattgttacccaatcctctgatctagtcagataaccaagaattagtgctatttggaaaaataagccctgcttctttttattcccccccctcattttctgcccatttcctcctttcctgccctacctcttctttgaggtggtaaggccttgcaaaactttcttggaaatatacctttgtttatcccattctttcaccaaatgtgtaaatataaaacacagctttccaagatgtgccactttaatttaatctaccagattatgcctgctgtcattctttagcacctcacttcagtgtatctgttgtttgcataacaatatactatcaatttataatgagttattttacaataggtctgtttttcgggaattttgaatgcatttttctaggaagttctgtttgtctatgtagccccaatacttgcatacttggggaagtaaaattgaaaacgaatagtttcatggaggattgttaacattagaggagaagattgtttaatcagaggagaatgaggaagtaaatggagattttagaggaaatgttgaccaggaagaaagccaggacactttcccatgcttttgacatgcacgatgctgttagttgtcctttaaaaaaaaaaaaaaatacacttcggtttctgtttctcatgaccaaggtaagagtcagttatgatttaggtaatattaataattttggctctcaaatgccattcagagaaagagagtaggggagtgggattagttaaaaactgggatgattttgaaataagaagatgacaattattaaacagtatctcagcagctggacagggaagattattctgtttgtaaataactgaaattaggaacacaaaagatggtcccaatttctttaaaagagaagacagtttgttgtccagagcagttctgtctcatagaattgagccaggtaaaaattttggggagcaatttttaataagtaaaaagatacagatgacattgatttggatgatgtatgttatgtaacctaatgtatcaaaaatattatttaatacaaagtcagtataagaaaatctttgaagtgtttgacattaattttgatactaggtcctcaaaatctgtgtgtgttttatacatacaacacatcttagtttgaactagcctcatttcaggcactctgtagcctcatttggtgggtggctactggcttggacagcatgggtctaggtctttgtggagcaacccaagatgtctgttgataatggctatgctgggagggtcaggcagagggtgggtgttaagaatattcagaattaggagttttggtgtatgtaaaatgtggtatgtgtaaaatgtgttttcttggagtctaatacagaattatttaaaatccttttaaaatcaaaggaaaataagcttatttccagtttcttaaatatcgtaaaataataaggtagatctgcgaagggtaataagaacatttgcagtgttgaccataatataccatatctttataaatccagattgcaggattttaatgagtgacttctacttcacctttagtaaaatgaagacctcttctgtgcctttttgcactcccgtagcttcctccttgccaaataatagcacttgagactataagtgcctgcctcactgtctggggcccaggagaccctaaaaggtcatggaggtagggtctctgtggggattaccaagcccagtactgatgggattgtgggctgcctgagacagttgacagtcatgtccactgtgtggccaaaattccacagacatagcgtgagtgtgttttgcgctgtcattctttgttaacttcatgtaggctgtttctttagacaccagaacatctatatagctgatgacaaaaatagatttttcttacgtaatattagcgcatgccctaggtggattgtcagaagaatctatgtatgttgtcatttgaccccatgaaatacgtctgaggtttaaaagtgcagctgacaagcttttcagcctcagtcggttcttactacttgatgttatcaagtcattcattccaagtgggatttctaagagttttggcacatttctgaggaaggtggagcaaagtgaaggatcattctgcatgcttccataggtggttattgtttaaccccagaacgtgcagtgatcctagttggaatgagatcgtaatcacaatctcccctccttccatcatttgtaatgggtcttgctctggatgtcaaagcaactctggtggtaggttcacattctttctttgccctgtcttccctggaggctgacagtgtacccttgggttttacccttgctaggtgaaatgtaggttctcttccacgtttgcaaaggagatggctgagggtggaggccagtgtgagggcttgggacagagatgaacccttatctcaggggccatgattggcctttcactacagggtgatcaatgagtaatctgttgtttctggaaactgaaaaggcttctggaatatagaaagcacaagacacgtgtgttcctattaagggtccgaagagatttagagtaagatgctatattgtatgttggagaaacagcatcagattatagatttagctccgtttggttctgttttctaattgacctgaaccatgccaaccttaagttcttgtagtaagtggttggttgtccactgcagctgtttctgtttctagaataattgagaagggggtaaaacttaaattgcaaaattctgcagataaataataagagttttgtccagctggcaacacaaatattcagcagattctaggcatgcaggtgtaaaatatccttttcttttttctagctctctctttcaaataaaagcaatatggttttatttagaatctttaagtaaactggatacaggcatgtgtgagaactattgtgggttcagttccagaccatcacagtaaagcaaacatcgcaataaaattagtcacatgaagtttttggtttcccagtacacataaggttaggtttatactatactgtattctattaggtgtacaatagcattatgtctaaaaaatgtacataaccttaaatacattttattgctttaaaaaaaaaagtgctagggatcatgtcatccttcagtgagttgtaattcttttgctggtggaaggtgttgtcttgatattgactgttgaccagagtagtggttgctgaaggttggggtggctgtggcaattttaaaaaataaaacagcaatgaagtttgccacatcacttgattctttcttttacaaaaaaattctcttttggcgaggcatggtggctcatgcctataatcccagcactttgggaggcagaggcaggcagatcacttgaggtcaggagttcgagaccagtctggccaacatggcaaaaccccatctctaccaaaaatacacacacaaaaattagccaggcatgatggtgcacacatgtagtcccagctactcaggaggctgaggcccgagaatcacttgaacccgggaggctgaggttgcagtgagccgagatcccaccactgcactccagcctggacgacagagtaagactctgtctcaaaaaaaaaaaaaaaaaaaaattggagtcctctcaaactctgctgctgctgctttaccaactaagtttatgttaatatagtgaatcctttgttgtcacttcaacaatgttcaacaacatcttcaccagaaatagatttttatctccagaaaccactttcttttcgcgtccctaagaagcagtgtctattcagttcaggtttcatcctgagattgcagcaactcagtcaaatcttcaggcttcacttctaattctagttctcttggtatttccatcacattctgcagttacttcctctgctgaagtcttgaacccctcaaagtcatccatgaggattggaatcaactccttacaaactcctgttaacattgatattttcatcttttcccatggatcatgaatgttgtgaatggcatctggaatgctaaatcctttcctgaaggttttccatttactttgcctagatgcatcagaggaatcactatctatggcatctataaccttaggaaatgcatatcctaagtaataagacttgaaagttgaagttactcctcaatccatgggctgcagagtagatgtcgtgttagcaggcctgaaaataacacgaatctccttgtacatctccatcagagctcttgggtgaccaggtacgttgtcagtgggcagaaatattttgaaagaaatatttgtttttgagcagtaattcttaatagtgggcttaaaatattcggtaaaccatgctgtaaacagatgtgctgtcatccaagctttgctgttccatttacaaagcccaggaagagaagattcagcatcatttttaagagcactaggattttcagaattgtaaatgagcactggcttcaagttaaagtcaccatctgcattagccactaacacaaaagtccgcctgtcctttaaagctttcaagccagacactgacttctcctctctagctatgaacgtcatgggtggcattttcttccaatagaaggctgttttgtctacattgaaaatctgtttagtgtagccactttcatcggtgatcttagctagctctcctggataacttgctgcggcctctccatcagcacttgctgcttcaaggagctgttcaaggacagagcaaggagcaattctttccttaaacctcatgaacttctgctagattcagacttttcttctgcagctttctcacatgcctcagtccccatagaagtgaagagagttagagccttgctctaggttaggctttggcttaagggaatgttgtgctggtttggtcttctacccagatcattaaaacttcctctatgtcagcaataaggctgtttcactctcatcattcacgtgttcactggggtagcacgtttaatttccttcaagaacttttcctttgcattcacaacttggctaattgggtgcaagagacctagctttcagcctatcagcttctgacatgtgttcctcactaagcttaaccatttctagcttttaatttaaagtgagagatgtgtgactcttcttttctcttgaactcttagaggccattgtagggttattaattagcctgatttcaatattagtgtgattcagggactagggaggcctggaggagaggaagagagatgggggtctatggagcaatcagaacacacacaacatttatcccttaagttctctgacttatatgggtgcggttcatggtgccctaaaacaatgacaatggtaacatcaaagatcactcatcacagattgacgtaacagatgtaataatgaaacgatttgacatattgcaagaattaccaaaacgtgacacagacacgtcacgtgagacatgctgttaggaaaatggtgttgatagactttctcgacgcagggttgccaaaaaccttgaatttgtaaaaactacaatctatgaagcacaataaaataagatatgcctgtataatatgggacagcagtgcatcgttttgttttgttttgttttttgagccagaatctatttttctccttgaaaagctatatattagagattatttggtcctttttatctttgcgattattcactccttactctgattctatttctttttttttaaactgctataatttatatactattttctgtcatttttcaggagtagatggagacttaaagcaatgtaaaggagcaaggtaaatgatatctcctaagaaatgtcccctgaaagcactccttatatagatgctcaggcgactggtcagaccttctgatgagatgtttgaaaagtgattgataggcagtctgtaggtagaaagcacaatagtgttattctggaatacattacgcttgaaaataatgctcctaccatcggctataagggaattttagtgattaataaatgcagcatttaatatattaagagcttccttcaatagtgttaaaatggtggaagggggcaaccttgattttgtgttgcagatatttgcagtttaaaattgccttgttggtgcttaaagagcatttttttgaagacatagtaatcctaacacatgcatttctactgtgtaagagcacaaaaaggaagacttttccccatggcttttcatagctgggccatccatgtggcttctcttcacatcccttttcagcaatgtctggcagatagatcaccacctttcctgatcctcctttatcctctgtctcccttgtgtcctttgctgtgatgccaacagtgagtagcagctaaggaccctggtgcagctggccacgtggcaaggtgcctgcgtatgagaggaggatggtcacctcttcacagccatgcctggcaggcagtttcatggcattgcttgtggcgcttggtggggcccttgactcttctctctctgagctctgggagctgggccgaatgatgtgcccttttgtgattgatggtgccttatttaaaaaacactgcagatgacatagctgttcaaggacagagcaaggagcaaaccaaagtttgctctttgactcccaatagactgttccatgtgtctatgaagtaagagcaaatggtcatagttggcacatcgaagcttatctgagccttcagacaaaagccaaaataagcaccaaccctctcccacttgtgtcagctgccatgcacatggaagagaagcacatggtccttgagcactgtgcgcctgtctgctctctagcccagcactgtgtatccagcaaatcttcctgccaggatggaaatgttctgtaactatactgcatccgatgggagccacagctggaaactgggttcatgagatgtgactcatgcaactgaggacctgaatttctcgtgttatttaaatagcccccaatgactaattgccaaaacgtaacatagagacacaaaatatagagtggacagcacaactctagaggaatgcattcactcatccttaatctatttagaaaatactctgctgggtgttacaaaggcttcaaaattagtctcttcctttaaggatcttagagtcctgctggaatctaaaacatgattggtaaaatctgtgaataattgctaatgatatacacaataagaatgtgttagcaacagtgcaggattttgaactgaaatcacatttggggtagcatactgtcaaggatagataggagccaagaagaaaaatggatattccagaccaggagaaatggccaagccataggcatctttactaaagcatagaagagagtcgttttttgttgttgttgtttttatcaagcaaagactgtattaaaaaagatcttgctaatgattacattgaagtgtggaggtgagaagagatttgaaaacataataatcctaacacatgcatttctcctgtgtaagaacacaagaaggaagactttgttttccccttgggtttgcatagctggagcacctgtgtagctcctcttcacatctcttttgagcaatgtctggcaggtagagattagaaatctctaatgtttcattgagaaatacgagactggggctggggacagtggttcacgcctatcatcccagcactttgggaggccgaggcaagtcgatcgcttgaggccaagagttcgagaccaccccggccaacatggcgaaaccccatctctactaaaaatacaaaaattagtctggcatggtgatgcgtgcctgtaatcccagctacttgggaggctgagacacgagaatcacttgagcctgggaggcggaggttgtagtgagctgagatcacgccactgcactccagcctgggcagtagagctagattctgtctcaaaaaaaaaaaaaaatactagattaatctctgtcaggctaagattagtatttcttaaactgggtgcccattggtaatatccctttagcctattttaaagtgaaaatctcaccccatcctgcaagcacacatcctgggttttccccctatgactttcagaagagtctaggatggttatcgagacaccagcctacattctggatttgtctgattgtttccacatgataccaccttacttgttcctctgtcccctgtatttcctctaatctagaaattatgcctagtgcttcagttggacacaggtcagctgcctctggcaagaataatgctgtgccccttcgtcacctttttggggagatgtttgtattcagtctatatagggtcagtaccttcatgctagccccagccctgcagagtagagttgtcctcaggaaagctggtgaactgactcctctcccatagtggtacatggaactttttagtgagaagttcagagcctgagatacaagttagaagtactggctataatgcctgtgtgtgtggacagccggaacccttaggcaggaagaggaggctgccggggacagaggtgtgccatgctgtgcacccttcgaagagaaggtactcacaggaacctaaataggtttcacgtgtatgggttcctctgttccatgcagtgggatacaggaaagaaagagcagccatgcagctgttttctcactgtgtcggagcacacaccacagtctctttgatgtttgctcatgagattgaaggacactcatggctttgtcacaagatgcctgagaaagcacagaggttttttgtttgtttgtgtgtttgtttttgagacagaatctcgcactgtcgcccaggctggagtgcagtggtgcgatctcggctcactgcaagctccgcctcccaggttcacgcctttctcctgcctcagcctcccgagaagctgggactgcaggtgcccgccaccacacccagctaattttttgtattttttttttagtagagacagggtttcaccatgttagccaggatggtctcgatctcctgacctcatgatccatctgcctcggcctcccaaagtgctgggattacaggtgaaccaccacacccggccttagttttattttttttttttgagatggagtctcgctcttgtcacccaggctggagtgcaatggcgcgatcttggctcactgcaatctccacctcccgggttcaagcaattctcctgccctagcctccctagtagctgggattacaggtgcctgccaccacacccagctaattttttgtatttttagtagagatggggtttcaccatgttggtcaggcaggtctcgaactcctgacctcagcacagagttattaaaatcaaatgcagttgcctacgctttgtctgcttttgaaaagtaaacttaatgtttcagactgaggtgtatttgtcattggggtcctatgttctgcacagtttgtaaatctacttcacccaaagtgatacagtgatactcaggagggcttaaaaaagattaaatccttcatttggaaacatcatgcccagtgaaaggaacacaggccctaaggagatgtggctgattctagggaccgggaccagtaaaatacaacatgagcacagagcactttctcatgccaggatgcagtgggcggggttgggggggggggtcccactggcacaatatgaaccatttgtaatcaaaagaataatgaccagaagagagtataatactctgtctatatattttttaagtctctgtgttatgattctcaaaagagtaaaagggtggctgggggtgagctcttttacagaagaatgccagttaataaatatggacagaatgggagaattagccaggtcaccattttgggatcccgactgtaagtggttcccacaagcattgtcagtggaagccaaaatcatagagtaatcatgcaggagacgaaggtgcccgcagtgccatgtcagaagtcactgactgataacagaggcaaacgggccttcagagcgggcagctctgggggccacaattgaccctgtggcccaactgatgtagctttgccatccagaaagcagcatgtcacgtcacgtgtgctttctgaagtgacctcagaaatggttaacctgaatccatctggacctctagcagtttcagaggggtagaggaacacgggagggggtgtcatgtggaaacagcaagacaaatcctgaatgtaggatgttccaccaggtacctggactgggtccttgaaaatgttgactatcatggggaaaaaataggggctggcttttccacttttaaagaggctaaagggacatagtcaaattcagtggaccttagattggggaaaaaaatctataaaagacatttttgtgacaattggagaggtgtgatgtgtgctatttagggggtactatgaaatattgctgatttgcctgggtttggcagtggtattatggctgtgtaggagagtgttattctgaggagaaacgtgcagagagctagaggaatgaagagttagggcatctgcatgttttcaggtgtgttgcgtgcaggtatagggtatgtagatgtttcctatcctactattgactcttctgtatacttgaaaagttaaaataggaaagggaagattaagtcttaagcatgaaccactaaaaacaaccccaaaagcagtattaagtagtagtcagttaattctgtttaagagacaagaatgtaaagcatgcatctttagaaaattgatgttggagatatggaagaaatagtttcagaaccttcagctctctcgaacattacagtggcaatgcattcattgcaatgtgtattatagcagaaaacattctgaaggaagagtcccatttcctagtgctcatttttcagttcctcgtctctctcatagtgcaggagatttgtagacaaatgtctacaggatttagacagatgtcaggaaaattgtcttttgttgatgtcttaattggaatccgatagtttgtcagggcatgatgcttataaaaggaataaaagctttctaaaattcttcaaagagtagccactggtacctgtgtgtcacatcatatgctgatgagacatgacagaaaatgctcctaagtagccttatagctgatcctgaggagctactgtgactgggctctcactgcacctctcagctgacttctgcctactgggtctgtgtcatccctttttactctgaggctaccaaggtcttaggaaactggaggttggagcttgaactgagtgatgggaggaaaagacttcctgaagtgctgcccacatctcatgtatgttctcttggacccagttgtatccctgccattccctggaggttacctgttcatacgcagacttctctttcccttatttacctcaattgcagtagcttggcaaccttttaactcttgctttttaaaaggaaaattatttggttatcgtagaaacattttgtgcagcaaagtgttacacatatttctgttctggcctcaaataatcatggatttcattaaatactaaacattttgctgattttaatacagtgctttagtgtattcttattttctttttgcatctcttatttgcctcgtttatcttaacataaagcatttcctttggttaagtagatccttatatctgctttttctttttgtatgactcctatttaggttggtgctaaagtaatgacggtttttgccattacaatacctgtagacataaaggtctagcttactttttgccatttgctaccctgtgtttagtactggcattttgctgactgctcatcagcttttgatacggtgtgcttacgtgacaagctctttaaagtgaaatcataatcagatttgagatttagaattgaggcgacttgtcctgtctacagtgaaactgaggcaggacaacctggggagctatgaatagtaggaaaatcccagtgaaaatccagcacttctaacttctactcctgggcgcttcatcacttagagttaccagcagtcttggtaccatttgttcatagttttgccagccctcacaggtacaggtacaattgtagatactgaaactctcaccagctgacatctaatttaccagctgatttaattttatctcattgatgattgagaggctctactgatagcccaaaaccactttagcttaggtgaaacatgagctgcgttggtaactgaagcctggcccatctcattgacaacttacttactgtactgatttagtaaaattacccatcctctgtgtccccgagtatggtttgcagcatatcacaggcaatgtgtgacatcttccaggatattgcatgcctaccaaaatataatcagattaaagaacatgttcagttcatatctgacctacggccccattgcactgtttaacatgattttgcaacagagatgtaaccatctgcacatgttatgcatccccttataccattagggtttatgctgagatcaagtaaaatcatatcctctcatagggaggggacgggacttctgtgaagtagcctgaagaaattaacatctttatatgatcacatctataatacagaataataaatgccatgtacctgttgctgtgtttattgcttctgctggctgggactagtgagtgtcccgattttaaggacgtgttttgaaactggcttgtctgtctttctgcctctcttctcagccaagtgtcttgctaaagtgggctgtgtttgccgaactcactcccccattttccttccctcgctatgagctggctttttggccctaccactcacagaaattgttctgacagaggtagcagtgatgtccgtgctgctaggtgcagagggcacccttttcttaaattgccagaacttccggcttcctttgccgcttctgcaccctccttggaaatctttctctttggcttcacggatagttcctcttctggcttccccatagctttcttttcctcctggtgcctgtttggcgtccctatggctttgttatgggccctgtcctcttgtggaaacctcttctgagctcatggcttcggcacatgcttctgctctgatgaccccttgacctccctggctgggcctcacctcttttgagttcctgtctacgtttcccagtgaccacaggctcttcctacccgcgtggccaagaggcagctctgaagcattgtattttaaacggggcctctagttctctgccagatctgctcttttcctgcattccacaccaggcagcaaaccccgaaagccccacagcagatggctgggagttatcttccagtcttcaattccttgccatccccacccacaccttccaggcacctcctgatttataaatatttcaaagccacttctgtgtcattccagctgccatttcctgcttcaggctttcaggcttttttctgatctaatagcaatatttactgagaacctttaccacatgcagttctgttggttacctgcagtgagatcagtggtggctgtggggttttgatgctcatgagggtgaaatcgcagagttctggggcccaggtgtatttgcatgaggtggctttggtgagagcatagccttcaccaggatgtttttggaggtttttctcctagtgtattttcctagattcctttgtcaaaggaatttggtcataaactggcccttaagtactttctaagagaagccttgttcatgtggatcacaatgaccttagactttgtgtgcgttgtcagtgctgccctctcctgggcattgcttctgcattcttaatgcaaatatgtgagttattcctgggtgtggctccatgacttgttcctttctggaagctctagccttatctcagccctcatcttgttaaaccagttgtgctgaccttgcttctctgacagcaacctgataaaagcctgtaaagttgcccacttcaagtcattgagcaatacaggtagccaagcagtagaggtggttacaataaatggcttaacattcccagcatttaggtggctccattcagatggcggaaggcaggtggcactttctgttgtggagaatttgaggagagagctttaagttcaaaaggaatttaagaaaagcctaagttggatctatgagggctctggaggagagattgagatgttcagggtgttccttcgattcatgaacccgactgacttttcacagcaggaccaccagttgccagatactgagacaactgagtcaaatgaatacaacagcatccctgttcttcaggggactgcaggcaggggtgctgtaatttgtacgggggcgggggtggacatgatctgttcttctatattatcatcattcatctgctagagacaactcgattttcttgggagccaggaaaaggaagttggccagtcggatgtgcctcacagcagagcaaacgcatcccaaatgagccaccggaagggttggggagtcactgaggtggaggaggaagggctgagggtatttcaggccaagaggactcggtgagaggcggagcacaggtaaaaaggcctgccaagggcagatggcggcgagccctgtgccaggctaaggaattcacattttatctcgtagccatcatacagcctggcgagcacacgatgtctagaagggtggtgcttctgatgatgtggactgttggcgcttagacactggagactggtagaaggctgttgccattgtccagatgaacgatagaaggactgcatgagttttccacaaactggggggcctaaaacaacaggagattactttatctcagctctggagacaagaagttggaagtcaggatatcagcagggctgcgtttttccttggcttgtagctgcatcgctccggtctcagcttctctccacgtggccttctcttctctccttttgtctcttataaataaggacccctgccattggatgtagggcccaccgggataatacagagtgccacatctccagatccttcacttaatcacatctgcaaaggtcttttttccaaataaggtccgattctcgggccctagggattaggacgtggacatatatttttgggagccacccttcaactgactacaaggacccacagggttggaatgaaaggaagaaaagtggctgattcagaggccgttcagctgacagctgggcatagagggatgggagggagaaggcaggtgaatagcagtgacttgtcctgaagtcgaaattagaggaagctgtgaggcctgaaaatagggatgagttccattttaggcatttggacatgttgagtttcaggaaactgaaagactgggcacctcttaggttgacagcattgatggaaacaaccatgatttcccatttaagacaaacaaaactcttggtgccgttaacccatgaagaaaactgacataggtggccatcgacctacactcgtctttgaacagctacagtacctagaagccattttagtttttacttttattattattattttttgagacagagtctcattctgttgtccaggctagaatgcaatggcacaatctcagctcattgcaacctctgcctcccaggctcaagtgatcctcctgcctcagcctcccaagtagctgggactactggtgtgcaccactgcacccggctaattgctgtatttttagtagagacggggttttgccatgttgcccaggctggtctcgagccgtgcacccggctaatttttgtatttttagtagagatggggttttgccatgttgcccaagctggtctcaaactcctggactcaagtgatccacctgcctcggcctcctaaagtgctgggattacaggtatgagccactgtgcctggcccctggaagccattttaaacttatttctaagtccccttcctcagagagaatacatgcacacacacagttggataattagcctaggaagggtctggaaatttagccatatgcccaccatgttttgtcctcctcctccttttgtgtgtgtgtgtgtgtgtgtgtagtatgtgcatctctgatacaaagggagcagctctggatccctagtcattctccaatcagcctccgaattccccctaaccctgcatcaaaacctgaatccccccaaccctgtgtgaaagcctgccacttcaggcttaatctttgttgacacgtaagggtgccgaactcacaactttgaagtccttttattctactcccttctccttttctcatcccagctgggttgtaaatgtcagggagaagtagagggcccagtcctccttcctggggtagggagattatttaaccatgggatgcaccatgatttccaaacacagttgattttccagagaagggagtgaaaagaaaagtgctttggaataacctttggactccacgcaccatgccggggataaacatggaaaataaccatttgttgggcggtgctccgtgtcacatattctagtatgtagttttatacccagccattgcccttaccctttcgatttttgttagagcgggacggtgccctgcatgctgtgtgctgtctgagtatgacatttctagtagtaaggaaggttaggatggctctttcctttgccttcattaaagttctcttgcccagatgtgagatctttaaaaggtcagtgtttttgaataaggaatgaaatcatattctaagataaaagttcagagagttatacaataaaataataaattagtaaatggcacttccctgagaggcgatggtcactggtcactgttgttgcatcccattcctcttgccttcagggaatatcccctcaggtatgagaatgctcagggctcaaagacagagaagagctgtacgtcacactgttggggctggcagcaaaatgctgagcaaccttgggctctacaacatgtcctccatggaggtcaggctctaggcctgttctgttgactgctggagtctcaacattcagaacacgggtccaacatggcatgtgtattgacagagaagcttcaggtaatttttatgtccttgaatgaatgggcacatgttacatgacagagcagggactagatggagccaatatattagatccccttctctccacacctcattttctatatagtgcagccagtatgagaatataaaatggaaaggaagaaggcatatcattttgtatgtgctctatgatctttaaatgttattaaatgttggtaatgaaatgctgtggtataactaattatatcctagcacctctttcccatatacttgcattctctaattatgttcaaagcaatggttgcccgaaggctaagggtactcggtcctttcctcccccatgaggactatgttttagcttgtaatttcacctgcaggagctcacaaaccagctgcatttgagtgcaattatactttattcatagtgactaataacagaaaagagacatcgtgggggtttgggctggagatttataatctcatataaaaaatacgaattcttgcttatttatgggttgagcaccttgggcccccgctgtttcatctgatggctgcctgatttttatccgcaaaatcattcattagtatctacactagaatgtaaacacagaatgtaagataaatttgttgtgcagtacttggatagttagaacacatttccccagatagaaacattaaaactagaggttattcactcccatattcacacaacctttatgcacctgaggaggttccgaatgtccctgaccatctcttatttcttatgggaaagtgtttgggtaccagcttggaatgccaggagtgtaattctccagggcagcgactgccgcccgtgccattgggtccctagccctttttcatgctctgctttctgatgagcttacacacacaggcatggtgtactgtgggtgcttagtattgctgtaggacttcttgtgtcctgagttcaccactaccctttaattctaaacatttataaactattgaagttagattcaaaactttcttttccctaagcttttactttctgcttattctgcttataaattagtaaatgttggccgggcgtggtggcacacatctgtaatcccagcactttgggaggccgaggcatgtggatcacttgagcccaggagttcaagactagcctgggcaacatggcgaaaccctgtctctacaaaaaatacaaaaatcagctgggtgtggtggtgcacgcctataatcccagctactcgggaggctgaggcatgagaatcgcttgaacctggaaggcagaggttgcagtgagccaagatcataccactgcactccagcctgggcaacagagtgagactctgttaccaaaaacaaaaaatctagtaaatgttaacagtcactgttcagaggccataacagtgtttgagtctcaacctttacaattttttcataaacttcacctttatactgttaactcacacttacaaaactctaatatattttatttctttgttgagtacttcagttgtctgaattaaagaatgaaactcttttagtcaataatcatcttaaacataataagtttataaaaatgatgaacctaaaattcttaatatttcaacatcattctgatcatgccttaaattgcaaatgtaaataattcaggtatgcatttaaatggttatttattagcattattgttctcataggccaaattcaattaaaaagtacaagtaataaaataataagtaacatggaaaatgtattcagtggtcttgctgcttttaagcatccctctaaatgatttgggagttgagagatgtctgttcattaaggaaaacagttccctcccaggtactttacattcccatgcaggtgattagagttttcatttcttaaaataagtaaatatctttccacctaactccagtaatctttgaacttgggaggaattctccattcttttatgcttctcaggtcagtacaagtcgtaggtacagctattaaaaggatatctgattgaattctggatatctttcatgtagtttgactgacagtaacacctcatagggccacattactgacatagttagaacattgtgctagccttagttatgtgtctgccaagcccctagctgttcaaagaaaaggcggtctcttaccagctgtccttccctggtaattggagctgtggaataaaggtcagttgctctttgagaatgtgagtgagcatttctgactcctcatccttcagtgcccccatgtgtggaaggcttggtaaattgagctgtgcctgcagttaccaagctatgcctccttttgtcaatataattcccactttgctactttgggtaccagaggtacactctgcatagcaggaaccataccctatgctttttggttcttttgagaaatcctaggtagaattagatacataaaatctgagatactcgaaccaatttatacatatgcaaatatgtattctttaaaaaaggatcttgatccttatttcttagtgatcttcttcatcccttccccatgttaagatagcaccttccattaacaaactgctcttgccttttatataaaaaaataaaaattaaaaaaaccaagtagatgaagatgaataacccagtgttacgggctgagtcatgtccccctcaaacttacgtggtggaggcctaaccccaggacctcagaatgtgactatatttggagataggtctttaaagggctaaacaatgtcctaatccaatgggactggtgtccttataagaggcgattaggacacagacacactacggacaaccacgtgaggacacagggagaggacagcatctactaaccaaggagagaggtctcagaagagaccaaccctgctgactgactctgatcttagacttccagcctccagaattgcaagaaaattaatttctatgtaagccacccattttgtgttattttgtgatggcggccctagcaaacttacagtcccaagaatctaagatttttgattgtgtgaaggatcaagccatctggaccaatgttttcctgaatttctgggcagacctttccaggaaggtgggcagcaaatggcccaggtctgttcagttagaggatcaccagagaagtttctccattctcagctcctatcatctttttacagctgaattttctgacattcctccacccccaccagcacacaaaaataagtgaaccaaaagcataacagctaaagaaatattcctgtgacatggtcactcatgtgtctttaggagagaagcactttgtactgtgtattgctgtttatattcttaatgtttttcttacatttcatgatgatttacattgccctaaattttttaaaaatgtaattttggcattatcttcatatatatgcatatatccctggtggtaattcctaacaggccattgatagggaatgctaagagtaaggatagtgatatggtttggctgtgtccccacccaaatctcatcttgaattgtagctcccacaattcctgtgtattgtgggagggacctggtgggaggtaattgaatcatgggggcaggtctttcccgtgctgttctcgtgatagtgaataagtctcatgagatctggtggttttatgaaaaggagttttcctgcacaagctcgctgtcacgtctgccgccaagtgagatgtgcctttcatcttctgccatgattgtgaggcctccccagccacgtggaactgtgagtccattaagcctctttttctttataaattacccattctcaggtatgtctttatcagcagcctgaaaatgactgatacagatagaaatggaagggtagcggagggcctgtcaccttcactgaaaaagaatagaagtgattgagttttggtaggaaagatgatctttaaataaagcctttgtgcatgttgtggaggacagttgctggttttcattaattcaaaaggcctagggatatgtgggtttggcattaatctataatgcctcagacactggaaaactagctctgagaagggtttaggcaaagtgacatccatctagagctctatgtttgtatatttagctcttaaaattcaaaaagaatttagattattgccattagctaaatggaagcatcatggtgcatcaataggaaatgggaaaaaaaatgattaatagtatttatacatatgtgttattctgtagcaataacgaaggcctagcatgctggggtttgttttcattttgtgaggactatactgtgctgttttttagtaaactggtgaactgcctcagataaattgtcacacatagttctgtaaactctgcctgtagctttcattgactttaggttgtgaatgaaacgtttaaaagtttatttttatgttttttttatgtttttttttaatatgtttgaaagtcattgtacagtagcccgatgagggaaaaacaaaaagatagccaaagttactttttttttgagacagagtctcactctgtcgcccaggctggagtgcagtggcgccatctccgctcactgcaagctccgcctcctgggttcacgccattctcctgcctcagcctcccgagtagctgggactacaggtgcccgccaccacgcctggctaatttttttgtattttttagtagagacagggtttcaccgtgttagccaggatggtctcgatctcctgacctcgtgatccacccgcctcggcctcccaaagtgctgggattacaggcgtgagccaccgcacttggcaacaagatagccaaagtttcttaaatgccttctatttctattgctgctgtaacaaattaccacaaactgaggcctgattttaccaatctcttggtaaaatcgggtgttggcaaggctctgtttgtttctggaggctctaatggggaatgttttcttgccttttccagctattagaggccacccacacgtcttgactcatcttcaaagctagcactgtttcacctctttgaacatacttttttagtgcagacgtttgtagccataatttccctccacgcagtgcttttgctgcatcccataagttttggtatgttgtgtttccatttttattcttctcaaagtatcttttaatttctctcataatttcatctttgacccacaaatttttaggagtatgttgtttaatttccacattatttgtgaatttcccaagttttcttcagttactgatttctaatttcattgttgattgggaaaatatatgatttcacttctttgtaaacttattgagacttatgacccagcatatggcctattctggataattttccatgtgcacttaagaataatgtatattctgttattattgggtcagttttgtatagatgtctgtcaagttttaatggtttacagtgtgtaagtggattaaatcaagtcttgtatttgtcttccgtctagttgttctgtccattgtcaagtgtggcattgaaatctccagctactattattggaatcagctatatcccctttcagttttgacagtttttgctgcttgtattttggggctctgtggttaggttcatatatgtttataattgttgcatcttcttgatggggtgacctttatcactataaaatgtttccattaaaattgtttggttttttttagtgaaatggtttgtcctaagtctactttgtctgatattactatagctacttcagctctctttgggctgttgtttgcaaggaatctcatttccatcattttactttcaatgcttttgtaccatttggtctaaattgtatctctattgtagatatcatatagttagatcatgtcttttttaaatccattcttcaatctctaccttttaattggcgtttttaatctatttacatacaatgcgattattggtaagacaggatttacgtgcggcatgctgctgttttctgtgttaagtcttcttgttaccttatttctttattactgccttttttaactttagatattttttagcgtgccattttaattattctgtcctttactgtatttcttagtgattgctctgtggactatgataaacatcttaaccacttattttaagtagttcacaaacctctgctcctatgtagttccgtttccgactctcttatttctgttgctgttgtcatacaaattacatgtttataccttgtttgcccatcaacacttataatttacttcacacaaaatttgatttacaaacaaaacataacgtttatactgtctttaatatctcccaaggggcaaaagcaaagcccagttgtgagccattgccttaaagtataaaaaataagtgttacagcattcttgtcctttatctcattttaaggtaacttagcacgatttagaaagaacaccagagacgtttttttaattggttattggataatgagaccccaaaaaaccctggataaaaaatgttccatttttaagtgtttccaaatctggcttgatagtttccagaacaaaaaataaagtaaaactttataacaatttttggtataaatacttcaagttagaactttgattcattaatctttattcaaatactgaaagtatgttgagaaggaaaatatatacaaactcataacgtaactctagtaataatctcaagtgagtttgacctggggagaaggtctgttcagagaaaggtgcatgtaatcgggtgatgagaatctgaatttgagccagctgtatccacacagtctttataagtcatccctaacactcagagcaattgcgcgggatagctgtttgccctggaaaaaagcttgactcttgctggtggagcccagattcaaaacgggggcagggggtggttacaaagcatatcaatctgttatttcatcacatacctgctgccttcttaaaggaaacaggaaagcattctttgatcagcatctacagggtctgagattctgctttgaaaaaatccatgtaggaaaagcgagaaggaaaggaagtacacaggaagggagagccaattcatctctgtgaccagaaaaattaaaagttctttttgcactggtcatctactgccaaatatgtgcttttaaatgggagagagaacaatatgcatgtacatagcagtattattcagtatcctgggctttttcctcttcattatggttatcagatttgtgtgcaaatgaatgtaaacacacacacacacacacacacacacacatatatgggtttttttttttgagacagggtcttactctgttgcacaggctagatagagtgcagtgcagtggtgcaaccatagctgactgtagcctcgaactcctgggctcaaccgattctcttacctcagctccccgagtagctgggaccagaggcacatgctaccacacccagctaatttttaaatgttttttgtagagacagggtctcgctgtattgtccaggctggtctcgaactcttggtctcaagcaatcctccttgccacagcttcccaggtgcctgggattacaggcatgagccacagcccccagctaacatattctttaaccccaatatctacaggatttaagactctctctgttggatagctcaacttaaagatatggtagagctctcctgaatttataaatccaaatcaacagttatttattctcccaagctagggacccaccctccttatggtcgcagggggttccctggcacactgcatgctagttagaaagccctcacactgaccccaggctcctccctatatgcctgtaccctttggccacctacctgtggatcttttctctctgggagcctccttgttctctgtgtttgggacaggctgtcaccttctgtcaactagggtaccttgctcttaaattatcccttcaatcccacctccaccataattaaagttaaaacagtagtgggacctgcttttagcctgcagtgtgtgggcgtggagggaaggcaccctgaagctccagggaaggaatggcgccatactttgtgcgctcaccagtgccccagaaaggatggcactggggacaagagccccaaaacatgggcatcccctcctccctaagaaggctcaacagagggtccccttcagggattccatcaataaagaaagcacattttatgaaggggagttgagaagtcccaggaagatttcctcacattggattccaggggtcatttatgagtgttgtgatggtcggtgggtattttttgtcattcagggctacttctattaacattgtaactgttcattttttcccaacctaataagtttttctttttaaaacaactttatggaggtttaattggagtacaataaactgcacataaagtatactgtgtgaccagttttggcatgcagttaccgtgacacagttcccacacccagatgacaaatcttcccacaactcccagaagtttcacgtgcccactgcaacccctgcctctctctgaccccatgccaaaggaaccactggtctgcttctgaaattaaagatttcctagaattgtatatagaaccacacagtatatgttctttttttaatctggcttctctcattgagcataattttgggaactcatgtcattgtgtgtaccagtagtttttatgccttttattcagttgtgtggctgcaccacaggctgaatatccattgacctattgacagtcttggcttctttccagtttttagctgttacaaatgaaactgccataaatatctgtgcctaagtctttgtgtaaacataggcttttctttcttgagtaaacatgtaggactggactgattccttcctgaggattgtatggtaaatttatagttaacttttaaagaaactgcccaaagagttgctatgttagccttttattactgctgtaaccagttgtcacaaacagtggcttaaaacaacacaaatgtattgtcttacagttctggacaccagaattggtctcagttggtaaaatcaaggtattggcagggctgtgttcctttctggaggctgtggggtattggctgtttccttgcctctccagctcctagagtggccgccattcctgggctctgactaccgctcctcttcataccttctctctctccctcctggccgcctcttataaggaccttgtgattatattgagtccacctggataatccagggtcacctccccacctcaagattcttaattacttttgcaaattccctgttgccatggaatttaacattcacaggttctgggaattaggacttggacatctttgggggacaattattctctctactgcagattgcgtcatcactgagttgtaaagttcagttccttacgtattctggatacgagtcctttgggtgtctgtgtgtgcatgtgtgtatgtatgtattgtaaatattttccctcagtctgtagcttgccttttgctttcttatgtgtatgtgccttttaattttgaagaaagcccctttatccatatgttctcgtacgacccttgctctttgcgttctatgtataaaaccttcacataatccaagcctccaagaatttttctcctgttttctttacagaggtttatgatcctagggatcaatatttttccccaatacagatatgttttcatacagataggtatggtctagcaacaccttttgaaccagttcattttttaagtgattttttaaatttaaatatggatgagaaaaaaattcttagaccaattcccatacctattaaatagaattgctaatgcctgtgaattatgccacatgctaatcaagagttttactttgcagatgatcactcaattatctttacagatctctattttaagcaatcatatttattattttttctctacagttcaaaaatgatagcttacagctacaggaagcgatatatcaaatacttaaatacttttttctaagcccactagagcaagcttctcatttgaggcaatattactgagactcttaattttatgcttaattattcatttcagtcctttaaattcctaaacacgagaaagcactagcatttacatgcaggctcatttgtaaaggtgaaacagtgacagcacggtgctgtggaagtttctatcctgtatatataaagcacaaaatacgttagtggttgtagggaaaagcgcggtagtgctcacagcgtgttaacaacttgcaacatttgttgaagaacagatgattgcacttctcatcatttgatgttctcatcaccgtgtcttctcccttctcatactgctaggaatttgtgcttggcttgtaacattgcttctacctgacttctgttttcgggtctgagaggacatttcttagataataggtcattgaaattagttagctgaaggtgacatatggataggtcttcaggtgagaaaaacattctgatttacatagtgatgtattcttaatcactgtttttgcaaggtttctctttgtcagtatttgtttcaaaatatattaatgaacttatcatttctgattactgatttatttaaccttgtaaggactgtctccatgtcagttgtcacatttttcttggtgcctagcacaaagtaggtacccagtcaacatttgtttaattaaactgattgtattctgagcatgtgccatttctgcatacccgggatatctggcttctcgagatttttcatctatgatttgaatcaatattacatgttatgtttacttgtgtgacacaggatggtcccaacttagaaatatttgtctcagaaggggctctgtgctcagtcactggaaacctggactgaattttaatttaaggggaaagtcaattttaggttcgtttggattctagttcatagcattacagttttgttcttcagtttccacagtgtaaatgaaataacacatatagcagcaaggagcagtgagccagtcatacgggtgcagtacagtacttaaccaaaacaagcaaaccataccgttaaattttgaaccaggtaggtttgggttttctcctagtttatagacaggtatttattcatggaaggcaagttggatggagattgcagaaaacctaaaagagaggaatatattttgtgtttttggactttaacagcactaactttgatttccttttcctgtgacatacttacctctgatttttgctcacactcagcctcactgttctatagttttggagtgtttcctgcaaatcacagtgtctttctgctatacattgggataagaaaatatatacatgaattagatctggtaatggcaggccttgagaatagagcaaagggtaaaacccaaatatgtcagcatccaagcccacataagtgtgacagttctccagactgtgttaaagtttcctgattgtattaggacatattgtattgctataaagaaatgcctgagtccacgtaatttgtaagaaaatgggtttaaatggctcacaattctgtaggctatacagaaagcaagccactaaggcgtgtggcttgtgtgcctacagagcaccaggatgagctccctttgagccctggctgaagcaggagcagtggggatgaggggagcagtgtcctgaggcagctgggccctgggcgtggctcaggaaaccacccttctcttctaggcccctgggcctgtgatgagagaggctgccttggagacttctgaaatacctgtgagacctttcccccactgttttggtgtcagcacttccctcctttttagatatgcaaatttctctggcaagtggttgctccacagcctgcttgaattcctctcctgaaaaagctttttcgttctctgccacatggccaggcagcatatttcctaaacttttttgctctaccttccctttaaatataacttccaactttgtcatttctttgcttctgcatctgagcgtagtctgttagaagaagccaggttacacatagcatgctttgctgcttagaaatttgttctgctagataacctaaaggattaccctgaagttctaacttccacagaaccctagggcatgaacagaatgcagccaagttctttgctaagaaataacatgtgtgacctttcctccagttctcagtttctcatttccatgtgagaccttgttggcctggacttcaccatccatatcactatcagcattttgatcacaaccatttaactgttctctaggaagctgcaacttttctctcatcttcctgtgttcttctgagccctccaaactcttccaacctctgcctgttacccaattccaaagtcacttccatattttcaggtatccttgtagcaacacgccacttctggtaccaattttctgtattaggccgtgcttgcattgccttaaagaaatggctgagtctagataatttagaagaacaacggtttaattggctcacatttctgcaggttatacaggaagcatagtggcagctgcttcgggggagtcctcaagaggcttacaatcacggtggacgggtaagcaggagcaggcatgtaacatggcaaaagcatgagccagagagagagttggggggaggtaccatgcacttttaaaccaccagctctcatgtgaactcagagcaagagctcactgatcaccaagtggaggatggcccaagcgaaggatctgcccccatgatcagtatacctcccaccaagccctgcctccaacattgagggctacaattcagcatgagatttgggagggaataaatatataaactctattactgaccaatgcagtttctcctcataaacactgacctgatgcagggtctttttggcgtagagggggcatggagattagttcattctgattggtcattaccaaaggctgggcaagggcatgtggtaagggatgcaggagtgcctgtggaatatagaatggtgaatgaggctgagcagggcaggggtcccagggcccagagagaagtgcctggcccaccatccacctgggaacatgctaggggtttgctaacggatggccaaggtggctgggaagaaaccaggaggcaggccagggtaggagggcagccacactcatcccatgagtctagtcggcagcccagggtccttggccagctcaatgacttatctcctttaagggacttgattgtctcaggcatgcctacagagtttccaccgccagccagagagccaaaatgtttcccaagccaatcccatgagatgcctcacttctagtgagccacccccagcccccacaacagcctccagtcagggcccacctgaagcctcccttttccaactgtaaagctttcccagctccccaacctgcatttgagcttctgccaaaggcaagtgctggtgtccaactttcttgctatgcaatctctgaatgaatagcctctgctcgttctcatttgaagagattttcatttaccttcacacatggacagttatctttataacttaactcagtgcctcctcatttaccagaatctggtcttttcgtgggcttctcttgtcttcccgcaaatgtaataatgccttcctatgacactaggatgctttgagcagatagactcttccagtccatgcaaagaggtggtgtggtttggcctcactcctcactgcaggcttaggccagctcccccttgcagccacgtgcgtggacgtgactctgggagtgaagtgaaatagcgctgccgacaggatctgggctctgtgctgtgtgccaggagcatagagagcaatgtgaaacagctgttgcccacagtgacctttcagaacagtttttgctgttagggttctagggattactaagtaagcttggctggttaagaaggtcaaaaaaagcccaaggcaaccccagctgtctgaactagccatttcagaaggctgaaacctttctgctgtgaagggctggatttcctagcttatgtagttcaaagctcagtttttaggattgctgtgctacttactgaccgaaagttggtttttggaaattgacccttattttccaatatctttcataaagctggaaatgctttcactagaagaaaaggaggatcttatgttagaacatatatatatagcgatgtaaaagtttcagtagttactctcaaaagaaggtcaccaaggacaactgtgatttcatatgtaatgattccagcctagaaaatgtttttttcttgatttccatttaagagagttgagccaattaactaatccttgcatatggtatgttccattaagttgtcagtgtttttattccaagatgcatgtttctttaaaagagctagcttattagggcatgtcttcataagcactttaccctggccatgtccgtgagaatgctgtgcataactttcattgaattctacatctcatttgatgcaggcctaattaactattattaactgagaactccaatttattggaatcatttgctgcagttaacttgagaaagaatggggcatgtttaagggtccttatttttaaatctctctttcattacaaacacattaacataagtctgatttgggggtgacagaaggaaataggaaaataaatgtaactaaaccataatggggtacaatataaaggaaagtaagtactgggatgaatatcatcatagattgtttattctttaatttgtactaatttgtacatttgtatatgtacaattaagcacttcttagttaagattgatatatttttaaaatcacaactttatagagcacaagtcttacatgaaaacataatgccaggtcagtggccctccacttgagcacacattcaaatcactgagagggctctgtaaaacacacattgctaggtcccaccccagcttctgattctgtagatctggggtagggcctgctgtgtggtttgaacgtttgttctctctgaaactcatgttgaaacttaatccccaatgtggcagtattgagaggtgtggggtctctaagaggtgttgggtcatgaaggctctgccctcatgaatggaccctttcgttcatggattaatagattagtgagttgttggatgaatgcgttatcaaaggagtgggactgctggctttgtaagaagaggaggaggctgggcactgtggctcacacctgtaatcccaggactttgggaggccgaggcaggtggatcatgaggtcaggagtttgggaccagcctggccaacatagtgaaaccccatctctactaaaccccatctctacaaaaaattagccaggcatggtggtgtgcacttgtaatcccagctactcgggaggctgaggcaggagaattgcatgaacctgggatgcagaggtttcagtgagctgagatcacgcctttgcactccagccctggctacagtgcgagactccgtctcaaagagagaaaaaagaaaaaaagaaaaagagagagagagagagagacctgagctagcatactcagccccctcaagatgtgatgctctgtgctgcctcgggactccatggagtccccaccagcaagaaggccctcccaaaatgtgtcccctcgacgttggacttctcagtccccataactgtaagaaatgaatgtcttcatacattaccacgttttaggcattctgttaataagcagcagaaaatggaataagacagagtccaagaatatgtagttggacagcatctcacttcatactgatgctgctggtccggggacctcatttcgagaatcaaggtgtttaggaaacaagcagtagaatatcttagatgaacaatactagtggtgtacattttaaataaattgaacaattactgattagctactatgtactgtcaaaatggttcagaaaaatgacaccaccacttctatcaaaatgtactggatgttgggttttttaattaaagcaacttcactttaaaatgtggttttacacacattcaaaacactgctgaccctctttcctcagctgccattaaggtgcttagcccttccgaggaagctaaggccttgtgaagctgtcactcattgggtgactagcaccctgcccggtggcaccagccccgcactcgcccacaccatggcctccatctttgtttgagctcacttgcatctactcggccctcattctacagtgcagtgtggtgaccatcacataagaccgtcgccctcattaaagcagctagtgtaaatggtgaaacttttgggcctgacctgtttgcaagggcctggccagtgtcaacatcgggagcctttttggtagcatgggggctggtggacctgtacctacaggcagttctgcccctgtaccatttccccagccagagtcaacattgggaacctcctctgcagcagcatgggggctgctggacctgtacctgtaggcagtcctgcccctccactgctgccccagctgagcagaaggaagtgcaagcaaggaaagaagcatctgagggatctacttaggacacgggctttaatctttttgaagaaacctcttttgtaacatgatcagtgaaaagctgaactcttggctgggcaccgtggctcacacctgtaatcccagcactttgggagtccatagtgggaggatcactccaggccaggagttcaagactagcctgggcaacatagggagaccgtgtctctacaaaaaaaattaaaaatcagcctggtgtggtggcgcacacctgtagccccagctacttgggaggctgaggcgggaggatcacttgagcccggggggtcagggctgcagtgggatgtgatcaccctactatactcaggtgagaccttgtctcaaaaagaaaagctgaactcttaaaacgtgcacacacacagtcagctaacatcttcataactgtcagattgtgacaatttgattctaactcaagatcagcctttcttgtagtttattttgtgtctttaaggaactagcctatctaacacaaaacactggctttaagttttttctcttttttgtaattgggaataaaaattatgctcaagatacatcaagattagttttggagaaaaaaagcattaagtagattcagttgtgcaagatgcacaaagtgtaacttcataagtaagcggtcacaaactcgggttcataatccgttacccaaaatctatggagccagatgtatttaaatataggttatttttaaaaggtattagaattcatatgttccatgacacagaacgttctcaggcagcacccgtaatcaaatccattagtatttctatagggaagtgcttgaagagtcgcactaagtatgataaatgtggaccattaaaaccacctcatgctagcccagtacagattttgcagtgttttcagaagcttttgggttatggaattgggaacagaggctgtgtttgttcctctgcagccccggcaattaagaagtgtttgtgaagctggtttaatgtgcctagcaggtgtgatgtattggtgaattccaaataattgatagttttgtttgcttttttttttttttaagcaaaatatttggtaggaggcactttagtttctcaagttcaatagctgtttgctcttactggagcgttgctgttaagggagacagcagatcttgtcaattccctataactcacggttaacaaaagcattccctaatgattccatatgttgatgctcagaggtaattctgggccaagcgctcagagcacaacacagattatttcactccatggacgcaaccgcctagaaggtgtgtggcatgactacatcattaggatcccattttagaggtgtgcaagccaaggtccagcaggcttataagacctgcagtatgaataggatcctcattttataggtgctttacccaaggctgctagcttccagagtttccggctagaaagctgcagagttggggtttcccgaaagaccaccaggctttagaggacctggcttcactgcctgggctgcctgccacctcccacacctaaagcatctccccccgccccaccccacccccagctttaaggccacccccgctctgcaggtcagcggctattaaatacatttctccaataaacatcgtatgttagacaggctaagaaacttgtcccagggcgtgcagctgagctgggagttttctgcaggtctcttgggtccccaaagccctaggtcttgtatgaacatgagggtaggagcaaaatcaggccttcccatgtgtattaatgttactctgttctcacactgctataaagaacttccctgagactgggtattctgtagaggaaagaggtttaattgacccacagttccacatggctggggaggcctcgggaaacttacagtcatggcagaaggggatggcaaggcagcaggagaaaggggcaaaggaggcacttgcaaacacttataaaaccttcagatctcactatcacgagaacagcatgggggaaaccaccccaacgatccaatcacctccctccctccacacttggggattacagttcgagattgtcaggcctctgagcccaagctaagccatcatatcccctgtgacctgcacgtatacatccagatggcctgaagcaactgaaaaaccacaaagtgaaaatagccacttcctgccttaatggatgacactccaccattgtgatttgttcctgccccaccctaactgattgaccttgtgacactccttctcctggacaatgagtctcagaagctcccccactgagcaccttgtgacccccacccctgcccgcaagagaacaaccccctttaactgtaattttccactacctacccaaatcctataaaactgccgcacccctatctccctttgctgactcctttttcggactcagtctgcctgtacccaggtgattaaaaagctttattgctcacacaaagcctgtttggtggtctcttcacagggctgcatgtaacagatgagatttaggtggggacacagccaaaccgtatcaccatatgtgcttcttaatgacagttggctcaaggtgttttccccgtaaataacgcaactcacagttataaaattgaagataggtccccatttgcatggtaagcaggtacagctccctgagagagcagttggggagaaaccctcgctttttatatctttgttgggtaaaacatcaaccactgtgcctcaggggcggacttagtgagcatttaagatacattttcagttataaaatgttacttgatttgcagcaattacccagtctccgccttagacagaaacttagaggccatcggcctagacttcctccaggcacagggcttccataacagttgaattaatttaagccttaatgcctcccataagcccccgggaactcaggctgcctctgaggatgaaaacacccgccagtctttgggccccagcctggggcaccctgtagcttcttcagagcttccacctccctgccaggctctccccctccccatgctgcccttgcagctactacagaagctgctctcaacatgccacacagattccagctgggaggaggggagtggtcacagtcacaagggatattttctaattctcctaaggagggtagtagtgtatgtggccctagcatgttaaaaacaatatgacctttcctggtaaaaaggaccctgaagcaatgttaaagctgcaagcttgttagtaagcagggaagaatatccatctgatggccctagtgcaagtgttttatgctcctttattttatttcagcatttttcctttcacaacgctgtccctttaagtgtgccatcatcaacagctgtagttatcatttgatctgaggagtttaattacttgtttagatcctttcttattccacggatttaggattattttatctaaatggtgaggaaaagtgtctgtctgcacagtcccctacagatttataatcccacagttctgtgtcttttaaattaaaagctccatgacattttaagctttaaataaacactgttggaagcatttttagaggatacagctgttttcctgcctttgtccacactcctttcttcctgttcgcacactcgccttagtcagagttccacggagcacctccatcgtcctgcctgccctctgttctgttccttcactcggcttttcaaacccgacagtggtgtctcacttgttcgatgcctgcagtttccttttgtcaatcttcctctctcaactactagaacaaacactcaaggaagtaaaatgtgccgcctcactgccaatccgtccatctccttgccctgagagccttggctctttctccccctcacagagaagaagaaaataaaaggagcgctcatgcctgggtaaccctcccttagaggaggcttttcaccactcagctgttgaggaggagggtgggccagcccttccttctgttctgcagcttctgtagggagaccgagtgcaggatggaatccaggaagccttgagttactcaggttgttacttgaacttcgacttctacaaaccagcccagacttttctaagagtcctgtcttttgtactctcctaaagggctttgagccctccattcagggattgggccttcacagtctgcagtatccagaacggtggaggttctgaggtttgtttggtgtgttttacagcaaacttaataaaatacagcttgtggccaggcgcagaggctcatgccttaatcccaacactgggagaccgaggctggagaatcacttgaggccaccagtttgagaccagcctgggccacagggcaaggcatcccatgtctacaaacaaaaaaataaatgaaaaaaatacagcttgtggtagaaaagcaaggagaaaaatattatagtgctgaaaatgaaatggcacctgcagatgcagctgtgggtggatttgccaagaaaagcagagaaagaacagaggagggctcttcttgttgctgttagcagtcaaaaccagagtatccatcaggaggtggagaagccaggggtcttctgcagggaagagggccacagagggggtcagtgcacagggggaggaaggaagatggggagtgcagggcaggggccacccaaaagcccaaggaagagcccagtccacaataaccagcctctcctggtctccagtgtccacagggtggactgggcccagcctcagccccatcccaggaggaagagccagagagttccccaggcaagtgcagtgagccctgggaccaggagagaagcgtgcacagaggcaaagtccacaccgtggcagccaaagcagtcagtgagcccagtcctctgagtataaggcggcaagagccctagccgatgctgcaggtgcagtcaagagatgcagtttggatgctgctgaaggaacatgatacagggccacacggaaaactttttctcaagacagcagcactctgcccttggttcattcaggaattttgcatataggtggtggatatgattgactgcccaggccttgtgtctacacagatgaccattcaccttctgtgagaaagatgcaggagacaaagcacaggtggccctaccattgcagcggctcacaagagaccttcccggcctcctccatgtgtgacacagcgaatcctgccgtgtggtgcaggcagctctctgcatgcctatctgggaggagcagatattttggagttaaaacctgccctaactctcttttttttgaagacataatttcgctcttgttgcccaggctggagtgcagtggcacgatcttggctcactgcaacctccgcctcttgggttcaagtgattctcctgccccagcctcctgagtagctgggattacagtcacatgccaccatgcccagctagttttttgtatttttaatacagacggggttttgccatgttgcccaggctggtcttgaactactgagctcgggcagtcctcctgccttgacctcccaaagtgctgggattataggcgtgagccaccgcgcccgccccataactctcctttagtcgcagttcataccttgccaactttcaaaacacatcgaggcaattacagacaagcatgcatacctatgtgcatgtaagcatgtgaacatacataggagtatgaagacttacatgcctcttggatacacatagccttctctgtgcgtacacgttacttccctcagtgtgtcctgggtctcccagatactatcttacagggaaaaaaactagtatttagggatgattattgtatttgtttatgtcattgtgggacagttaaaggccattgagatcgcctgctcttttcaggacttcttgttgggtccagctgtacagattcaaggtagactacgtcctgctaatgctgctccacaccctgtgggaaggtttcagtgctaaatctagaacaggtggtcagtctcctaactgaatttgaatccagatttttgtcagatgcatccgtgtgtcttcttcttaaatcagttgtgaacagggctatttccagcctctcgggttcagggactgcctctgtgccaccgcagactggaagacaaggactctgcccaggccttgggatagccttctgccttcactggggccttggggggattgtcatcaggcaacactcagctccatggagcttacctgggtttgaaattccacttggtagacattcctctgtgttgaagtatttctttttttttggcataatgcctcctagcaggtcagttagttggttcttcagtaaagtaatctttctaggcccacactggagacagagtggggaagacagctagtgtgtaacaagcatgctctaggaggctggcactagaatgttacttatgtgccctgaaatattcattctgtaaagtaggattatttcactgtagtagcatcctcagtagtattcttattggtaatatgagtgcaattgatactatgtatatattaaatatacatacagaaaaaacacatgaatagaaatgggtgtgagccagtactagttattatattgtatgtagtgtaatctagcgtatattagtggtactggtactattattagcagtattcctgttcatcttgtgtaagcgtgaggaaagcaggcacctgcaggctcactatgtttctgaggctgtgccctgagtaagtgccgagccgggagttaattctcaggtcagctttcaccatcccgtgacagcctgtgcattaaatgttctgttcttacctgggagcttcacagcagcatcctggccaggcatggtggggattcatcccactgggcagtggaaatgtccttaatactagtgggccatgcagtggactttgtcagctggtgctggcttccatgttgttgggaacaccgagtaatgatgccttgtgctatcgaatggaattgaccattccaaggatatatttagattcaaatacgtacatttaaacagaaaacacaataatacagatttcatttctctcctgagttctgaatttccagatcacaactccagacataactccagcagccttgagaggaggctgcccatagtataatttagtgagaatgacctgcaagcctttctcctgttcacttaggtctccacaaaagcctttgttcatggaatgagacctacacagtgtatgtttatgcggacctgatacaaacttactgttcatacagtatgcactctaaaaatctcttttttttttcctgcagatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggtgcggttgcctcgctgtttgcagggttatgtttgtgactattagcaatggttttgtaaatcacctttaaagtctagcatagggcatgcttagtttgtcctcttttcttcagtatctaaactaagtccctcctggtgctcctgaaagagtttggctgatgctgtgggatgctgtgattcaattttctctttaaaagcttcttaaaataatatgcgttagtttcagtgatttctgggttccaaaaacatttgagtattgtttatattactatatataaagattatgttaatgacagaatgtcttcaaagtttaccttaatagatggttttgcctttttcttttcaaaatcagatataggattaatatttcagcaactattcaaactttaacaaattgataagcagctaaatctccccaaagacgcttaattaaaaaaaaaaaaaagtaaaaagtcgaattcatttttagcctgtgtgtttatatgccgttcagccctttctttacttgtatccagttttcttcggaaaggaaaaacaactttgttccctccgtgcttgttaactgacattcaatcagaacgggcttgcctgacgctccttgttcaagaatattctagattacagaccttgaaaatagactatttgaagatttttctgggatatacaggatgaatactctgtctttagaattcctggtgctaggggagaaaaaaaacagcagttatgtgagtaatcttggatttaaaatgatattaatatgaagcatacctacttttgaaatgtatgttattatttatatttatacatatgtccaaacatgtggattgaccattcctgggcagcacacacacacatgcaaacacacaccctttgtaatcactctgtctgcatccactgaaaatggtagtgtttgtgaatctcaggcatgggtacgagcatcgtgatactcagttctctgcatctagtgtctttctgcaccatttgcacatgaagttaccttgataagtcttggtgaaacacatccatacagttactatatacaaatttaattgtggtaggacacagacacacacactaaaatttaccattttacctattttaaagtgggcagttcagtagtgataagtctattcatgttgctatacaattgacctccagaactttttcatcttgcaaatctgaaacttcgtgctcattgaacaagtccccatttcgccctgccctcaacccctggcagccaccattctactttctgtttctaagatttttactactctccatacctcaaataaggagaattatgtagtatttatctttttttgattggtttatttcacttagcataatgccctcaaggttcatccatgttagagcatgtgataggattttcctcctttttaaggctgaacaatattctatggtatgttagaccacattttgtttattcatagttcatttgttgagggacatttgggtggcatccacaccttggctgttcttgtgaataatgcttatataaacatgagtgtacaaatatctctttgagatcctgctttctagtctcttgggatatacccagaagtggaattgctggatcccatggtaattttattattaatttttgagtgaccaccatattgttttccatagttgttacaccattgtatattcccaccaaaaatctataagggttccaattactccacattctcatcaactcttgccatttcctggatttttttgatagtagtcatcctaatgggtgtgagttgatatctctttatggttttgatttgcatatctgatgattggggatggcaagaatcttttcatttgcttgttggccatttctgtattatctttgaagaaatgtctgtgcacatcctttgcttatttttgatttttgtgtttttgtttttatgttgtaggagttccttatgtattttgaatgttaaactgttatcagacatatgacttatgaccattttctcccattctggctcccttttcgcttagttgttggtgtgcataagtttttgattagatgaatttgacatatgtcatctcatttgtctaattttgctcttgttacctgtgcttttggtgtcatagccaagaaatgattgccaattccaatttcatgaaactttaatttatgttttcttcctggagttttagttttaggtcttacattcaggactttaatccatattgagttaattcttgtgtatggtgttaattagaatctagcttcattcttttgtacgtggatgtccagttttcccaacactgtttgttgaagagacttatcttttccccattgagtagtcttggctggctcgttgaagatcgtttgacaaatacgtgagagtgtatttctgggctatctattctattctattagtatgtaggccagtactgcactgttttgatgaatgtagctttgtaatatgtttggaaatcaggacatgtgagacctccgattttgttctttttcaagattgttatggctatttgggatcccttgagattttttatgaattttaggatgtatttctctgtttctgctcaaaatgccattgggattttgatagggattgcattgaatctgtaggattgctttgcatgctatgaatgtcttaatattaagtcttcccatccatgggcataagatgtctttcaatttatttgtgtctttctttcagtagtgttttgttttgtagtttcagtttataggtccttcacttctcttatttctaggtattttattcttttgatgctattataaatgggattgtttataattttctgttcaacttgttcattgttagtatattaaaatgcaactgatttttgtttgatgtgtattctacaactttgctgaattggcttattggttctaacaattgggtttttttttttaatatgttgaattgtagtgatttctatatatatgatcatgtaatctgtgaacaaagataattttgtttcttcctttccagtttggatgccttttgttgtgttttcttgcctaattgcctggctgagacttccattattatactgtctagtagtgacaagagtgtgtatccttgttgtgttcctgaacttagaagaaaagctttagtcttcattgagaatgatattagctgtgaacttctcatatatggcctttaatatgttgaggtagttttttttttctatccttaatttgactgtttttaatcgtgaaagggtgttggagcttttcaaatgcgttttctttctgcatcaattgcggtttttgtttttttttttttttttggttccttattctgtaaatgtggtttcatatgttgaaccatttttgcattccaggaataaacttcacttgttcatgtatatgatcctttcaatttgctgtggaattgtttgctaatatcttatttagactttttaacctgtgttcatcagggatattgatctgtattttgtttttcatatagtgttttccatgtttggtagggttctccagtgaagccatctggtcctgggcttttctttgtggggaggttttcttttattactgattcagtctccttactacttacagatctgttcagattttctatgtcttcattttttcccccttctcaaaatcatcagggattctctgtcttcatgattcagtttgggtaggttgtgtgtttctaggaattcttttatttcttttaggttatccaatttgttgtcaaaggatatgccaacaaatagtattctcctttatttttgtggcattggttgtagtgttgccccttgcatttctgattttagtcatatgagtgtttttgttttttgtttttttagttaatgtagctaaggtttgtccataaagttactctgtgactgagtgtcttttgtgactttacaaagcactcatgatgtatgaggcatgcacgtgtcttatttcttccatatctacccaagcctttcacatggttttctttctacactttttgttctatattctaagatatacttgaaatatgttctactgcaattcttaaaaagaaaaaaatgttttatctagatagtctggtagtttggctggagtgctagtgaatctgttttatggaatctacttggtgatcccatcaacgtagtgtcttcatttggctttctaagcgagcaggtatcagattaagtaaggtgccaatcatagaaactcatagaaggtgaacaaccagccaggagctagttcttcaaagatagttcagtcctatagaacttatctagatggctctcttttctttctttactactttttgacctctttaacttttttttttttgacttgacaaatcatgttttttggcatatgatttgtgtgtgcgcgtgtgtgtgcacacgcatatacttattttaacttttactagccgctcagttgcgagtagggacttcaatactgaaagtctctctttgaaaatgatcatatctacatgccatatacacaattagctgtgctttgacagagcagagcatgcagaagacttgaagagtatacagaaatgcacaaggtaatgctggagagaagaaacttaaaatcatgctgggatgctggctcagatgatgtgcagggacagtggtcagatgatgtgccgctttggtattctgaaacgagttaggtgtaggataagacaaaattattagaaatcatacttaacctgaagggaaagcaagccagaggaggacaatgttggactgaatgtatagagcagaaagacaggccgtgcctaattccaatccagaaatgtgttcttccttagggtttctgctcaatattataccagtcacaaaaatgaagataaaatagctcttctgtcctgaaagaacattcttggagacctagtttccattcattttgcactcctcccatctcctcttttatctgcgccaaacctgaattcccctcggaaggtgaccttatagcgtcattgctctggtgactagattcagagaaacttgctgctgtagtctttcttctaggtgttcattttgctcacttactactttgttcctgttcttaaggtgtagatgataatataacccttgactttgtttcttttccttctggaagtattttctggtagggtatgttaggttgtggaaatgaccttgagctctttagaaaagaaagctgtctgtagggagggctttttaattcaacgtcattctttttcacatgctttcagagcgacagccgaacccaaggaggtatttagcaagttaaattgccggagtgaatggtagattaccaggggaagcagcccctgatcatgctgcaggggctgtgtgctgtgattaggctgcaggagggtgtctgcttgggccagtcaccagggaatcagcttgattatgctgcagggacatgactacctgggccaataaccagggaatcagcttgattattcttgggggtgtgtctgtcttggccaatcaccgaggaatcagtccaattatgctgcaggggtgtgtctgccttggtcagtcaccaggggatcagcctgattatgctgttggtgggtgggtggtagggggccggggagggggacgggatggggtgaggtgggggacggatgggtgtctgccttggccagtcaccagggaatcagcctgattatgctgcgggagtgtgtctacctagaccaataaccagggaatcagcctgattatgctgcagggtgtgtctgccttggccaatcaccagggcatcagcctgagtatgatgtgggggcatgtctgcctgggccagtcaccaaggaatcagccccctgattatggtgcagaggtgtatctttggcttgatcatggtatagaagtgtatctttgccctgattatgaagcagaggtgagtctgcctggtcatggtataggagggctctttgcctgggccagtctagccactaagaagacaaggtggacctaatggacttgaaagacgaggcagagtggccctgatgcactcgcacatcagctgcctatttgctatcatcacatttctggaaggccctctctatgaaaaggtgggtgggcctacgatgtcctcagtgggaaatccttttgagcagttagttctgtaggcatttcttatatggcttcatggttccatgtaaactgtcggtcagccaaggcttaaattattttaggaaaataaacttttaaattgtggcacaaattttagaggaaaaaatgcatgtggttcatctcttgtgagttttctagggattttaaaaataggtaccgtattacaactggaaatgtatgtcacattacttaaaaaaaatcttcacttaggatatcagaaaatcttgtttaaaacatagcctatgctggttacctccattgtatcttgaacaaatcctttcagtaatgaattccttgggacagatgaaattctacatttcattataactcagcgagggtaatttggattcaaagaccaataagaagaaagttggtgccttttattgtgtagaatcccccaggagttttttctgttgtcccagctctctgctttcccatgtgttttcactaagcatgagattcctagaggaagagcccagggcatggtatctgggccagtagaaaggacagcctgccttgcagatgtgctcctcagcctggccggctctcccctgcatctcttggccggctctcccctgcatctcttggccggctctcccctgcatctcttggccggctctcccctgcatctcttggccggctctcccctgcatctcttggcccttaccgcctgcaccaggctctctggtgttaacttcctgccctctactttccccctctcagaccatctggagcagaaaaagcaaactagaaccctggccccctggagagtcgtggatgggtgccagagctccccttaggtggctgaggggagggagcaggtgtggcctgtgtggtagaaaggatgggtccagtcacagctctgcagcggagcactcctcctgctgtccagccccagtccccttaggacagtaggagtactgactgacatgcccactgtggggtactatgatctgaatgtgtcccccaaatctagtgttgaaacttaattgccagtgtgataggattaggatatggggccttcaggaggtgattaagtcctgaaggtggagcctcatggatgggattagggctgtcatgaaaggactagagggtaaggcctgctcttccattcctctgtcacctgaggatacagcattcctcccctctggagggtacagcaacaaggtaccatcttgaagcaaggagcagtcctctgcagagacagacctgctgatgccttgatcttggacttcccagcctccagaggtgtgagaaatacatttctgttctttacaagtgtccagtcccagatattttgttatagcagcacaaacagactaacacctggggcattgctgtaagacaaccttggagcatgtgtggttacacctggcccagtgagtggctcctagcaggcacttgtgtcatctcctaacccaggaggatccagtcctcaccctgaatcccaccttgaggagttagtaaggtcgttctccatccctgctcggcttcgttgaaaagcacacaccagccatgacatggacaccatgcacatgacatgggctctagtcctctttctgtccaagctgtgtcttcctcttgtaagtaagccttcctcctcaggctgacttaggtaattatggttgtttccatccttctactttttttctttttaattttgttcttggtttattttcttacaccgttgtcttcctggctgttaacagatacacccccaccctttccattaggagcatctggcaggaaggcactcatcctctggaagtcagctaacaacttgcctctctttcctctgaactctcgtgcatgtagtgctgagtgagtgctcggggggacacaggagaaaggtctctttcctaatggagtatgtcatccatttggggagaggggacaggcatatctgcagcatccaagtgaaaacccgtggtaggatattgttgcacagcaaaatgagaaattcaggaaagagatgccaaagggatgtagaattaagtaaagcaagatattcttggagtagtggccgctcctggggtagggggtgacctcgggggagtccacaagaacagaagagatacagatgggagaagccatttcaaaaggaaaacagcacctgtggaggattccagtcagccagtgagtttgcttctatacagcatgaagccaagcttctcatggctcacaagcttcagagaggaattgtggctctatgagttgagcttcttattccccagctcatctgtttgctttctggatagggagaaccattgggatttttaaaaggaggcgtgtcagaatgcaacctgcacttggggagaatcctctgggtttgtggcacacaacgcctgcagcctagaagagatgggccagaggaaggccagggtgatggtaaaagacatgcaccccccttgactgggccatgaggtgtccagacggaacattctttggagtgtgtgtgtgagggtttttctggaggagattagcatttgaattggtggattcagtaaaggagattttcctttccagtgtgtctcatgaaacacatcatttttcgcatcatgaaatttgtcactagaggaatgaaaggatgatcttaagtagggagaatatcccttcaggataaaaaaaaaaccacaatcatgatatgcttttttttccattggagacacagtctcattctgtcacccaggctgcagtgcagtggtgctatcatagttcactgcagcctcgaactgctgggctgaagcaatgctttcacctcagcttctggcgtggctaggactgcaattatatgccaccacacccactaaggtttttttctttttttctttgtagagacagagtcttgatatgttgcccagtctggtctcaaaagttctacctcaagcagtcctccttcctcagcctcccaaagtgctgggattacagacatgagccaccacactgggccttttttttttctttaattacacaaattacacttgtttcacacggtacaaaaatgtatagcattaaaattggaagcccttctaactcccactctcctactccctggagataaccgttactcagtgtttaactatttaaggtacctcatttcaccccttgtcttatgatgcctatgtgtttgtgtgtagacccacaggcacacagagatatgctcacctacactcacctacatgcacctttatggaatgaggccgctgacataattcaccaagatccagagcaagtacctatagattaatgggacagaaatcccaaatgctttaattaaattgttagtcaattttttttttttggaagtaggtctaacaaaagtgaggacatctttttcctagctcttaaatgaattgtcactgtggatccctgaaatgctggacatcccttgggatgggaaggcactcagagcacttcctgcctgggagcacttacaaggttgcattagtccatgcagtgctaacatgattcttgtgtcaaggacagcttccagaagacctcagcaggcaagctgtgctgctttggtttgtcctccttagtgatggaggtattgtgctgtccacacccttacagtcctgtagattttcatatgtccacactgacacagtcacatctcttgttccgtctcctgtgccagtggcttcagggccagctgttacctttaggaaccaggaagcacccaggtcagcttccaggccaagaaggaagccagcagaagaattatagcccttggtttataggccgctctgataatccattactttctaagtctgggcagcaggcctcagtgttgaggggcagtataacacctaggtggcaggagcctcacagagaagagggacccatttgtgtacatggcacaaactgtgtctccacctgcctgtcattcctggcctatcctcagccagatttcacagctcggtgctggggctatgccagttagatctacccagggtgttggggcttcgagtctcattaagatggacagtgcctaggaaccccagaacacattctctgtgccatgttcaggaaacatgcacctgaagggtattcatgccacttttccttgttggtgtccactatggtcgtgttggctcacaagcattgaggactcactgcatgtcatgctctcagtgctttcactcgtgggggtatgtgtcagcctcctgccgccgctaagaagcagtcgctcttagcacagggaatggcaggtaggactgcaggggtcaagttacttgtccaaaagcttgcagcctctgattatggaggctggcctcgaacccaggtggggaatgaagagtccatagctcttagccacggcgctctactgccccagatgatgtggcggtgaccttctgttgaggtagacaacatcagagtacaaaggggagaagatgtgttctgacacgggtcacagggctgagccctttaaggccatatataacccatgtggagaagtccccagtgctcggggactctgcctcgtccagctccgtttctggtggtggtctcgatttggggcactcagctgattctcagtcgctggagaggctctgctggcaaagctggacctcagggatttttacttaggcagattgtactccttggataacagcacaattaaaggacacacacaacaagcgaaaaggaaaattgtacgctgacagtcatggtaacacattcaacttacgctgtgttccttttccgtttaacaaatcgaattagccccatgttcaggaaaatttatgatcgtagggaggaagaagcccatttgccagtcaaatgtaaatgtaaatgaaaattcttaccccccttttcctttaaagtatcagcttattggccaggcgcggtggctcatgcctgtaatcccagcactttgggaggtcgagacgggcggatcacgaggtcaggagatcgatcgagaccatcctggctaacacggtgaaaccccgtctctactaaaaatacaaaaaattagccgggtgtggtggcaggcgcctgtagtcccagctacttgggaggctgaggcaggagaaaggcgtgaacccgcggggcggagcttgcagtgagccaagatcacgccactgcactccagcctgggcaatggagcgagactccgtctcaaaaaaaaaaaaaaaaaaaaatcagcttattcaatgatgtatatggacattattcctcttttctgaatatagtgactttcataggcagctaattgccttgttatttagtaaattgtaatgaagacatcctagactaaggagaataagatacaaatctttgcttctgatcatcctagatattacctcactgcgcatgtggagatgtttctcaaagaattacaatttatattttttgctttgtttgtttgacacaggatctcactctattgccaaggctggagtgtagtggtgcagtcatggctcactgcagccttgacctccctggctcaagtgatccccccaaacccaagcgatcctcccaccttggcctctcaagtagctgacacttcagatgtgtgccaccatgcccagctaattatttctttcttttctgtagagacagggccctactatattgttcaggctggtctcaaactcctgggctcaagtgatcctcctgcctcagcctcccaaagtgctaggattacaggaatgggccaccacacctggcccagtttctgtttctaaatgtgtggtggttctcctgtggatttctaagtctttaggagtataggataatgaacaagagaaatccttacctcaaggacctctcgattcaaaggagaggaaatgagtagataaatgaccacaatgggttgaatcaagtcactgtccctccgggaggggtgtgctcacagcataggacagcactgtggagctgcacagacaggctttgaggggtgttaggtgccagcactctctgcacactgcagtcaggacgagggagtggggagggcagtgacttttaggtgagcatccaggtgtagagcgctgccagcttgccccgagtcccagcacccgctcacagcctcctggcgccagtagtagaaatggttgcacaaagcaaccaatgagaaatactttcagttttccatctgccacacagagaaggtaggagaggcttgcaaagggaatagcatccagtccttttgttacttgggcatggaaagttggggttttccttttgattgagttctgggaagtcagcatgaatcagctttcggttccctgcctccagaccctattctcctgcttcagtatgatgtccctagagttgtcaaatccatagaggcagaaagtagaattgtgattgccaggggctgggggagggggatggaggttttagcatttaatggggacagagtttcaccttggggagatgaacacgttctggacatggatggtggtgatggctgtacaacaatgtgaatgtactgaatgccacagaattgtacactgagaaatcattaaaacagtacattttatattgtaggtgttttaccacatacaacaatagttattctttttcaaatggcaagaagccattcaaggattttggagttgtgttttggcaaagctcctgtgcagatgaggtagaaagcctgtagtgagtagacacaaatgtggtttttcacataagtgttgtggataagtgcatctccttatccccaacagaatcatacactcttatcagggaagacaggtgtctctcatacgccccaagcacctgggtcatggggacttgggcccagtgtcatgggcaggtttgagtgaggtcaggagtacctcgcaccacgcctactctcttgaggtggtttctgcaccacttctatacggtgggacctttcatctccatagcatggtagacacaagaatacagggaaagtcttactctctcctttctagaggattccttagagagtagactgtaagagcaagactttaatatttgagactattgacagagacaccatcaacagaaactcctcacaacaaagctctagccataaaactgaaatttctatgaaatatttgcaaaaaaaaattgacaataggaaactatgatattttatagtaagtagtccacaaattaggttaagaactttaaaattagtttgggattactataacttaaagtattctgttatttttgtcttattgttgaatgcataaggcaaaatgaatccatttttgatgtgagttatttaaaagaagaatacttttctgttacctcttatttgtgaagaaattgaaaactgaaactctttcccaatctttatatcatttgcacttttatgtttgttttgtgacgtagtcagggttgttcttatttgcattatgtaggtgaggatacaggttcagagaagtgaaacggagaaggagaagtttgaccctggccttgtaggccattaccaggctgcttttattgagaacctcaggtatggcattctctacgatgagttaaatgccttcttcagattgggttttataatacttgtgcttgtttaggtaagagaatttacattgtttaatcacgtagagagctatagtagaaaatcaggaaaattgaatgagctattatgttaacatttcctagtttgtatcttttcctttggctattaatcataagctatttaaatagctgttttatacatttattttgtagtgatagatccttagaagtagcaacccgaaaagtgattcaaagtaaatgaaattagtactgtaagcagctttctggcaaatcaaagaagacacaaaatcaaatatttttctgaggatggtcagtattttgagatagttggtcaggttctccagatcttaagaaagccaatgaaagaaaaagtccatttaaggccgggcgcggtggctcacacctgtaatcccagcattttgggaggccaaggcaggtggatcacttgaggtcaggagttcgagaccagcctggccaacatggtgaaaccctgtctgtataaaaatacaaaaaaaattagctgggcatggtggcgggcgcctgtagttccagctacttgagaggctgaggcaggagaattgcttgaactagggaggcagagattgcagtgagctgagatcatgcctctgcactccagcctggtgacagagtgagactctgtcttaaaaagaacgaataaaaagtccagttaaatgtgccttccctttgagtttccagagctttccacattctagtgaaacctaggagacctgagttaccacagtcaagtggtgaactaagtgtgtcctgatcagaacaaaatactgttcctcggtatctttccctttcttttttatttaccattgacagctggctacagagatcatataatctccagaaagaatgctggtatagcttctgtgaggacaggaggctcctgacgatcataaagtctttttcatggagtcaccattgaccctttggaagtgttcagtgccacttctttctcatatcaacgtaaaactctgcaaagtcatctccttctcatctgttacataatacaaaagaatgcattttacttgattttcagggcaaagagcagattctgaaactgatagcacatttgcacactgaactcagaatttgccagtggtagtaacctttgtcacatggcggggagcacaagattgtgtctgattgtgtctggcctggttggggtgaagtcggggctagtgggtcgcttacatggtagcctccagcctcttcattgtgacaacacaggagcttctggtgttgaaactgcctgtccctgtaagactgagatgagatgtgaggcatatgatcaaagggtcacttaccagctagctagggggaagtggacatttcctgaatgtcccacattttagaaaatagtacgaaattcccaatgcagatactgtctgggttgtatgagtcttattttactgagttttctttgtaccatgcacagcctattgtaagcgcaatttaataaggagattttaagcatgttggtatatcaaattgatttgatctttatatacatcctttttgtctattagggatttatatgaattcaatttcacagggctaagaaaaatttttttaaatttaaaaatttctgctcctttggttgcattgaaatggtgggtctatggctcataaaatattctatgcatggtaagctaaaatatatctgtatttggatttagctgcataagtacaggaactgaacatcagactttaataaacattaataaacccttatgctatatgtttttcaatgagttattatatagtatatataatatttagatactatatatactttaaattctcaacattgttttgataatttgctctaataacgctctaataatttgagcacttgtagagaatatttagttaagtggttaatggaagaaactcgttggggatttttggattccgtttctaggagggcagttctctcatgaggtaaatttcctatctggtctgtgcatgaatttcttgaagaactgacaataattcttcctattagtgtcacaggcaagggggcaaaggggttaggtgtcaatgcctggctgatttcctgcattacaaaatttacctcttacttttctgtcttcctgatgttaccccctcttttctttcacctcttgggcctgcacatgatttgtttgctatcaggggccaataagctttctctgtgttttcagctttacagaccccatggtatatgtgtgaagcctttagctttgctgtgttaagaagcaagtagctgtaaacagtgcgtgagtgggtgctggtgctgcactccagtcaaactgtctctacagacacagaaagtggaacttcatctcattttcacaggttataagatcatattttttgactcttttcatttaaaaacaggtagtaagttgaatttgtgtttcaaaaaaaaacaaaaggcaggataaaacgaagagctaaaacaccacagagcaggttgaaatcccggatgtgaagtagtggagccattgggccctccaccccaagctgtgcattcagaatgccacctggggcagaaaacaggtttatacacagagccagagagacttcagatctccggtgatcaggcacagtggaggacgtagataaaagatccctgcaccctgcgctgtgagcccaccaggtcccttcacctcactctcttttatgcacaaccaaaaaagatcctggagaactcttctctggggaaggaagttacctcatgacaacaactcttaaacaccaacatttcgaggcccactgatggaaaaactgactacaggtagtaacttcgagtttggagaaggctcccacctgtgcccccaggtggtgctgtgtagcttactgagaatctgcctggcggctcagcccccactcttctgttgtggcaacccacatctgaaatgttgtcctctggggaacatgcatcctttccagacactcctgtaatctatatatttgttcctccctttcaagaggcttagaacttaaactttggttgtcatttttgttgatattatgctgttcattcctagtatagccgttttctaaaaggagagagaagcaaggatcatggatcagtagccaacgttagagtcagagagcagtttgcatgcaggttgtcacagaggcacatctagaacacaaggaaactctcatgcattccatgtgcttattaaaagggcattatactgcgaagtactagtctaataattctctgcaagggatttaaaaaagggatcaggggttagtactacttgctagagtcagagggcaatttgtatgtaaattgttacagtggcaaatctggaacacaaggacactcacatgtatcccatgctattaataaaacggcattttattgtttaagtcctagtctagtcattctttataagggaaaacaaggatcaaggatcagtacaccatgctatagtgagagggaaattttcacgttaagttgttacagagacaaatctacagcacagggaaatattgagtcatttttaacattaaggtgtcaagtcctgcctggaggaggggcacttagggtcagtaggatcaggtggagaggcttttcttctaaagtcctagtgcttagcagaggaatgagagagaccattcagtcccactatcacattgtacacctgtagttgcagcactgtgggaggccaaggtaggcagattgcttgaggacaggagtttgagaccagcctggtaaaatcctgttgctacttaaaaaaaaaattacacgctgtagtcctacgtttacttcataaaaactaatgtagaaatgcaaaattaattttccttaaataaaatttctgcattactctctatattactttgtctcttttattttcaatggctgaaaaaaatagttttgttttaatttttattatttgatccatccttaattaccaggcattgatcagtggtttgaattgccctccctggctttccattttaatctaaaattctgctataagtctatgaaattggaccagaacacaagctgtgccatcagtgatactgataacgagattctagagaaaggtgcttctttggctggaggagtttaggccgatcacatttcagtgaccccggagaacattagacagcacctattgccacaaagcaagcagccagctgtgggtagaacagcaaaggcagtcggatgctcatcgcctgtattgccctgggaccagcagaccaaataaatgtaaactggactcttgcaactgtttgtttgaagatttgaaaggagttagtttatatttattttcataactgctttatttctgtcagtatttaatgtttgccaaaaaaggaaacacaggtttcccacactgtctccccatcaagtatcacaaatttgtgtgtcaagtaccagaatttgagaaagataattaagatggtttaaggtcatctcacagatagaacctcagtctatccaagttttctcctccagggtcaacccactgtattagcttcctggtagtgctgtgttaattaacaaactccgtggcttaaagcagcagaaacttaactgtctgacacctcagaaggctagaagtccgaagtcaaggtgtgagcagggctgcactccctctcaaggctctagggaaggatccttcctgcctcttttcagctgctggtagttgccggccacccttagctttccttggcttgtaccttcaactccccaatctctgtctccattttcacacgccctccctcgtcctgtgtgtctttgtctccaaatttccctctcctttctttggatttagggtccaaccttaatttagtatggcctcataataacttgattacatctgcaaagaccctatttccaactaaggtcctattcccacgttttaggtgaacatgaattttgtggggagagcactgtcaagccagtacacctccacccatactttcctactcccagctcagactgccactgttcaggttgccccaggagggccctgagctggggcgcggactcagtcagtcgtgtttggctggagtgttccatgaggttcagccagtcttgccagagccttgctcctcttccagcccctcaacccaattcctttctcctgtttcctttccttccacactaccacactgtcttacgtccaggatataggttagtcactcaattccataagccggatcctgtggtgcaaattccataagtggcgatccctgatattagctttgagttggtgccgggtccctagtaaattaggactgaagatctgcacacagccaagggccctctccctagcagcaagcaccttttcaaaagagcagaattcatttggaaggcctagaaaaaggaaggaggtgctctgccaaaatcaatgatgtctgagaaagaagcatgctccctagagcttggagaagatcagaagagggatagcctgaggcatggctctgcagtaaatcattaagagacgcccactcacagtggctgtggctaccagaggtttcctgtgagggaactaaaaagcgcacagtagtgtttgtaagtgatggttccattttaatagataaacatacagaacttataaaaaatcaagaatctatattagccagatttcctaaattagttaatatttcttttaaatttatacttaaagtcacagtttttaaaactatatatatgaatgtgaatactatatgctttggggaatttgactttggttattttctagtgtcaaggataaacacagccagacagtagttaaagcgatcagcacagattttcttccataatatactattgcaatagagaaaagagaccaatgtgaaactgggctcaacatcaattatcccagaggtgactgggcattttaaagggaaattcagggagtagggaggggtcagcaggggctcagcagagttggggaagtgaaaattgcagaaagcaggaagagggtttggtcagtgtgaagccatctgggtttcactggtgctgatagaagtcaggctcctgcccttccacagaggcttgtctgcaggagtggctggaaccaacaatcagttattttggcagccttgagttttcgtaggcaagtactttaagggggctagagtcatgtagcggtgtgaccttgagctgttgaacttgttcaagtctttataggccagtgtgggggccttgtggagaaaaagactcagagcagcctgagtagagtctggtccaggagacacttttgtcactgagcatgaccaatccatttatcacaatggtagcagcgtgtcctcatggaattatgtttccttcgataaatcttgaacaagaaataaatgcatcagcatatgtttttaaaagttaaacagatgttaaacttaaaggaagtttgctaaaatccatttcgtggacccctttgtaaatacctgacctacacagcttaccccttatgatttaaagttaacttgcatccattttatggaatcccaggtgcctgtttgacctgcagacatctttctcccttcttggtcactctctcagggcatcagctcttcacacagcaacagcttcctgcatgtggcccctgactgtccattgatgaccgaaggctcgtggacttgccaagttgcccacgtaaaacccagggttcagagagcgagacaagtccttgcattgtgaagtgccaacaattctagtattccaaagctcagtgttgttcagaacatggtacccttgtgagatcacgtgtgacatttgtgaagaacctggaactgatgtttccttaggaagcctcgcaacagtaagtgctttcagctcgctcaaggaacttcaagtaggcaagaaataagaatggaaaccctgcattactccatcagatcttgaaagttttctcttggataaatgtgcctgtcaatcacatcgaatcttatcccctgcctccatgtgctataccacaacagcgacgtctgctggaccgtgtgtgctctctgggtacacattttccaggaggcagcatcttattagagagtaacaggtctgtcttgtgtaaaggagaatgctaaccgcttcatgagaaggctccccaccatgaactcggataaccggatgctatttttttaacttatttattttttaattgacaaatagaaatcgtatatagttatcacacacaacgtgttttgaagtatgtatacattgtggagtggctgcgtcaaggtaatgaacacatgcatcatctcactttctcatcatgttttgtggggagaacacttaaaatctagaatctgagtgattttcacatagccaaatgttatttttaatgacctttgccttaattgtccattcaatatcggtcatagatatttattgagggcccagcatgtgccagccaagcgtggcctcctaattggaaacacaaaccctgagaaactctgagcattgttgtgtagtgcaggggccatcctcacacccccacagccagcattcagcttgcttcataagccatggatggagtcaaaggaaaactagctcaccttcccactatgtatctgaaatcactttctattccatgctgcacacatgtactgcaaggaaaaggaatgattcctgcccccaccactgccttccattcctaagaacagagaggatggagtacgaggatgaggaaaacagacggcaggaaataagcagtttattcactggatgtctgcatggggtcttgggagtgcagaggttgtgactcattcttgagtggaagtttctaaccacatacatacaaccgcaataactgcagccagctgctggaggtgttgtggtgaatcccagcgggttacaagggtgtgagaagcctggtaaagtttccaggaagtgaaagcacatgagctatgtcttcacccgcaaagatgcaggtaacagctcagattctgagtcttaggaagaggatggaggccggagggtgacagggtttctctgtagtcctcaggaagtgaaactgcctcacaggaaataaagcaatatcaatcaggcagtttctttctgtgtatatttgaatattgtcaatgttttaaaaatcacgacgtatttctttttttttccttctttttttttttgttgttgttgttgttgagacagtctttctctgtcgagtgcagtggtgtgatctcggctgactgcaacctccgtctcttgagttccagtgattctcctgcctcagcctctcgagtagctgggattacaagcatgtgcctccacgcctggctaatttttgtgtttttagtagagatgggatttcaccatgttggtcaggctggtctgcaactcctgacctcaagtaatccgcccacctcggcctcccaaagtgctgagattgtaggcatgagccaccatgcccagccaaaccggacatatttctaaggaacgagaaagagcagccgtctgtccaccacctgccccccacaactgtcttgaaccgcatcccagacagcttggtgtcgtagctgacattgcctgtgtcggccctcctctcctgatttattttaatcctcatatgttctttcttcttctgggaattgttcttttctagcattctgtttttgttttaaggactcagtaacttatatgtcttcatgaatactaattattatcatgactgttgcttcctcgcccacttttctctggattgtcatttttttctggcagattcctgtcttctgcctgtttgagtcttcttccacaaacacctggcagtgtctgttctgctcattcacattcaagaacagagcacctgtgtgttcatttcctggggctgctgccacaagatactgaaaactcagcaacttctaataacagaagttgactgtctcccagttctggagactggaagtctgaaatcaaggtgtctcagggccacactccctctgtaggctctaggggaggatccttcctgcctttcccagctcctgggggctctaggcatccctgggcttgtggccacatcacttcagtctctgcctccgtttccacgtggcaaagtgagctcatctcaagatttttaacttaattacatctccaaagaccctttttctaaacaagacagaagtaccatgggtgaggacttctgtttgggggctaccgttcaacccactgctctcagtcacacaaagcttttgaagcataacacctgctgttcaggcagttgcaaaagtagcccctaagaaagacagcatgccaaagcaccttccccatggtggggtggggtgacgggccaggcacccttaggatgcccatgcaggaagtggaggctcagcagaatcccacaggtgtgtctggtcctgggatagcatcagcgtcttctcacaggtagccaggtggcatccatcagctgaccacatcgtctgccccagtggcacgggctgtcttccatgtctcacttcatagagctcttctagactgaggcccaggacatggttctcggcacacagcgttaatgacatgcacggccctctaagcggttccctctcccactttgcgttgtcaacccccggtaccccccacttgattctgttgctcactgcaggtcttaggtagtacagagaatgttcaggcttgtagggttctgatggccagatcacccaacaaaagaatgccacgaacacctgagaccgcgcggcagctgcctgtcttctgcctctttcctttgtttaatcctgtttaattgcacatccctgttctcacccaccttgggtctctaggatggaggaaagcaggagcgtttcttcccactcacagtgctgattctccacattccccagttcttcccctggagatgtgtcctgtgagctgattgtttggagcaacagatacctagatatctgtctctctgcccttcctgtaaacccacggaagcacaccaaattctaggagctgggaactggagttcatttatacacataattaaccagcttctccctagaacagaactccatttgcattttttcgtcttttacttctcagggaaagccactgagtgagacaaagtttgtgtgcactctttaaaagatgaaaaactttgtgaaggcatcaggcagttttgaatcaggtgattaggatcgttcattcctgatgatacactggagctatatctgatgataacgacactacctaacatttatctggggcttcctcacccatgtcattttccaggcattgttcttcttgtgaattaattccatgaggaacgttaatcattgctctttgacagatgacaaaattgaggcccaaagagggcgtataattgacggatgtcccgtaatctctgactgtggtcatagtcttgtcttggctttcatcttcataggagtcccaagcattttggagatctcagtatgttgtggtggtgtaaagcagtcgtccaaaaccgtttttgattcattctccatcaataagaatgttgagctgcattccagtctagacacattggtgtgtgtttgtttatctactccaccttagaaataattcacagcaatagaaatgcaagaaggataagctaaaataaaataatcggccgggtacagtggctcacatctctaagcccagggctttgagaggccgaggcaagaggattacttgaagcagaacttcaagactagcttagctaacatagggagaccctgtctctacaaaacataaaaaaatttaccaggcatggtgacatgcacctgtagtcccagctattcgggaggctgaggctggagaatcgttttgagcccaggaggtcaaggctgctatgattgtttgactctgctccagcctgggtcacagagcaagatcctgtctcaaaacaataataataaaataatctgtttaagtttttaaaattaatagcaccaaagtactttaagaaaatttttatacagtgtgttttacagagccatgtgtttaagtgtgctccattttttaaaatattggtttaaaattgtgtgatctagcaatttaaaaatcttgttttaaattcagattgttttgatactcagctttaatcactgtttatatccagacagaagttcatgattggctaattttttttttttttttttgagatggagtctggctctgtcacccaggctggagtgcagtggcgctatgtcggctcactgcaacctccacttcctaggttcaagcgattctcctgcctctgcctcccaagtaacgggttacaggacgcactgccacacgtgactgtctcttttttaaaaaaattagagccttttatctcatccatcagttaggttaaggtttaaattgaaatttagctaataaatatagtcctctgtgatactaatcagtggttgttgcaaactaatgaaatagtgtggcattttagtatttttaactaatggattcaagttctgtagaagctctttaggtggagtacttctacactgattgaatattgtttttatgcgtggaggtatgtgtatgtatgttcatgagatctgtcgttttcttgtctggcttttgtctggttttgggatcagggaagtgctgatgtaaaatgtaaaatgagttgagaggtgttccctccaatttcctgaaaagtctgtttagaattggcatcctttttttcttgggaagttggtaaatttaccagcaaggccatttgatcctagatgtgggaaggaggtttttaattacaaattcaattcctttcataggcagaaggctattcaggttatttgtgtcttcttgagggagttttatatctttcaaagaattatctcatttcatctaaatggtcaaatgtgttgccattaatcctataataattaagtttttatcattttatcgatgttagaatctgtagtgatgtctgtcccctctttccctgctaatgttagtacatttggatcttctttatttttttgatcagtttagctaggagtctactaatttaattgctcttctcaaacaactcgcttttgatttagttggttttctgtattctacttttatttcattgattttctctctcatgtttattatttccttccttttatttgttttgggtttaatttgctcttttccttcactttcttaaggtaaaagcttaaatcattgaacttctttctttcaggttttcaatgtggcaacttagatcacttatttgagaccttattatttaacatatcactcaatgccatcagttttcatcgaagcaatgttttagccacatcccagaaattttggtagtttttagttctctacaaaatattacctagtttccctttgtgatttcatctttgacccatgtcttacatagaagtgtaacatccaaatatttgtgattttccacattcctattattaatgtctattttaattctaccatcgttagataaggtattctgtatgattttaagtattttataatttttgagaatagttttatccttataataggatatttcttgttgaatgttccacgtgcacttaaaaataatgtggtttctgctgttgttgggagaagtattacataaacgtcaattaggtcaggttgcttgacagtggttctgaagtctgctgtgtccttacttcttttctgtctacttgttttatcaattactgatagaggagttttaaacttccttctacgtttgtgtttctccattcagttctattggtttttgctttatgcattctgaagctctgctatttgatgtttacacatttagaattatgtcttattgatgaactgatctatttgtcattatgaaatgtccctatttatccctgatgatagtcattcattgttctaaaggcttgtttgttattaatgtaagtaacctggctctcttttgagcaatagttatgtggtatgtagttttctatccttttatcttcaatctatctgtgtagttatatttaaagtaggtttctgtagacaacatgtagttgggtcttttgtttttcttttttattctgatagtgtctatcttaggtgtgtttataatacttataaagccgttacataaggtcatgatctgctaattccatctgtctctatcatttctgtgtctatttctcctgattgtgggtggtatttgcttctttgcagcatggtaatttttgattgaatgttagacactatgaattctacacccagtggagtgctagattttgcttgatttcatttgctttatttaactttgtcctggaactacattatgatctgtccatgccttccttttaaaaatctttagagggtcaggtgctccagatatctgttaccttatcctgaatgactgtaggtgttcggaaaaaatgagtctgttgattgttttgtgtaacaattgacaaagtagggacattaaatcatgacattattaaaataggcatgattatacaattatttaaaataattttaggccaggcgtggtagctcatgcctgtaatcccagtactttgagaggctgaggcaggcgaatcacctgaggtcaggagtttgagaccagcctggccaacatggtgaaaccccatctctactaaaaatacaaaaattagctgggcgtggtggcacatgcctgtagtcccagctactctggaggctgaggcaggagaatcgcttgaacctgggaggccgaggttgcagtgagccaagatcagccattgcactccagcctgggcaacagagtgagaccctgtctgaaaaataaaatgaaattttaggcaaaccgtcacaccttgtgtggatttagatgttcctgttgtgctagtcgcataagttaaaggtaggaaggactcctggtatttttgattctttctgataactagtcctctcatgattggctctatgatgacctccatggacctgtgtggtccctgtagttaatccgtgtggctaatgacagtgtgaggatgctcttttcatatggcacgttgctgttgatcagctgtgttcagcagctttcttttgtcccctgatcccttgttaagtagcgctgcagcagtccctcagccacagccttcttcagcatctggtggacgcctttgtgtaatttcctctccttagcagggtgaagaatgattgaagtgttttctgtagaatacagcatttttgcagaaaacaccaaaagcatagtccttgtgtatttactgctctggaaaaaaaagtatggttcagcgaggccctgctgaagggccttccccggtgccctggccagatcccaggtccagtcacctcctgggcctgctctctgcccttctccacgtttcataaggaggcccagcaggcaaagcagcagtgcctcccagtgcgctcttcttctgttcctttgggaaacgtatcgctcaaccgccaatagcttttttgattttttggtttgttttatttgagcagggatgttgtggagctgacaaccgcttttagacaatctgtcctaggtcagaaattcctcaaaaggagcagcctgagagtgtgctgccacacagctggagggactgtccctgcaagaaggtcttatggtggaggcctcgcccctcacctcagtccttccctcctcctccccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaaggtaagtgggtgccggtgacacgggccgtgttccacaaccatgttccaccaaataatatccatgtagtgtttgctaaatgtgaaaagttgtggtttgtgctgttgaaggccactttgcaatgctccctagaacttgggtatgtgggcagggagatggtctggttggaagattttgtgaggaatcgtggccgcacctaagtcaccaggccagggagactcagccagaatccactgggtctcagggacaatctgagaagcttacagtgccagaacaaggcctattcagacattttccagggaagcggcggttttaatgatgtggggcttaaaacagtcttattgtctaggtgcaggctttaaggtgagtattcactgcagttcagatgtaaatcactaaaactcacttcccctccccaactgcttatagagtgctcgttggttgctgcagtttttgcttgtgtagtgacgctgggtttttatcgccaagtttttggacttccatccatttctccattggaaagtggcagctggtgggcttgtatgccgtggcaccccctgtcccgcaccacggctgcttgaccatgcagggtatgcagtggagacggcccctggctccctcttcttgttaaataaggctcctcctcaggtgacctgggcagagcgtttagagagccgaccgcttgtggtggctgggcctggctccagattcctctgaccgttctgtgactgccaagatggagtccttggcctgaacgatctgcaggtacagattccagaatcacaggaagtcacccttgaaaggggggctcccgctggcgatgtaagtgtaagcagctggggagggcatccgtcggggagtctctgcaaatgcctgcttcccctgggttcctgcatgtgaggacttttgtggtttgtggggaagagcctttcagtgagaggtctttttcaggcctcacctctcattactaaccagtgacaccaatcacgagctcagggaaattactcagaaaccttcccaataaagcggagctaccggagtagtcttgaaagacctgttttttgttgttgttgttttgttttgttttgttttttgcccagggtgcaacttactaccttgagcctatagaggcagccggaacctgtgcctcagtacacaggcctctgattctctgaagctaagtgggcatccagcaattcagttcagttctgacactgactcctacggttagcccagaccccgaaggttaaggccccagtcccacaagacgcccattgcacgttccaggggccacctgtacttctgattggctacaaattgggggttcctgcaatcctctcttcaggtctaataatcccctaacatgactgacagagctcaggaaaacactttcatacacttgctgctttgttatgaaggataaaactcagggacagccaaatggaagcaaggcattggccaatgtatggcgggtggttgcaatgctcccctgccctctctgggcacctgaccctcccagcacctccatgtgctcaccaaactcaaagctccccaggccccttatgtagaggtttttatggagctttcttacgtaggtgtgagtgatgacatcactgacgattgctcattgaactcaatccaggccaaggtgccctccctggagatgagggggagggctgaaagttccagtcttgtttgtttgtttgtttgtttgttttgagatggagtctcgttctgttgcccaggttggagtgcagtggcatgatctcggctcactgcaacctccacctcccgggttcaagcgattctcctgcctcaccctcctgagtacctgggattacaggcgtgtgccatcacgcctggctaatttttctatttttagtagagacagggtctcatcatgttggccaggctggtcttgaactcctgacctcgtgatccacccgcctcagcctcccaaagtgctgggattacaggcgtgagccaccgtgcccagacctaatcttctaatcgcatatttggtctttctgatgtccagaccctgtcctaaagctatcctgggtccactagaggcatcttattaggttgaaaatggcttattaatgactcagaaattccaagtgttttaggagctccatgtcatgaactggggacaaaaaccaggtgtgtagtttttatgatgccatagctataaacagtcattgaaagacagtggggcattcttagcaacacacatacctgggctgattgaaatctcattcttgatttaagtctcattattgaattcaacttgactgcaattgcttaacgtgggacgtgcctgagacctcccagctagtaagtcagagagtcaaggctgagcctccaggtgcggctggaacagctcccagtgggaacatgtatctgcttcttatgtctggacatgtgtatgtctgcatgcttggcaccctgttacaaattcctctgcaacatgttcatttttccttagaatttcccccttgtggaagaattattccatagcttcaggctataaagccttcttcccagaaacaccatttttgttgttgttgtttaacctgagttattgttcactagaaaagtgaaggtgctgcactccataaccatgtcccagaagcgatcagagtatgttggcacttgcattcagttctgtatttacaaactgataaagacaaggtgaaatatttgccttgttaacatgagctgttcctatagctaaggcaattaaacggaatttcaagtacaggcagtccttgttttgcaaggtactctgttaatggaaacatggtgtttcatgtggggttttttggttttggttttgttttccttttgtttttcagatagggtcccctttgttgtccaggccataggcggtggtagcacaatcgtagttcactgcaacctccatttcctgggcgtcagcaatccttctgcctctgcctcccaagtagctgggaccataggcacacaccaccatgcgcagccgggtgtggcagctcacacctgtaatcccagcactttgggatgctgaggcaggaggatgcttgagcccagtagcttgagaccagccaggtcaacatagccagaccctgtctccacaaaaaattagccatgttttaaaatgtatatggaagcaaagtgtatgtggaaaccacatgctgccattgcatgggaccagttatggtgaaacccacagagcaagggccctcatgaggaggaatttctctcacaaggtaccctgcaaagaggcccatggaatgaattgtgttttaacatcttggtgttctcattgacaatgtttgttttagacttgtcaaagaaaaatgagcagttgcattttttaaaagtcatttagcttttagaaagttctaaacattttccttattattaatctacatttacttacagatatatttctcttgcagaaatgaaatgtttcctctcatgcttcttacttagagacagtgacacattgtgggtcttcctcctgtgatgtgcatattgtaatactaaaggaagtttttcccaagctcctgtcagggaagcagccctggttttgtacttggcatttgtgtcaggaatacaggaggcagtggccaggggccgtgtggacgatcttggagctcttcagtcaggccctgctgctgcttcttgcccgcagtgtgggtgtgagctcacaggagcagcatgcctccagagttcaagggcattccattaaatcatcagtcactgaagagacttctgaatctcttagggaattgccttagggaattgatcatgccataggtgtcaccaggttaattaggcatagtagtagtagtagtcataggaaagtagtcaaaaacaagtaggatcaaagggttattaattatgttaaatattaattcccatcttactaggagaaagtgtccaacagagctgacattaaagaatcaagttttcactgagaatattttctaagttattcatgtatcattattttgttctaaaaaatatcaagcaaacataaggccaccttcagaagccccccagaaaccaccttcaggataatgagcacccatcgagtgaaagcacccgcccactgtgtgccaggcagggtgcgacatctgccaacacatcccctgaaggccagagacccagtgggtagagggcctccatgtgccgaacgccaggtcctgagacttgcgagtgtgagcacactcattgcttggtggggacttgagcgaccaagctgggaggcaccccagggctctctgttcccagccacaaaaatgccatcattgttgtgaaacaaaaatgatggcattgcttacatatcacttctagggttgatatttattacaagtaaaaccagaaatcggaaatcagttttgttttttttttttttttttgagacacagtcttgctctgttgcataggctggagtgcagtggcacgatctcggctcactgcaacctctgtctcctgggttcaagtgattctcctgtctcagcctcccaagtagctgggattacaggcacacgccaccacgcccggctaatttttttatttttagtagagatggggtttcaccatgttggccaggctggtcttgaattcctgacttcaggtgatctgcccacctcggcctcccaaagtgctgggattacaggagtgagccactgttccggctggaaatcaattttttacagcctagccatcactactttgcgtgttttagttttcttgtacttgttagtgttgttttaggagctgaatttcaggttttaaaaaaattatttttgtttttgtttttctgttctattttcaagaaagttatacatgttaaactgcataaacagatagagtagactcattttgccagcctaagttttgtgtatattcggtatctgtctttttttgtataataccagggttgaagttgtgagataatattcacaattaataaacaagggacgtggtagattctactctttttcgtggaaacctgcatatttcttaatgaataagggctaagtccacataaataggtagactgggctcatttcaaccagcctttagacatttctactcatagcccaaactattatgctatcaccttgttaagaatacagtcttacaggtggtggttcatgcctgtaatcccagcactttgggagtccaaggtgggaggatcacttgagctcaggagttaaagactagcctgggaaacatagtgaaaccgtgtctctacaaaatataataatgatgatgatgataaatttgccaggtgtggtggcgcctgcctgtagtctcagctacttaggaggctgaggtgggagaatcacctgagcctaggaggtggaagtttcagtgagccgagatcatgccactgccctccagcctgggtgacagagcaagactctgtctcaaaggaaaaaaaaaaaatagagagtacattctgggtggtgacttagggatacaggtgttctgtgaaattctttcaactctgctgtacgctggaccatctctacagtgcaatgttgggggaggcagctctgcctagtgtgacagtcagaccaaaagttcactcaggcacaaattagagcatcataggggaactggggatggcacagggcctgagataaatgctcagcgtttttacagagaagaacagagggtgggattagtgctgaacagaacaagtccaacaggagtgcagccaacacagaatcaatcgtgaggactttggaaaccaagcagaaaagtttacacatggtacaataggcatttgagctcactggaaattcttagaaggacacattggccatgtctgtgttttagagctcagtggagtactgggtgacagattagaaataggcagtaagggaggaggaagtgccaggtgtgattccaatgtgatttccttcagggaacttatagttcaattagaaaaaaataagtaatgtcaaaagttataggaggcttaggagaaagtgaaattaagaaaactgtcgctgggcatatattcatatcaacttgtaccaaatttgaagaactttttgcatctctgtgactctttcctagatttaaaaaaactgaaaaaaagatgtagctagttaaaaatacatgtatttttctaatacctgtaactgcatgtgacatttacacaaagtttcatcttaacttatccttatcgtacattgcatatgtcccaaaagaatgcagacaggagcaggcaggctgtcagtgtgagctgacctctgtaactggaacttcttttcctccgagaataatagagaacaaatagctgtatactacttatgtccaatttaaagttaatatttgggccaggcgtgatggctcacgcctgtaatcccagcactttgggaggccaaggtgggtggattacttgaggtcaggagtttgagacctgcctggccaacatggtgaaacctcatctctactaaaaatacaaaaatcagctaagtatggtggtgcacacctgtaatcccagctactcgggaggctgaggcaggagaatcgcctgaacccgggaggcagaggtgcagtgagccgagattgtgccattgcactccagcctgggtgacagagcaagactccttctccaaaaaaaaaaaaagttaatatttggtgaccagctgagctttgctggacctctggttttggggagattagatgttcttgaatcagcttcttaccctgcaacactgagttacgggcacagccacactggagctgctccagagggtgaggaccgtcacctgccattgtttgccaccctctgtgggcctcaggaccccacagcctgggtcctcattgctccagcctcaaggccacctcctcctgtcacccatcatcgctgaacaaaataggcatgcctctgctcacttgtccttggtattatttcatttccctttctcccttctttcgttatttaaaaaaccgtaataacaaggaccttcacggttactgtccttacacttcttttctttcattgaacttgcctttgggcttggtgtcccttctgaatttcctggcacgagggcacttgcttaaaccaaatttcactgtcagaggaaatgtgtttcctctaccctcttaggtgcagtgattgggggcctgtaaatcagactaacaaaagacagactatcaagagtaaagatagatttgtatttacatacaacgaaggagttcacagaaaaatgtgactcaaggaggcagttagaatttcggatttgtatgtcatcttaacatggatgggagagaggcagaaggacacacagaagaataaacttttaggaaaacttttaggaaaactaagtgggccgttaggagactagatggtggataagatagttttataacaacatcttttggggcgatttctcatctaggtgtgacaggtgctgacttcttatctttggtgataagactcacacttccctggttgtgaaactcctgagcattggatgtatgagggctgagggctgaattcttctggaaggctttccttagaaagggaagggagtgcagaagccttctgttcctgtacttgatgcttactgtcttcagctctaataaccctcatgccactgtggcatgttcctcagtccatggaggccccatctgcttctccccaacaccccatcattactcccctgcccccttctctgaatgcccagcacccagcactaataagaggccctctgcctgccgagcgcacgtggcatccttgtttctaaacaaccctgaggtgcccggcccctggttctcaggtcctgcctttatccagcccgagtagccttacgtccgtgtccagaacactagccttggggcatcttgctctcccagatgacctcggtgtccctcagtcttgttcccacattagctgccaggtgccacaatccctgtttctgactgcatcctcgcctcctcacctcgcctcggggggcatttcatcctggcatctgccgctcctgactgctgaaaccacagacatccgtttcccacgctcctctgcaacgtctccctctgctggctgcaccatgcccatccgccctcatccactgctcccactgtttctctctgcacttcctctcacccaggaactcggttcagcaatccccaaatgtcagcatctgtgtgtgtgcaggtgttgttttggtgttcatctcactctgtcccatccccctgggtgatcttatctgctacttgttgtcactgtgcctgactcaaatcttggtttctggacatgggtagagtcctgggcccagtggtctggaaaggggccttgggaaaatcttatgtaaaagttcagccaggccacacttactaggagtctcaatagaggttctcctaccttaaatctactcttggggaccctgctgcttgtctgagccccaggctcatgaatctgcactgcctggaagtcatgagcacctctgaaaacacggccaacactccattttcccacattttccttcagcctgctcctgtccctccaggcaccctggagtccctcagccaaccttgaagcttctcattgcacgaggattctctctcctcacatgccgtctgcagccagcaacctcctttatccatccacttcttaggccctctcttctgaaaacctcccttgtcctcatttgtacgtttcttcccttcctgaattgaggctgtaggtagcagctgctatgttgacttcaaggtctcattcccagcctgagaacacagactcctcccctgtccccacacccaaatcagaggctatcaatgcacgatatacggaagcagaagccaatagacacagaatccagtcactgattctgtaggtaaagaaacagattcacaccaagggactcaattcccctctgtaagcttttattgaacctttcgtgtacgtgccattttatcagattgcaagatgccaggaataccgagtgatttaggagcacacactgtcatttagttttaataatagccaatgtcatttcttattagaatttagtagttatttcttgctctttgattttcagttcttataaactttggcaaagaaaccctacattcccagctatagtgtggccttctatattagtctgttttcacgcttctaataaagacatacccaaaactgggtaatttatacaggaaagaggtttaacggactcacagttccacatgactggggaggcctcacaatcatggcggaaggcaaggagcagcaagtcatgtcttacatggatggcagtgggcaaaaagagagcttatgcagggaatctctcccttacaaaaccatcacatctcatgagacttactcactatcacgagaacagcatgagaaagacctacccccctgattcaattaccttccaccgagtccctcccataacatgtgggaattgtgggagctacaattcaagatgagatttgggtagggacacagccaaaccatatcaccttctttttcttttcccgtggtgttccccacaaatagagaaggcattcctcttctgtactgttatttcacaaaccctgactgacacttagtctcgtgatccttgtctccatctcctgccactacagctgcagtgatgtcaatggggaggctgtctttttcaccttcaggctctccctctccccttgggtacatcatcagctttgataggaggtggagctgtgctttggccaggtcacagctcagtaagtgttctggcttcttggcagacccacagccacctgcgttcctccagactggtttccagggcttacagtcagcggcagaatctgtcctcctttgatggagagctgctcgtcattcttggggaacttggggcactgcagtgttgatttctagttcacagccctgcagagacctcgacacaggttgcatgcacacgggcccctgtactgttctgcagaattacgccagagctgagccattcctggggcatgagggtctctgggaaaacacaaattagaggcatgaggcccttctgcactctgtcaaatgcagagaagtgaagaaataatttcactaaatgctagagaaaaacagcaaatctcagaacagaatgaagttctgtcctctcataattactcttcatatgtcttgccttcagatatcttctttatgcttggctggagaaattccaggatggcactgtgccctgtgctttgtgtggagaaaatatgatggatgaatccctggtccactatttcccttttaaaggcagatacttgtatgacaatggaaaatgtaacaaaacttcatttaatcagcactgtgtgtgtgtgcgcatgcatgtgcgcacacgtgtgtgtgtttatgtgtgtgtgattgatatgtgttatggaaaaagctcatgtctctggaaatactttccagcaaaaaacatctaatagcttaatctttatagcagtgctggttttggccctttaacttccccgaagttgtaaaccaaaaaattgcagtctccatatatgttttattgcatcctctaaaacaggagtccccaatcccctggccatggaccagtactccatggcccgttaggaagcagggcgcacagcaggaagtgagcggcgagtgagccagcattaccacctgagctccgcctcctgtctgatcagaggccacattagattctcacaggagcctgaaccctagtgtgaactgtacatgcaggggatctgagttgtgtgctccgtatgagaatctaatgcctgatgatctgaggtggaacagtttcatcccaaaaccagcccctttcaccccccacctatctaggaaaaattgtcctctacgaaaccggttcctggtgccaaaatgctggggaccactgctctaaaacatgtatttttttatttctggactgtcactcaaatgcctcaaaaaaatccatgcctcgtagttccttgaaacactttttaaaagaactagtagccactattagtacaaatgccactaccctactcggggcatttcattaggttggctggtgaccagctgtgcattttttgtaatgatactgtgttcactgagtctttttgatagcaaggtttcagacaactagccagtaaaaatacaatctagtcactattcccccatacactagtgcatcaagttcgttggtcctgcattaccagttatcttttacaattgtgtcaattttcaaaatatcttttagcttttaactagtaattattactaataattattggatgttttgggctaaaaccttgctaaatgtttagcatctcatttaatgtagtaccacagattattggcaaatttgggcattgtttctcttcactgcgattggaggagaatggtgtattgaatacagagaacacgtgacccataagtagcactagtgctgtttgtatgtatggctccccaccttgcattgcataacattgctgtagttgaggaatccgctttttaaaagtgtttggcctgggctaatttgcaataaagcccgtgaactctcccacccctggacatgttgtaccttccttgtaccttcctcacccgatctggcctccacaatgcttgtgtacacattctcggacttgccctcacccaaactagaatagggagaataaccagtgaattcagcctcgttatgtttggggatttatgcgaggatcaaggtggcatttcagattgttgtgaaacagatggatcagtcaggaaataataccggggtagatgtcttgccagtggagagggggacataaaccccaaggctctggcttacttccaacactaaggtgaatcctactccaatcaaatattaacatgtaaaactcgaaccaagtctccttctggtgataggacctaagcaagctgcgctaactctccccttaagaacagtgagaaaaactggacaaaaactcgaaagcatctttttgaagggatctgattacccagcaggtagggaacggtgggaccctttacccctagagctgtccccagaagaagtggctaatgagaatgagaagcccgagtttgttttttgttttttgttttttctttttttggtttgggggcaggggggctgaggtgggagaatcacttgaacccaggaggaggaggttgcagtgagctgagatcacgtctcttatatagaacctagtttgaaaaggaagggatattttaagtcttttaagataatgttaactatttttctttctttagctctatttctgtgtgtagctgttttactacaccagaattcagcaagtgatagtttcttaagagttagttgctatgtggaaattgaagccctatcagtaaccttttcctcctcgtgtatcttcaaatctattaccgagccttaaactttgaatggatcttgtatccctagcttattcaagggttaagaaaatacgttttctgtagaaaagaagacatgttctgtggctcatccagagtattatttgagctgcatgtctatagtttaatcacatactgttggaggtcttcctgggagatgctggaggcccaggagtcaaggggctctgtgtgccgttctccaaacacagctctctagaaagaaggttccagcatgactcaggagaggttggtgcaaactgggaccctctgggcacctctcagggacacagactgtccagctggttacggaagcacatctcccacctgatttattcctaaataggagcgaggagggggacaatctttcccttcacccccacatcttcctttcctcttccctacctccctgtattaatactgagaaaccacacctgaacaatgaaatgactaggaactacggtttctggttgtgttcccaagtgggaatatgggctgttcacgacctcggaatgtagaatgccctcattatttattcagtagacatccaataaatgcggatcaacagcttgcctatctttgatagtttttggcagtgtgtgctggttttaatctttgtacttgtcccataagtgaccccatgactagagagtgggctcttccatcttgtaagagccttctgttcacgttctgttctttttatgagaaggaagttccagtgcatatcccaacataaagagaaacgttgaatacgtactgtttttctcttatatatatgctcaaaataacgactgtagtaaacagtcgtcatgattataggatgaattacgcagccattcatagatttttgtagttgtcatttacaagtggactatgcaatagttcataggcttatgaatacataatctaacaatattagctgggtgcagtggctcacacctgaaatcccagcacttagcgaggccaaggtagcttgattgctagagcccaggagttcaagactagcccgggcaaagggcaaaaccccatctctacaaaaactacaaaaagaaattagccgggcatggtggtgcttcccggtagtcccagctacttgggaggcaaaggtgggaaggtcacctgagcctgggggtgtcaaggctgcagtgagctgtgattgcaccactgcacccgagcctgggcgacagagtgagaccctgtctcaaaaacaaacaaacaatattatacttgtagtatttaaaaaacataattatctggtattcccatagctaatagaatgaaaggggagactttatctccctagacaggaagcacggtacctcctacactctcttctccccacatcaactggataggtgtgtgaacgcatttcaaagtcaagtatggttagtaattacttgatctttttccagccccttcagataagctgaattgaacacccaaaagtgatagtaacatcattttcctttgcaattacaaagaccattaacccaacagaatctccatgctttacctgtttgtgatgtttttgttccattttattaagtatgactcctgataaatgaatcactacacaattaattttttctcattctttagattcatacacacagacacatatatcaagcaaactataaattgctaaaatgacaggccagcagtgactacttgttatcacgtgtgtaacatctcttgagggctgctttgtaattcatttgtatggtgttgttgtaccagtgtaactgctaagtggtttctctggttccatgtgcatttgtacatgaagttgtgcaatctccacataccagcagtttcaaagaatgacagtttgcatgaggccatcttaatagcaggtagcatgtaaccaacccatctgaattaagccaccattgcagaataaaacatttgacactaagccaggtatttcagtggatgagttgtattttggatttccaaaaaaaaaaaaaaaaaaaaaaattaagcagtcatgctctcgaataatcttactagacataaacaatactgctagggtaggggggcactgcctttaacaatggtcagagtttcttggtaaatcagtggttttgcttctttgatgtttctaaaacactgatatgcccagttgccctgctctgacctcatctcaccctccccagcttccctccccacccacctcgtaaagcacagacctctcagcctgaccccttgctccctacctcactcattacttctggtttccttttggggccttgtcttctgcctgcccccagtacaatgtttatttttctgcatgtccatctcatcctgacaagcctctccacactggagtgcagccagtagctgtctctgctaagctcttccctctgcctgcatttctcaccccacacacaccttccatttcccagtggctacatacatcatgtgcgattatgcctgtctttcatgacctgcctctgaccagaaatccctgagtcatcttccctaaacccactccttcaaatccaccttccaaatcctggtgaatggactgctgtccctgctccagaggactgtgtgcctcaaacagggctccccacagtgggcctgtattagcagggattccccagtgcatgtttcctgccttggagaccatgaactccagggaggctggagagctgtctgctctgctttctgtcttctgcctgcccaagacagtactttatgtaggtgttaatttcctaaaaatatgtctaacatgcttgaattgctgatagctattgattaaagcccagcttctaatataaatatgcatttctgatgaatctcacaaaaaaacaggaagaaacaaatgccattaatttgcagtttatcaatatcctggctagtaattgagatatttagtggcatagtcactagaatataaggtgctagtcccagtcccaacacgagcttgagtaattttaaacttcatagtgaattttttgtaacgtctacagaatggatcaccattatcataataatagctgatagcgacggagcatgtcccatctgccaagcactggatatcattgattcattcatttataaaatttgaagttggtgggagggcatatttaaagactgctacctggaatagtgttatttgtcagagattcatttgtttgttctccacattcttcaatatatgaattattccatgcaattgaacagctccccaagtacgtcatagttatgaaatgttgtgtgttgactttggaaggttacagttcatttgtgatcttccaggcagcgggggtgggggtggggggattcttctctgtagtgaaagtgtttttctctgaaatcttcagctactttcctactctgtgaagccttcttctcctgggtcagtgggacccttccttgagagtggtttcagtaggttctccaaaaactgttcaactgagtaaaattgaatagaatagtccatgcattttgtcccaaggtataaaaattggctttggggaggtgaaaatgaaaccttacttttttttaatgtatcaagcaccaatacacatacagaaaaatatagtgtatctgtgttattataacatgttatggggatagactgttggggaaaaataactggaaaagcttttttgggggtgatcatgaatgaaatggttgagaaacactgagttagtcatacacagtatcagacaagtactgtgtcagtagccccagtaatttccaccctcaggccaggccccacatccagcacattctcgctcttctctagcccccacagccaggtcagtcttctagcccaggctccatcagcatctcaggttagagaaaggaaggcaagatgccttccacctctgttttccaggattgagaatatgctcacgcccctctctatctaaaggaaaggagagagggatggaccaggccctgtgttgccctcacaggtgccctgggcgccattttgtcatgagtggtcagcagagcccattgccgaggggcctagggagggtgccctcacagagctggtcccttcagttctgaattaagcagtagcctcaatgccatgtaagcaaccattcctgcaagaggataggcatttaaggtgaaatctgcctcatctgtcgttatttacaggtaagattcagaatagttcaagaaaacaaggcaaatgaattgcatttgcattgacgtgagtcatgccacattcagctactctttgtgaaaacgtccccaaaatagattcctcggagtgctgctttgcgggaccttcatcgatttgctctgaagataggtgtccatgcctgagaggcctcagtgaggtttcaactacacagttatccatggcagcacttctggaaacatttctgtgctaattgtacatggcaggtccccagttcctcatttaatgggaggaatctcctttttctggaaaatttctctggactgctgtgtcacagaacattctagaaaccccttacctcatgaacattctactactagacaatttagaattgaacgttaatatgggcatgggaggccagtgaaaacaacataagcctcacctggtactgcaacacatctttgtttgggaaacactgactttgcaaccacagctataaacaccggcttttatttcaggagtcagcagttactatatttgcaggaaggagaactgagggcatccctgtgaaaaccagaaaataaatccatcctgaagggcattggctttgtaggcctctcatcccctgttgagtaggttgctgggccatgcacaacgggtgtcagtatggaaaggaccaaggagaggaccgaagagaggcctctgcattgccagctgccacgtgctcaccacacagacagctcattggctcatccaccagctcatttaatcacgaagtcttttaatcccctccaggtccaatgaattccttaggcttttttctctgtgtttatcagttcccattataaatggcagcttcttctacatggcacatttggagatgacatggaaaaatcactcacacaggccagcaaaggcactctctttatgctgtgataatcctgtttggggaagccccctctgtagcttctctcaaaagcaggcaaacatcgctgtgcttttgctgtcctgacaatgtgtggagtcatattatacagcaagcataccacaagcaagtcacatctaaggcacctaaatgtggtttttccataacgaaagtgctgttgaaaataaacacaacttgctgctctacaggttagagcattttaatcccgtacatggctaatcttcccgagtctgtctgaagtcataatgtccctctaaacacacaaaaccgataggggcctcccgtcacacttgcggatcatgagtctcatgcagaaggctacgtaagatgaattgatttcacatgttttactcagaggatgtggaaaaagaaaatgattctagtgaccatctagaaacttgcggtttgtttttgactttaagacagtcagcacctttcagggccttgctgggttttcactggtttctgacagattggtggacgcggcatctgtaccattaaaagaggaaatcaggaaggttttttgagctgtcttgaagtcttttgctcaccacttaatttacatacatacactttaatatgcatgctaagagtgcccgtaatgtacttttattgagtaaaatgacacagagagaattcgttaggaagctttcctgcccaccccccaaccaagtcgttaaataactttttcaaaggctgttctctataggagaaggaatcaatttaggggtgtagttcattcatttacctagcttgtaactctaaagggttttgttataaacatgtttatatcaataatggttttatagtttgattttcagagcactatcgattcagtaaaacagtagctctgcggtgcacaagggatactgacctccacctcagcactattacttagaggaatgcagcaccatatgtagcttactagtaggtaggtggatgtttggatgaaggaagggagagcaggaggaagggagggatggatagattgataaatagggatggatggacagatggatggattgatgaataatataaacaaaagtactaattaataacaaaatacacacatacctcagcagtcattttgacagcagtacttaaaagtttcatgtttaaacaaacatctaatagtgtatatgtatccaacatgacaacattgtggtacttatttacagatcactgtctgacaaggaacatgaagtcaaacagaacttaaaccttagatatgagcactgccaatcaaaattaaaaacaaagtttaaggcccccttgaagttttgatgtctcaccatgtgaaaattgaacttcatattacaaaattaatgcataggaaaaaacctcctatgaaaaagcctggttttggtgatgagattcagatcatacatggctttataattgatgaatagttgtgagcagctgctgtactttctgtgcttccatgtaattccaggaccgcttctgggagccctgaaagtacccttcagtgacttccttccaaatgttgtatttcactaagcaaaagggaaagctttattccttagagatgatatagtaatatttggaaagctcactagttccaatgaagcacataatttaaaacagacacatcatagtttaaaaggtaaaatcggttacgaaatgtgatcccaagtaggcacgggcagcactctgcctgtggcctggaggaggtcccggtgtgcaggattggaaaggggctggctccttccctgctgtgactgttctgtctgcttcccgatgggacgtgctgttgatcccagctgctgagaagaaatggtgggcaagtgccacggggacaggatttgcagcagggaggagccaaaggtggaagcatcaccgggaagtgagacctggggaggaacacgagagcatcacaagccgcgggcccttctccttccctcttgaaaacctaacctagctcctgacactgcctcctactgtgttcccttcctgcccaaactgtacctagagctccatccatagacctcgtctgctcaccgcacagaaatgccagggctgccgggatcccttctcagcgctcctccttctgtgtaatcaactgcttctctgctctgatgacacctgaccgcacctccagctcacagccacagtgcatggagaccccgagccttctacttgggtgtcccacgatggcctcaaacccaacttgtcacaaaagctacctctccttcctgccaccaaaatg

SEQ ID NO: 5449 - DNA, 90365 bp, human
gaaggcgccaccatggcggcgcccccgcagcccgtcacccacctcatctttgacatggacggacttcttctgggtgggtagtgtgcagccgccgcctccagtaagggcggtcttgtgtgggcgtggggacggtcggcgcggggtacgtcacggcctgggggccgcggcggggcggtgttcatgcagggacgctcgggctcccgcgcgctctgcccccggctggccccgaagtcgggcggcggccaggagcgcccgcgggcccatgtccgggctggcgggcgcgcgtggccgcggcgtctacgcggccccagcacccgcttccggtcggcggcccgcgcgtggggccggagcacgtgggagcagtccctggggtccaccgggcgggcgcgcggctccgcgtcctctcctcagagcgaggcgcggcgggacctccgcgctctcttttcggttacgcatgcgtgcgaccttgagcggtgcccagcctcagcttccccgtctgcaaagtagcctggaggatacttgcctgcctgctccaaggttgctgctgtgggcgcactttgatggtagcatcctgcatggtagcggttctctacctggcggttttgcagccctgagggcatctggcaatggcgatgtcaggagacattttggctgtcacagctggcgaggagtgatggggtcactggcatctagtggagtccagaccagtgatactgttaaacttcccgcagtgcacaggagtgccctatgcaaccataaggaattatcccgcgccgtcaacagtgtagaggcacagaaggtccgtcaagtggcctggctgcctagggtgaccagcaccggggacatcacctgtgggctacttgtaaatgtagaagctggggccccaccctacccctgcccaatcagaatctgcattttaagcgcgtgaacgtttgagaacagctgctctatcaatccgaggcattaagaaacccttggcagtgtactaaggtagtcagtcttagcacatgtgaacttcaccagccaagaggaattcaagtagaattcaaagaataaaaccctgtttttaactcaagacagaactatgctgagctctaccgaaagccttgacacagttaacactatgacacataatcaccaggaggcttcatatatctataaacatgtctgcatactctttgtagacagctgacctgcttggttacgtatatcattccttcatttcaaaaccctgcaagttaggaggaagtatttgcatgtcactaattaaaaaaaaaaaaaaaaaaaaaaccctgcagctcagagaggtaaagctacttgcccaaggtcacacagctaataagccaagctgagaaacgattctggattgatccagttctaaatataaatgatgttgagctcatcttaaattgtgaatgtgaccttgtttctgctcatcatattgctgggtaattccctagcagtgtttccttttaaaaaggcatgcagaaaccattctcttcattttatgaacacagaggtgtaaactgatgaattccaaaggaaaaaaaaaatccccgtagaggtcactaattggagccaacggtgtatgcagctactaaatttgaaatgactcaatttcagaaagcttgtgggatacataggtatagtttgtagacatgaattttcctactccggtggtcaaaaagttaaattgtcaaataaatttcttatcctctaataaaggtccagagaacctgttctgggagtctcatgaattttaataccaaacaagatgtctcattaaaattaaatttattaaacttctaaatgagcttggtgcctaattctgattctagattcacacatagccatgccctgaagtgatgaatgtgacttaaatggcattacaagcattgacctcacattgttacccaatcctctgatctagtcagataaccaagaattagtgctatttggaaaaataagccctgcttctttttattcccccccctcattttctgcccatttcctcctttcctgccctacctcttctttgaggtggtaaggccttgcaaaactttcttggaaatatacctttgtttatcccattctttcaccaaatgtgtaaatataaaacacagctttccaagatgtgccactttaatttaatctaccagattatgcctgctgtcattctttagcacctcacttcagtgtatctgttgtttgcataacaatatactatcaatttataatgagttattttacaataggtctgtttttcgggaattttgaatgcatttttctaggaagttctgtttgtctatgtagccccaatacttgcatacttggggaagtaaaattgaaaacgaatagtttcatggaggattgttaacattagaggagaagattgtttaatcagaggagaatgaggaagtaaatggagattttagaggaaatgttgaccaggaagaaagccaggacactttcccatgcttttgacatgcacgatgctgttagttgtcctttaaaaaaaaaaaaaaatacacttcggtttctgtttctcatgaccaaggtaagagtcagttatgatttaggtaatattaataattttggctctcaaatgccattcagagaaagagagtaggggagtgggattagttaaaaactgggatgattttgaaataagaagatgacaattattaaacagtatctcagcagctggacagggaagattattctgtttgtaaataactgaaattaggaacacaaaagatggtcccaatttctttaaaagagaagacagtttgttgtccagagcagttctgtctcatagaattgagccaggtaaaaattttggggagcaatttttaataagtaaaaagatacagatgacattgatttggatgatgtatgttatgtaacctaatgtatcaaaaatattatttaatacaaagtcagtataagaaaatctttgaagtgtttgacattaattttgatactaggtcctcaaaatctgtgtgtgttttatacatacaacacatcttagtttgaactagcctcatttcaggcactctgtagcctcatttggtgggtggctactggcttggacagcatgggtctaggtctttgtggagcaacccaagatgtctgttgataatggctatgctgggagggtcaggcagagggtgggtgttaagaatattcagaattaggagttttggtgtatgtaaaatgtggtatgtgtaaaatgtgttttcttggagtctaatacagaattatttaaaatccttttaaaatcaaaggaaaataagcttatttccagtttcttaaatatcgtaaaataataaggtagatctgcgaagggtaataagaacatttgcagtgttgaccataatataccatatctttataaatccagattgcaggattttaatgagtgacttctacttcacctttagtaaaatgaagacctcttctgtgcctttttgcactcccgtagcttcctccttgccaaataatagcacttgagactataagtgcctgcctcactgtctggggcccaggagaccctaaaaggtcatggaggtagggtctctgtggggattaccaagcccagtactgatgggattgtgggctgcctgagacagttgacagtcatgtccactgtgtggccaaaattccacagacatagcgtgagtgtgttttgcgctgtcattctttgttaacttcatgtaggctgtttctttagacaccagaacatctatatagctgatgacaaaaatagatttttcttacgtaatattagcgcatgccctaggtggattgtcagaagaatctatgtatgttgtcatttgaccccatgaaatacgtctgaggtttaaaagtgcagctgacaagcttttcagcctcagtcggttcttactacttgatgttatcaagtcattcattccaagtgggatttctaagagttttggcacatttctgaggaaggtggagcaaagtgaaggatcattctgcatgcttccataggtggttattgtttaaccccagaacgtgcagtgatcctagttggaatgagatcgtaatcacaatctcccctccttccatcatttgtaatgggtcttgctctggatgtcaaagcaactctggtggtaggttcacattctttctttgccctgtcttccctggaggctgacagtgtacccttgggttttacccttgctaggtgaaatgtaggttctcttccacgtttgcaaaggagatggctgagggtggaggccagtgtgagggcttgggacagagatgaacccttatctcaggggccatgattggcctttcactacagggtgatcaatgagtaatctgttgtttctggaaactgaaaaggcttctggaatatagaaagcacaagacacgtgtgttcctattaagggtccgaagagatttagagtaagatgctatattgtatgttggagaaacagcatcagattatagatttagctccgtttggttctgttttctaattgacctgaaccatgccaaccttaagttcttgtagtaagtggttggttgtccactgcagctgtttctgtttctagaataattgagaagggggtaaaacttaaattgcaaaattctgcagataaataataagagttttgtccagctggcaacacaaatattcagcagattctaggcatgcaggtgtaaaatatccttttcttttttctagctctctctttcaaataaaagcaatatggttttatttagaatctttaagtaaactggatacaggcatgtgtgagaactattgtgggttcagttccagaccatcacagtaaagcaaacatcgcaataaaattagtcacatgaagtttttggtttcccagtacacataaggttaggtttatactatactgtattctattaggtgtacaatagcattatgtctaaaaaatgtacataaccttaaatacattttattgctttaaaaaaaaaagtgctagggatcatgtcatccttcagtgagttgtaattcttttgctggtggaaggtgttgtcttgatattgactgttgaccagagtagtggttgctgaaggttggggtggctgtggcaattttaaaaaataaaacagcaatgaagtttgccacatcacttgattctttcttttacaaaaaaattctcttttggcgaggcatggtggctcatgcctataatcccagcactttgggaggcagaggcaggcagatcacttgaggtcaggagttcgagaccagtctggccaacatggcaaaaccccatctctaccaaaaatacacacacaaaaattagccaggcatgatggtgcacacatgtagtcccagctactcaggaggctgaggcccgagaatcacttgaacccgggaggctgaggttgcagtgagccgagatcccaccactgcactccagcctggacgacagagtaagactctgtctcaaaaaaaaaaaaaaaaaaaaattggagtcctctcaaactctgctgctgctgctttaccaactaagtttatgttaatatagtgaatcctttgttgtcacttcaacaatgttcaacaacatcttcaccagaaatagatttttatctccagaaaccactttcttttcgcgtccctaagaagcagtgtctattcagttcaggtttcatcctgagattgcagcaactcagtcaaatcttcaggcttcacttctaattctagttctcttggtatttccatcacattctgcagttacttcctctgctgaagtcttgaacccctcaaagtcatccatgaggattggaatcaactccttacaaactcctgttaacattgatattttcatcttttcccatggatcatgaatgttgtgaatggcatctggaatgctaaatcctttcctgaaggttttccatttactttgcctagatgcatcagaggaatcactatctatggcatctataaccttaggaaatgcatatcctaagtaataagacttgaaagttgaagttactcctcaatccatgggctgcagagtagatgtcgtgttagcaggcctgaaaataacacgaatctccttgtacatctccatcagagctcttgggtgaccaggtacgttgtcagtgggcagaaatattttgaaagaaatatttgtttttgagcagtaattcttaatagtgggcttaaaatattcggtaaaccatgctgtaaacagatgtgctgtcatccaagctttgctgttccatttacaaagcccaggaagagaagattcagcatcatttttaagagcactaggattttcagaattgtaaatgagcactggcttcaagttaaagtcaccatctgcattagccactaacacaaaagtccgcctgtcctttaaagctttcaagccagacactgacttctcctctctagctatgaacgtcatgggtggcattttcttccaatagaaggctgttttgtctacattgaaaatctgtttagtgtagccactttcatcggtgatcttagctagctctcctggataacttgctgcggcctctccatcagcacttgctgcttcaaggagctgttcaaggacagagcaaggagcaattctttccttaaacctcatgaacttctgctagattcagacttttcttctgcagctttctcacatgcctcagtccccatagaagtgaagagagttagagccttgctctaggttaggctttggcttaagggaatgttgtgctggtttggtcttctacccagatcattaaaacttcctctatgtcagcaataaggctgtttcactctcatcattcacgtgttcactggggtagcacgtttaatttccttcaagaacttttcctttgcattcacaacttggctaattgggtgcaagagacctagctttcagcctatcagcttctgacatgtgttcctcactaagcttaaccatttctagcttttaatttaaagtgagagatgtgtgactcttcttttctcttgaactcttagaggccattgtagggttattaattagcctgatttcaatattagtgtgattcagggactagggaggcctggaggagaggaagagagatgggggtctatggagcaatcagaacacacacaacatttatcccttaagttctctgacttatatgggtgcggttcatggtgccctaaaacaatgacaatggtaacatcaaagatcactcatcacagattgacgtaacagatgtaataatgaaacgatttgacatattgcaagaattaccaaaacgtgacacagacacgtcacgtgagacatgctgttaggaaaatggtgttgatagactttctcgacgcagggttgccaaaaaccttgaatttgtaaaaactacaatctatgaagcacaataaaataagatatgcctgtataatatgggacagcagtgcatcgttttgttttgttttgttttttgagccagaatctatttttctccttgaaaagctatatattagagattatttggtcctttttatctttgcgattattcactccttactctgattctatttctttttttttaaactgctataatttatatactattttctgtcatttttcaggagtagatggagacttaaagcaatgtaaaggagcaaggtaaatgatatctcctaagaaatgtcccctgaaagcactccttatatagatgctcaggcgactggtcagaccttctgatgagatgtttgaaaagtgattgataggcagtctgtaggtagaaagcacaatagtgttattctggaatacattacgcttgaaaataatgctcctaccatcggctataagggaattttagtgattaataaatgcagcatttaatatattaagagcttccttcaatagtgttaaaatggtggaagggggcaaccttgattttgtgttgcagatatttgcagtttaaaattgccttgttggtgcttaaagagcatttttttgaagacatagtaatcctaacacatgcatttctactgtgtaagagcacaaaaaggaagacttttccccatggcttttcatagctgggccatccatgtggcttctcttcacatcccttttcagcaatgtctggcagatagatcaccacctttcctgatcctcctttatcctctgtctcccttgtgtcctttgctgtgatgccaacagtgagtagcagctaaggaccctggtgcagctggccacgtggcaaggtgcctgcgtatgagaggaggatggtcacctcttcacagccatgcctggcaggcagtttcatggcattgcttgtggcgcttggtggggcccttgactcttctctctctgagctctgggagctgggccgaatgatgtgcccttttgtgattgatggtgccttatttaaaaaacactgcagatgacatagctgttcaaggacagagcaaggagcaaaccaaagtttgctctttgactcccaatagactgttccatgtgtctatgaagtaagagcaaatggtcatagttggcacatcgaagcttatctgagccttcagacaaaagccaaaataagcaccaaccctctcccacttgtgtcagctgccatgcacatggaagagaagcacatggtccttgagcactgtgcgcctgtctgctctctagcccagcactgtgtatccagcaaatcttcctgccaggatggaaatgttctgtaactatactgcatccgatgggagccacagctggaaactgggttcatgagatgtgactcatgcaactgaggacctgaatttctcgtgttatttaaatagcccccaatgactaattgccaaaacgtaacatagagacacaaaatatagagtggacagcacaactctagaggaatgcattcactcatccttaatctatttagaaaatactctgctgggtgttacaaaggcttcaaaattagtctcttcctttaaggatcttagagtcctgctggaatctaaaacatgattggtaaaatctgtgaataattgctaatgatatacacaataagaatgtgttagcaacagtgcaggattttgaactgaaatcacatttggggtagcatactgtcaaggatagataggagccaagaagaaaaatggatattccagaccaggagaaatggccaagccataggcatctttactaaagcatagaagagagtcgttttttgttgttgttgtttttatcaagcaaagactgtattaaaaaagatcttgctaatgattacattgaagtgtggaggtgagaagagatttgaaaacataataatcctaacacatgcatttctcctgtgtaagaacacaagaaggaagactttgttttccccttgggtttgcatagctggagcacctgtgtagctcctcttcacatctcttttgagcaatgtctggcaggtagagattagaaatctctaatgtttcattgagaaatacgagactggggctggggacagtggttcacgcctatcatcccagcactttgggaggccgaggcaagtcgatcgcttgaggccaagagttcgagaccaccccggccaacatggcgaaaccccatctctactaaaaatacaaaaattagtctggcatggtgatgcgtgcctgtaatcccagctacttgggaggctgagacacgagaatcacttgagcctgggaggcggaggttgtagtgagctgagatcacgccactgcactccagcctgggcagtagagctagattctgtctcaaaaaaaaaaaaaaatactagattaatctctgtcaggctaagattagtatttcttaaactgggtgcccattggtaatatccctttagcctattttaaagtgaaaatctcaccccatcctgcaagcacacatcctgggttttccccctatgactttcagaagagtctaggatggttatcgagacaccagcctacattctggatttgtctgattgtttccacatgataccaccttacttgttcctctgtcccctgtatttcctctaatctagaaattatgcctagtgcttcagttggacacaggtcagctgcctctggcaagaataatgctgtgccccttcgtcacctttttggggagatgtttgtattcagtctatatagggtcagtaccttcatgctagccccagccctgcagagtagagttgtcctcaggaaagctggtgaactgactcctctcccatagtggtacatggaactttttagtgagaagttcagagcctgagatacaagttagaagtactggctataatgcctgtgtgtgtggacagccggaacccttaggcaggaagaggaggctgccggggacagaggtgtgccatgctgtgcacccttcgaagagaaggtactcacaggaacctaaataggtttcacgtgtatgggttcctctgttccatgcagtgggatacaggaaagaaagagcagccatgcagctgttttctcactgtgtcggagcacacaccacagtctctttgatgtttgctcatgagattgaaggacactcatggctttgtcacaagatgcctgagaaagcacagaggttttttgtttgtttgtgtgtttgtttttgagacagaatctcgcactgtcgcccaggctggagtgcagtggtgcgatctcggctcactgcaagctccgcctcccaggttcacgcctttctcctgcctcagcctcccgagaagctgggactgcaggtgcccgccaccacacccagctaattttttgtattttttttttagtagagacagggtttcaccatgttagccaggatggtctcgatctcctgacctcatgatccatctgcctcggcctcccaaagtgctgggattacaggtgaaccaccacacccggccttagttttattttttttttttgagatggagtctcgctcttgtcacccaggctggagtgcaatggcgcgatcttggctcactgcaatctccacctcccgggttcaagcaattctcctgccctagcctccctagtagctgggattacaggtgcctgccaccacacccagctaattttttgtatttttagtagagatggggtttcaccatgttggtcaggcaggtctcgaactcctgacctcagcacagagttattaaaatcaaatgcagttgcctacgctttgtctgcttttgaaaagtaaacttaatgtttcagactgaggtgtatttgtcattggggtcctatgttctgcacagtttgtaaatctacttcacccaaagtgatacagtgatactcaggagggcttaaaaaagattaaatccttcatttggaaacatcatgcccagtgaaaggaacacaggccctaaggagatgtggctgattctagggaccgggaccagtaaaatacaacatgagcacagagcactttctcatgccaggatgcagtgggcggggttgggggggggggtcccactggcacaatatgaaccatttgtaatcaaaagaataatgaccagaagagagtataatactctgtctatatattttttaagtctctgtgttatgattctcaaaagagtaaaagggtggctgggggtgagctcttttacagaagaatgccagttaataaatatggacagaatgggagaattagccaggtcaccattttgggatcccgactgtaagtggttcccacaagcattgtcagtggaagccaaaatcatagagtaatcatgcaggagacgaaggtgcccgcagtgccatgtcagaagtcactgactgataacagaggcaaacgggccttcagagcgggcagctctgggggccacaattgaccctgtggcccaactgatgtagctttgccatccagaaagcagcatgtcacgtcacgtgtgctttctgaagtgacctcagaaatggttaacctgaatccatctggacctctagcagtttcagaggggtagaggaacacgggagggggtgtcatgtggaaacagcaagacaaatcctgaatgtaggatgttccaccaggtacctggactgggtccttgaaaatgttgactatcatggggaaaaaataggggctggcttttccacttttaaagaggctaaagggacatagtcaaattcagtggaccttagattggggaaaaaaatctataaaagacatttttgtgacaattggagaggtgtgatgtgtgctatttagggggtactatgaaatattgctgatttgcctgggtttggcagtggtattatggctgtgtaggagagtgttattctgaggagaaacgtgcagagagctagaggaatgaagagttagggcatctgcatgttttcaggtgtgttgcgtgcaggtatagggtatgtagatgtttcctatcctactattgactcttctgtatacttgaaaagttaaaataggaaagggaagattaagtcttaagcatgaaccactaaaaacaaccccaaaagcagtattaagtagtagtcagttaattctgtttaagagacaagaatgtaaagcatgcatctttagaaaattgatgttggagatatggaagaaatagtttcagaaccttcagctctctcgaacattacagtggcaatgcattcattgcaatgtgtattatagcagaaaacattctgaaggaagagtcccatttcctagtgctcatttttcagttcctcgtctctctcatagtgcaggagatttgtagacaaatgtctacaggatttagacagatgtcaggaaaattgtcttttgttgatgtcttaattggaatccgatagtttgtcagggcatgatgcttataaaaggaataaaagctttctaaaattcttcaaagagtagccactggtacctgtgtgtcacatcatatgctgatgagacatgacagaaaatgctcctaagtagccttatagctgatcctgaggagctactgtgactgggctctcactgcacctctcagctgacttctgcctactgggtctgtgtcatccctttttactctgaggctaccaaggtcttaggaaactggaggttggagcttgaactgagtgatgggaggaaaagacttcctgaagtgctgcccacatctcatgtatgttctcttggacccagttgtatccctgccattccctggaggttacctgttcatacgcagacttctctttcccttatttacctcaattgcagtagcttggcaaccttttaactcttgctttttaaaaggaaaattatttggttatcgtagaaacattttgtgcagcaaagtgttacacatatttctgttctggcctcaaataatcatggatttcattaaatactaaacattttgctgattttaatacagtgctttagtgtattcttattttctttttgcatctcttatttgcctcgtttatcttaacataaagcatttcctttggttaagtagatccttatatctgctttttctttttgtatgactcctatttaggttggtgctaaagtaatgacggtttttgccattacaatacctgtagacataaaggtctagcttactttttgccatttgctaccctgtgtttagtactggcattttgctgactgctcatcagcttttgatacggtgtgcttacgtgacaagctctttaaagtgaaatcataatcagatttgagatttagaattgaggcgacttgtcctgtctacagtgaaactgaggcaggacaacctggggagctatgaatagtaggaaaatcccagtgaaaatccagcacttctaacttctactcctgggcgcttcatcacttagagttaccagcagtcttggtaccatttgttcatagttttgccagccctcacaggtacaggtacaattgtagatactgaaactctcaccagctgacatctaatttaccagctgatttaattttatctcattgatgattgagaggctctactgatagcccaaaaccactttagcttaggtgaaacatgagctgcgttggtaactgaagcctggcccatctcattgacaacttacttactgtactgatttagtaaaattacccatcctctgtgtccccgagtatggtttgcagcatatcacaggcaatgtgtgacatcttccaggatattgcatgcctaccaaaatataatcagattaaagaacatgttcagttcatatctgacctacggccccattgcactgtttaacatgattttgcaacagagatgtaaccatctgcacatgttatgcatccccttataccattagggtttatgctgagatcaagtaaaatcatatcctctcatagggaggggacgggacttctgtgaagtagcctgaagaaattaacatctttatatgatcacatctataatacagaataataaatgccatgtacctgttgctgtgtttattgcttctgctggctgggactagtgagtgtcccgattttaaggacgtgttttgaaactggcttgtctgtctttctgcctctcttctcagccaagtgtcttgctaaagtgggctgtgtttgccgaactcactcccccattttccttccctcgctatgagctggctttttggccctaccactcacagaaattgttctgacagaggtagcagtgatgtccgtgctgctaggtgcagagggcacccttttcttaaattgccagaacttccggcttcctttgccgcttctgcaccctccttggaaatctttctctttggcttcacggatagttcctcttctggcttccccatagctttcttttcctcctggtgcctgtttggcgtccctatggctttgttatgggccctgtcctcttgtggaaacctcttctgagctcatggcttcggcacatgcttctgctctgatgaccccttgacctccctggctgggcctcacctcttttgagttcctgtctacgtttcccagtgaccacaggctcttcctacccgcgtggccaagaggcagctctgaagcattgtattttaaacggggcctctagttctctgccagatctgctcttttcctgcattccacaccaggcagcaaaccccgaaagccccacagcagatggctgggagttatcttccagtcttcaattccttgccatccccacccacaccttccaggcacctcctgatttataaatatttcaaagccacttctgtgtcattccagctgccatttcctgcttcaggctttcaggcttttttctgatctaatagcaatatttactgagaacctttaccacatgcagttctgttggttacctgcagtgagatcagtggtggctgtggggttttgatgctcatgagggtgaaatcgcagagttctggggcccaggtgtatttgcatgaggtggctttggtgagagcatagccttcaccaggatgtttttggaggtttttctcctagtgtattttcctagattcctttgtcaaaggaatttggtcataaactggcccttaagtactttctaagagaagccttgttcatgtggatcacaatgaccttagactttgtgtgcgttgtcagtgctgccctctcctgggcattgcttctgcattcttaatgcaaatatgtgagttattcctgggtgtggctccatgacttgttcctttctggaagctctagccttatctcagccctcatcttgttaaaccagttgtgctgaccttgcttctctgacagcaacctgataaaagcctgtaaagttgcccacttcaagtcattgagcaatacaggtagccaagcagtagaggtggttacaataaatggcttaacattcccagcatttaggtggctccattcagatggcggaaggcaggtggcactttctgttgtggagaatttgaggagagagctttaagttcaaaaggaatttaagaaaagcctaagttggatctatgagggctctggaggagagattgagatgttcagggtgttccttcgattcatgaacccgactgacttttcacagcaggaccaccagttgccagatactgagacaactgagtcaaatgaatacaacagcatccctgttcttcaggggactgcaggcaggggtgctgtaatttgtacgggggcgggggtggacatgatctgttcttctatattatcatcattcatctgctagagacaactcgattttcttgggagccaggaaaaggaagttggccagtcggatgtgcctcacagcagagcaaacgcatcccaaatgagccaccggaagggttggggagtcactgaggtggaggaggaagggctgagggtatttcaggccaagaggactcggtgagaggcggagcacaggtaaaaaggcctgccaagggcagatggcggcgagccctgtgccaggctaaggaattcacattttatctcgtagccatcatacagcctggcgagcacacgatgtctagaagggtggtgcttctgatgatgtggactgttggcgcttagacactggagactggtagaaggctgttgccattgtccagatgaacgatagaaggactgcatgagttttccacaaactggggggcctaaaacaacaggagattactttatctcagctctggagacaagaagttggaagtcaggatatcagcagggctgcgtttttccttggcttgtagctgcatcgctccggtctcagcttctctccacgtggccttctcttctctccttttgtctcttataaataaggacccctgccattggatgtagggcccaccgggataatacagagtgccacatctccagatccttcacttaatcacatctgcaaaggtcttttttccaaataaggtccgattctcgggccctagggattaggacgtggacatatatttttgggagccacccttcaactgactacaaggacccacagggttggaatgaaaggaagaaaagtggctgattcagaggccgttcagctgacagctgggcatagagggatgggagggagaaggcaggtgaatagcagtgacttgtcctgaagtcgaaattagaggaagctgtgaggcctgaaaatagggatgagttccattttaggcatttggacatgttgagtttcaggaaactgaaagactgggcacctcttaggttgacagcattgatggaaacaaccatgatttcccatttaagacaaacaaaactcttggtgccgttaacccatgaagaaaactgacataggtggccatcgacctacactcgtctttgaacagctacagtacctagaagccattttagtttttacttttattattattattttttgagacagagtctcattctgttgtccaggctagaatgcaatggcacaatctcagctcattgcaacctctgcctcccaggctcaagtgatcctcctgcctcagcctcccaagtagctgggactactggtgtgcaccactgcacccggctaattgctgtatttttagtagagacggggttttgccatgttgcccaggctggtctcgagccgtgcacccggctaatttttgtatttttagtagagatggggttttgccatgttgcccaagctggtctcaaactcctggactcaagtgatccacctgcctcggcctcctaaagtgctgggattacaggtatgagccactgtgcctggcccctggaagccattttaaacttatttctaagtccccttcctcagagagaatacatgcacacacacagttggataattagcctaggaagggtctggaaatttagccatatgcccaccatgttttgtcctcctcctccttttgtgtgtgtgtgtgtgtgtgtgtagtatgtgcatctctgatacaaagggagcagctctggatccctagtcattctccaatcagcctccgaattccccctaaccctgcatcaaaacctgaatccccccaaccctgtgtgaaagcctgccacttcaggcttaatctttgttgacacgtaagggtgccgaactcacaactttgaagtccttttattctactcccttctccttttctcatcccagctgggttgtaaatgtcagggagaagtagagggcccagtcctccttcctggggtagggagattatttaaccatgggatgcaccatgatttccaaacacagttgattttccagagaagggagtgaaaagaaaagtgctttggaataacctttggactccacgcaccatgccggggataaacatggaaaataaccatttgttgggcggtgctccgtgtcacatattctagtatgtagttttatacccagccattgcccttaccctttcgatttttgttagagcgggacggtgccctgcatgctgtgtgctgtctgagtatgacatttctagtagtaaggaaggttaggatggctctttcctttgccttcattaaagttctcttgcccagatgtgagatctttaaaaggtcagtgtttttgaataaggaatgaaatcatattctaagataaaagttcagagagttatacaataaaataataaattagtaaatggcacttccctgagaggcgatggtcactggtcactgttgttgcatcccattcctcttgccttcagggaatatcccctcaggtatgagaatgctcagggctcaaagacagagaagagctgtacgtcacactgttggggctggcagcaaaatgctgagcaaccttgggctctacaacatgtcctccatggaggtcaggctctaggcctgttctgttgactgctggagtctcaacattcagaacacgggtccaacatggcatgtgtattgacagagaagcttcaggtaatttttatgtccttgaatgaatgggcacatgttacatgacagagcagggactagatggagccaatatattagatccccttctctccacacctcattttctatatagtgcagccagtatgagaatataaaatggaaaggaagaaggcatatcattttgtatgtgctctatgatctttaaatgttattaaatgttggtaatgaaatgctgtggtataactaattatatcctagcacctctttcccatatacttgcattctctaattatgttcaaagcaatggttgcccgaaggctaagggtactcggtcctttcctcccccatgaggactatgttttagcttgtaatttcacctgcaggagctcacaaaccagctgcatttgagtgcaattatactttattcatagtgactaataacagaaaagagacatcgtgggggtttgggctggagatttataatctcatataaaaaatacgaattcttgcttatttatgggttgagcaccttgggcccccgctgtttcatctgatggctgcctgatttttatccgcaaaatcattcattagtatctacactagaatgtaaacacagaatgtaagataaatttgttgtgcagtacttggatagttagaacacatttccccagatagaaacattaaaactagaggttattcactcccatattcacacaacctttatgcacctgaggaggttccgaatgtccctgaccatctcttatttcttatgggaaagtgtttgggtaccagcttggaatgccaggagtgtaattctccagggcagcgactgccgcccgtgccattgggtccctagccctttttcatgctctgctttctgatgagcttacacacacaggcatggtgtactgtgggtgcttagtattgctgtaggacttcttgtgtcctgagttcaccactaccctttaattctaaacatttataaactattgaagttagattcaaaactttcttttccctaagcttttactttctgcttattctgcttataaattagtaaatgttggccgggcgtggtggcacacatctgtaatcccagcactttgggaggccgaggcatgtggatcacttgagcccaggagttcaagactagcctgggcaacatggcgaaaccctgtctctacaaaaaatacaaaaatcagctgggtgtggtggtgcacgcctataatcccagctactcgggaggctgaggcatgagaatcgcttgaacctggaaggcagaggttgcagtgagccaagatcataccactgcactccagcctgggcaacagagtgagactctgttaccaaaaacaaaaaatctagtaaatgttaacagtcactgttcagaggccataacagtgtttgagtctcaacctttacaattttttcataaacttcacctttatactgttaactcacacttacaaaactctaatatattttatttctttgttgagtacttcagttgtctgaattaaagaatgaaactcttttagtcaataatcatcttaaacataataagtttataaaaatgatgaacctaaaattcttaatatttcaacatcattctgatcatgccttaaattgcaaatgtaaataattcaggtatgcatttaaatggttatttattagcattattgttctcataggccaaattcaattaaaaagtacaagtaataaaataataagtaacatggaaaatgtattcagtggtcttgctgcttttaagcatccctctaaatgatttgggagttgagagatgtctgttcattaaggaaaacagttccctcccaggtactttacattcccatgcaggtgattagagttttcatttcttaaaataagtaaatatctttccacctaactccagtaatctttgaacttgggaggaattctccattcttttatgcttctcaggtcagtacaagtcgtaggtacagctattaaaaggatatctgattgaattctggatatctttcatgtagtttgactgacagtaacacctcatagggccacattactgacatagttagaacattgtgctagccttagttatgtgtctgccaagcccctagctgttcaaagaaaaggcggtctcttaccagctgtccttccctggtaattggagctgtggaataaaggtcagttgctctttgagaatgtgagtgagcatttctgactcctcatccttcagtgcccccatgtgtggaaggcttggtaaattgagctgtgcctgcagttaccaagctatgcctccttttgtcaatataattcccactttgctactttgggtaccagaggtacactctgcatagcaggaaccataccctatgctttttggttcttttgagaaatcctaggtagaattagatacataaaatctgagatactcgaaccaatttatacatatgcaaatatgtattctttaaaaaaggatcttgatccttatttcttagtgatcttcttcatcccttccccatgttaagatagcaccttccattaacaaactgctcttgccttttatataaaaaaataaaaattaaaaaaaccaagtagatgaagatgaataacccagtgttacgggctgagtcatgtccccctcaaacttacgtggtggaggcctaaccccaggacctcagaatgtgactatatttggagataggtctttaaagggctaaacaatgtcctaatccaatgggactggtgtccttataagaggcgattaggacacagacacactacggacaaccacgtgaggacacagggagaggacagcatctactaaccaaggagagaggtctcagaagagaccaaccctgctgactgactctgatcttagacttccagcctccagaattgcaagaaaattaatttctatgtaagccacccattttgtgttattttgtgatggcggccctagcaaacttacagtcccaagaatctaagatttttgattgtgtgaaggatcaagccatctggaccaatgttttcctgaatttctgggcagacctttccaggaaggtgggcagcaaatggcccaggtctgttcagttagaggatcaccagagaagtttctccattctcagctcctatcatctttttacagctgaattttctgacattcctccacccccaccagcacacaaaaataagtgaaccaaaagcataacagctaaagaaatattcctgtgacatggtcactcatgtgtctttaggagagaagcactttgtactgtgtattgctgtttatattcttaatgtttttcttacatttcatgatgatttacattgccctaaattttttaaaaatgtaattttggcattatcttcatatatatgcatatatccctggtggtaattcctaacaggccattgatagggaatgctaagagtaaggatagtgatatggtttggctgtgtccccacccaaatctcatcttgaattgtagctcccacaattcctgtgtattgtgggagggacctggtgggaggtaattgaatcatgggggcaggtctttcccgtgctgttctcgtgatagtgaataagtctcatgagatctggtggttttatgaaaaggagttttcctgcacaagctcgctgtcacgtctgccgccaagtgagatgtgcctttcatcttctgccatgattgtgaggcctccccagccacgtggaactgtgagtccattaagcctctttttctttataaattacccattctcaggtatgtctttatcagcagcctgaaaatgactgatacagatagaaatggaagggtagcggagggcctgtcaccttcactgaaaaagaatagaagtgattgagttttggtaggaaagatgatctttaaataaagcctttgtgcatgttgtggaggacagttgctggttttcattaattcaaaaggcctagggatatgtgggtttggcattaatctataatgcctcagacactggaaaactagctctgagaagggtttaggcaaagtgacatccatctagagctctatgtttgtatatttagctcttaaaattcaaaaagaatttagattattgccattagctaaatggaagcatcatggtgcatcaataggaaatgggaaaaaaaatgattaatagtatttatacatatgtgttattctgtagcaataacgaaggcctagcatgctggggtttgttttcattttgtgaggactatactgtgctgttttttagtaaactggtgaactgcctcagataaattgtcacacatagttctgtaaactctgcctgtagctttcattgactttaggttgtgaatgaaacgtttaaaagtttatttttatgttttttttatgtttttttttaatatgtttgaaagtcattgtacagtagcccgatgagggaaaaacaaaaagatagccaaagttactttttttttgagacagagtctcactctgtcgcccaggctggagtgcagtggcgccatctccgctcactgcaagctccgcctcctgggttcacgccattctcctgcctcagcctcccgagtagctgggactacaggtgcccgccaccacgcctggctaatttttttgtattttttagtagagacagggtttcaccgtgttagccaggatggtctcgatctcctgacctcgtgatccacccgcctcggcctcccaaagtgctgggattacaggcgtgagccaccgcacttggcaacaagatagccaaagtttcttaaatgccttctatttctattgctgctgtaacaaattaccacaaactgaggcctgattttaccaatctcttggtaaaatcgggtgttggcaaggctctgtttgtttctggaggctctaatggggaatgttttcttgccttttccagctattagaggccacccacacgtcttgactcatcttcaaagctagcactgtttcacctctttgaacatacttttttagtgcagacgtttgtagccataatttccctccacgcagtgcttttgctgcatcccataagttttggtatgttgtgtttccatttttattcttctcaaagtatcttttaatttctctcataatttcatctttgacccacaaatttttaggagtatgttgtttaatttccacattatttgtgaatttcccaagttttcttcagttactgatttctaatttcattgttgattgggaaaatatatgatttcacttctttgtaaacttattgagacttatgacccagcatatggcctattctggataattttccatgtgcacttaagaataatgtatattctgttattattgggtcagttttgtatagatgtctgtcaagttttaatggtttacagtgtgtaagtggattaaatcaagtcttgtatttgtcttccgtctagttgttctgtccattgtcaagtgtggcattgaaatctccagctactattattggaatcagctatatcccctttcagttttgacagtttttgctgcttgtattttggggctctgtggttaggttcatatatgtttataattgttgcatcttcttgatggggtgacctttatcactataaaatgtttccattaaaattgtttggttttttttagtgaaatggtttgtcctaagtctactttgtctgatattactatagctacttcagctctctttgggctgttgtttgcaaggaatctcatttccatcattttactttcaatgcttttgtaccatttggtctaaattgtatctctattgtagatatcatatagttagatcatgtcttttttaaatccattcttcaatctctaccttttaattggcgtttttaatctatttacatacaatgcgattattggtaagacaggatttacgtgcggcatgctgctgttttctgtgttaagtcttcttgttaccttatttctttattactgccttttttaactttagatattttttagcgtgccattttaattattctgtcctttactgtatttcttagtgattgctctgtggactatgataaacatcttaaccacttattttaagtagttcacaaacctctgctcctatgtagttccgtttccgactctcttatttctgttgctgttgtcatacaaattacatgtttataccttgtttgcccatcaacacttataatttacttcacacaaaatttgatttacaaacaaaacataacgtttatactgtctttaatatctcccaaggggcaaaagcaaagcccagttgtgagccattgccttaaagtataaaaaataagtgttacagcattcttgtcctttatctcattttaaggtaacttagcacgatttagaaagaacaccagagacgtttttttaattggttattggataatgagaccccaaaaaaccctggataaaaaatgttccatttttaagtgtttccaaatctggcttgatagtttccagaacaaaaaataaagtaaaactttataacaatttttggtataaatacttcaagttagaactttgattcattaatctttattcaaatactgaaagtatgttgagaaggaaaatatatacaaactcataacgtaactctagtaataatctcaagtgagtttgacctggggagaaggtctgttcagagaaaggtgcatgtaatcgggtgatgagaatctgaatttgagccagctgtatccacacagtctttataagtcatccctaacactcagagcaattgcgcgggatagctgtttgccctggaaaaaagcttgactcttgctggtggagcccagattcaaaacgggggcagggggtggttacaaagcatatcaatctgttatttcatcacatacctgctgccttcttaaaggaaacaggaaagcattctttgatcagcatctacagggtctgagattctgctttgaaaaaatccatgtaggaaaagcgagaaggaaaggaagtacacaggaagggagagccaattcatctctgtgaccagaaaaattaaaagttctttttgcactggtcatctactgccaaatatgtgcttttaaatgggagagagaacaatatgcatgtacatagcagtattattcagtatcctgggctttttcctcttcattatggttatcagatttgtgtgcaaatgaatgtaaacacacacacacacacacacacacacacatatatgggtttttttttttgagacagggtcttactctgttgcacaggctagatagagtgcagtgcagtggtgcaaccatagctgactgtagcctcgaactcctgggctcaaccgattctcttacctcagctccccgagtagctgggaccagaggcacatgctaccacacccagctaatttttaaatgttttttgtagagacagggtctcgctgtattgtccaggctggtctcgaactcttggtctcaagcaatcctccttgccacagcttcccaggtgcctgggattacaggcatgagccacagcccccagctaacatattctttaaccccaatatctacaggatttaagactctctctgttggatagctcaacttaaagatatggtagagctctcctgaatttataaatccaaatcaacagttatttattctcccaagctagggacccaccctccttatggtcgcagggggttccctggcacactgcatgctagttagaaagccctcacactgaccccaggctcctccctatatgcctgtaccctttggccacctacctgtggatcttttctctctgggagcctccttgttctctgtgtttgggacaggctgtcaccttctgtcaactagggtaccttgctcttaaattatcccttcaatcccacctccaccataattaaagttaaaacagtagtgggacctgcttttagcctgcagtgtgtgggcgtggagggaaggcaccctgaagctccagggaaggaatggcgccatactttgtgcgctcaccagtgccccagaaaggatggcactggggacaagagccccaaaacatgggcatcccctcctccctaagaaggctcaacagagggtccccttcagggattccatcaataaagaaagcacattttatgaaggggagttgagaagtcccaggaagatttcctcacattggattccaggggtcatttatgagtgttgtgatggtcggtgggtattttttgtcattcagggctacttctattaacattgtaactgttcattttttcccaacctaataagtttttctttttaaaacaactttatggaggtttaattggagtacaataaactgcacataaagtatactgtgtgaccagttttggcatgcagttaccgtgacacagttcccacacccagatgacaaatcttcccacaactcccagaagtttcacgtgcccactgcaacccctgcctctctctgaccccatgccaaaggaaccactggtctgcttctgaaattaaagatttcctagaattgtatatagaaccacacagtatatgttctttttttaatctggcttctctcattgagcataattttgggaactcatgtcattgtgtgtaccagtagtttttatgccttttattcagttgtgtggctgcaccacaggctgaatatccattgacctattgacagtcttggcttctttccagtttttagctgttacaaatgaaactgccataaatatctgtgcctaagtctttgtgtaaacataggcttttctttcttgagtaaacatgtaggactggactgattccttcctgaggattgtatggtaaatttatagttaacttttaaagaaactgcccaaagagttgctatgttagccttttattactgctgtaaccagttgtcacaaacagtggcttaaaacaacacaaatgtattgtcttacagttctggacaccagaattggtctcagttggtaaaatcaaggtattggcagggctgtgttcctttctggaggctgtggggtattggctgtttccttgcctctccagctcctagagtggccgccattcctgggctctgactaccgctcctcttcataccttctctctctccctcctggccgcctcttataaggaccttgtgattatattgagtccacctggataatccagggtcacctccccacctcaagattcttaattacttttgcaaattccctgttgccatggaatttaacattcacaggttctgggaattaggacttggacatctttgggggacaattattctctctactgcagattgcgtcatcactgagttgtaaagttcagttccttacgtattctggatacgagtcctttgggtgtctgtgtgtgcatgtgtgtatgtatgtattgtaaatattttccctcagtctgtagcttgccttttgctttcttatgtgtatgtgccttttaattttgaagaaagcccctttatccatatgttctcgtacgacccttgctctttgcgttctatgtataaaaccttcacataatccaagcctccaagaatttttctcctgttttctttacagaggtttatgatcctagggatcaatatttttccccaatacagatatgttttcatacagataggtatggtctagcaacaccttttgaaccagttcattttttaagtgattttttaaatttaaatatggatgagaaaaaaattcttagaccaattcccatacctattaaatagaattgctaatgcctgtgaattatgccacatgctaatcaagagttttactttgcagatgatcactcaattatctttacagatctctattttaagcaatcatatttattattttttctctacagttcaaaaatgatagcttacagctacaggaagcgatatatcaaatacttaaatacttttttctaagcccactagagcaagcttctcatttgaggcaatattactgagactcttaattttatgcttaattattcatttcagtcctttaaattcctaaacacgagaaagcactagcatttacatgcaggctcatttgtaaaggtgaaacagtgacagcacggtgctgtggaagtttctatcctgtatatataaagcacaaaatacgttagtggttgtagggaaaagcgcggtagtgctcacagcgtgttaacaacttgcaacatttgttgaagaacagatgattgcacttctcatcatttgatgttctcatcaccgtgtcttctcccttctcatactgctaggaatttgtgcttggcttgtaacattgcttctacctgacttctgttttcgggtctgagaggacatttcttagataataggtcattgaaattagttagctgaaggtgacatatggataggtcttcaggtgagaaaaacattctgatttacatagtgatgtattcttaatcactgtttttgcaaggtttctctttgtcagtatttgtttcaaaatatattaatgaacttatcatttctgattactgatttatttaaccttgtaaggactgtctccatgtcagttgtcacatttttcttggtgcctagcacaaagtaggtacccagtcaacatttgtttaattaaactgattgtattctgagcatgtgccatttctgcatacccgggatatctggcttctcgagatttttcatctatgatttgaatcaatattacatgttatgtttacttgtgtgacacaggatggtcccaacttagaaatatttgtctcagaaggggctctgtgctcagtcactggaaacctggactgaattttaatttaaggggaaagtcaattttaggttcgtttggattctagttcatagcattacagttttgttcttcagtttccacagtgtaaatgaaataacacatatagcagcaaggagcagtgagccagtcatacgggtgcagtacagtacttaaccaaaacaagcaaaccataccgttaaattttgaaccaggtaggtttgggttttctcctagtttatagacaggtatttattcatggaaggcaagttggatggagattgcagaaaacctaaaagagaggaatatattttgtgtttttggactttaacagcactaactttgatttccttttcctgtgacatacttacctctgatttttgctcacactcagcctcactgttctatagttttggagtgtttcctgcaaatcacagtgtctttctgctatacattgggataagaaaatatatacatgaattagatctggtaatggcaggccttgagaatagagcaaagggtaaaacccaaatatgtcagcatccaagcccacataagtgtgacagttctccagactgtgttaaagtttcctgattgtattaggacatattgtattgctataaagaaatgcctgagtccacgtaatttgtaagaaaatgggtttaaatggctcacaattctgtaggctatacagaaagcaagccactaaggcgtgtggcttgtgtgcctacagagcaccaggatgagctccctttgagccctggctgaagcaggagcagtggggatgaggggagcagtgtcctgaggcagctgggccctgggcgtggctcaggaaaccacccttctcttctaggcccctgggcctgtgatgagagaggctgccttggagacttctgaaatacctgtgagacctttcccccactgttttggtgtcagcacttccctcctttttagatatgcaaatttctctggcaagtggttgctccacagcctgcttgaattcctctcctgaaaaagctttttcgttctctgccacatggccaggcagcatatttcctaaacttttttgctctaccttccctttaaatataacttccaactttgtcatttctttgcttctgcatctgagcgtagtctgttagaagaagccaggttacacatagcatgctttgctgcttagaaatttgttctgctagataacctaaaggattaccctgaagttctaacttccacagaaccctagggcatgaacagaatgcagccaagttctttgctaagaaataacatgtgtgacctttcctccagttctcagtttctcatttccatgtgagaccttgttggcctggacttcaccatccatatcactatcagcattttgatcacaaccatttaactgttctctaggaagctgcaacttttctctcatcttcctgtgttcttctgagccctccaaactcttccaacctctgcctgttacccaattccaaagtcacttccatattttcaggtatccttgtagcaacacgccacttctggtaccaattttctgtattaggccgtgcttgcattgccttaaagaaatggctgagtctagataatttagaagaacaacggtttaattggctcacatttctgcaggttatacaggaagcatagtggcagctgcttcgggggagtcctcaagaggcttacaatcacggtggacgggtaagcaggagcaggcatgtaacatggcaaaagcatgagccagagagagagttggggggaggtaccatgcacttttaaaccaccagctctcatgtgaactcagagcaagagctcactgatcaccaagtggaggatggcccaagcgaaggatctgcccccatgatcagtatacctcccaccaagccctgcctccaacattgagggctacaattcagcatgagatttgggagggaataaatatataaactctattactgaccaatgcagtttctcctcataaacactgacctgatgcagggtctttttggcgtagagggggcatggagattagttcattctgattggtcattaccaaaggctgggcaagggcatgtggtaagggatgcaggagtgcctgtggaatatagaatggtgaatgaggctgagcagggcaggggtcccagggcccagagagaagtgcctggcccaccatccacctgggaacatgctaggggtttgctaacggatggccaaggtggctgggaagaaaccaggaggcaggccagggtaggagggcagccacactcatcccatgagtctagtcggcagcccagggtccttggccagctcaatgacttatctcctttaagggacttgattgtctcaggcatgcctacagagtttccaccgccagccagagagccaaaatgtttcccaagccaatcccatgagatgcctcacttctagtgagccacccccagcccccacaacagcctccagtcagggcccacctgaagcctcccttttccaactgtaaagctttcccagctccccaacctgcatttgagcttctgccaaaggcaagtgctggtgtccaactttcttgctatgcaatctctgaatgaatagcctctgctcgttctcatttgaagagattttcatttaccttcacacatggacagttatctttataacttaactcagtgcctcctcatttaccagaatctggtcttttcgtgggcttctcttgtcttcccgcaaatgtaataatgccttcctatgacactaggatgctttgagcagatagactcttccagtccatgcaaagaggtggtgtggtttggcctcactcctcactgcaggcttaggccagctcccccttgcagccacgtgcgtggacgtgactctgggagtgaagtgaaatagcgctgccgacaggatctgggctctgtgctgtgtgccaggagcatagagagcaatgtgaaacagctgttgcccacagtgacctttcagaacagtttttgctgttagggttctagggattactaagtaagcttggctggttaagaaggtcaaaaaaagcccaaggcaaccccagctgtctgaactagccatttcagaaggctgaaacctttctgctgtgaagggctggatttcctagcttatgtagttcaaagctcagtttttaggattgctgtgctacttactgaccgaaagttggtttttggaaattgacccttattttccaatatctttcataaagctggaaatgctttcactagaagaaaaggaggatcttatgttagaacatatatatatagcgatgtaaaagtttcagtagttactctcaaaagaaggtcaccaaggacaactgtgatttcatatgtaatgattccagcctagaaaatgtttttttcttgatttccatttaagagagttgagccaattaactaatccttgcatatggtatgttccattaagttgtcagtgtttttattccaagatgcatgtttctttaaaagagctagcttattagggcatgtcttcataagcactttaccctggccatgtccgtgagaatgctgtgcataactttcattgaattctacatctcatttgatgcaggcctaattaactattattaactgagaactccaatttattggaatcatttgctgcagttaacttgagaaagaatggggcatgtttaagggtccttatttttaaatctctctttcattacaaacacattaacataagtctgatttgggggtgacagaaggaaataggaaaataaatgtaactaaaccataatggggtacaatataaaggaaagtaagtactgggatgaatatcatcatagattgtttattctttaatttgtactaatttgtacatttgtatatgtacaattaagcacttcttagttaagattgatatatttttaaaatcacaactttatagagcacaagtcttacatgaaaacataatgccaggtcagtggccctccacttgagcacacattcaaatcactgagagggctctgtaaaacacacattgctaggtcccaccccagcttctgattctgtagatctggggtagggcctgctgtgtggtttgaacgtttgttctctctgaaactcatgttgaaacttaatccccaatgtggcagtattgagaggtgtggggtctctaagaggtgttgggtcatgaaggctctgccctcatgaatggaccctttcgttcatggattaatagattagtgagttgttggatgaatgcgttatcaaaggagtgggactgctggctttgtaagaagaggaggaggctgggcactgtggctcacacctgtaatcccaggactttgggaggccgaggcaggtggatcatgaggtcaggagtttgggaccagcctggccaacatagtgaaaccccatctctactaaaccccatctctacaaaaaattagccaggcatggtggtgtgcacttgtaatcccagctactcgggaggctgaggcaggagaattgcatgaacctgggatgcagaggtttcagtgagctgagatcacgcctttgcactccagccctggctacagtgcgagactccgtctcaaagagagaaaaaagaaaaaaagaaaaagagagagagagagagagacctgagctagcatactcagccccctcaagatgtgatgctctgtgctgcctcgggactccatggagtccccaccagcaagaaggccctcccaaaatgtgtcccctcgacgttggacttctcagtccccataactgtaagaaatgaatgtcttcatacattaccacgttttaggcattctgttaataagcagcagaaaatggaataagacagagtccaagaatatgtagttggacagcatctcacttcatactgatgctgctggtccggggacctcatttcgagaatcaaggtgtttaggaaacaagcagtagaatatcttagatgaacaatactagtggtgtacattttaaataaattgaacaattactgattagctactatgtactgtcaaaatggttcagaaaaatgacaccaccacttctatcaaaatgtactggatgttgggttttttaattaaagcaacttcactttaaaatgtggttttacacacattcaaaacactgctgaccctctttcctcagctgccattaaggtgcttagcccttccgaggaagctaaggccttgtgaagctgtcactcattgggtgactagcaccctgcccggtggcaccagccccgcactcgcccacaccatggcctccatctttgtttgagctcacttgcatctactcggccctcattctacagtgcagtgtggtgaccatcacataagaccgtcgccctcattaaagcagctagtgtaaatggtgaaacttttgggcctgacctgtttgcaagggcctggccagtgtcaacatcgggagcctttttggtagcatgggggctggtggacctgtacctacaggcagttctgcccctgtaccatttccccagccagagtcaacattgggaacctcctctgcagcagcatgggggctgctggacctgtacctgtaggcagtcctgcccctccactgctgccccagctgagcagaaggaagtgcaagcaaggaaagaagcatctgagggatctacttaggacacgggctttaatctttttgaagaaacctcttttgtaacatgatcagtgaaaagctgaactcttggctgggcaccgtggctcacacctgtaatcccagcactttgggagtccatagtgggaggatcactccaggccaggagttcaagactagcctgggcaacatagggagaccgtgtctctacaaaaaaaattaaaaatcagcctggtgtggtggcgcacacctgtagccccagctacttgggaggctgaggcgggaggatcacttgagcccggggggtcagggctgcagtgggatgtgatcaccctactatactcaggtgagaccttgtctcaaaaagaaaagctgaactcttaaaacgtgcacacacacagtcagctaacatcttcataactgtcagattgtgacaatttgattctaactcaagatcagcctttcttgtagtttattttgtgtctttaaggaactagcctatctaacacaaaacactggctttaagttttttctcttttttgtaattgggaataaaaattatgctcaagatacatcaagattagttttggagaaaaaaagcattaagtagattcagttgtgcaagatgcacaaagtgtaacttcataagtaagcggtcacaaactcgggttcataatccgttacccaaaatctatggagccagatgtatttaaatataggttatttttaaaaggtattagaattcatatgttccatgacacagaacgttctcaggcagcacccgtaatcaaatccattagtatttctatagggaagtgcttgaagagtcgcactaagtatgataaatgtggaccattaaaaccacctcatgctagcccagtacagattttgcagtgttttcagaagcttttgggttatggaattgggaacagaggctgtgtttgttcctctgcagccccggcaattaagaagtgtttgtgaagctggtttaatgtgcctagcaggtgtgatgtattggtgaattccaaataattgatagttttgtttgcttttttttttttttaagcaaaatatttggtaggaggcactttagtttctcaagttcaatagctgtttgctcttactggagcgttgctgttaagggagacagcagatcttgtcaattccctataactcacggttaacaaaagcattccctaatgattccatatgttgatgctcagaggtaattctgggccaagcgctcagagcacaacacagattatttcactccatggacgcaaccgcctagaaggtgtgtggcatgactacatcattaggatcccattttagaggtgtgcaagccaaggtccagcaggcttataagacctgcagtatgaataggatcctcattttataggtgctttacccaaggctgctagcttccagagtttccggctagaaagctgcagagttggggtttcccgaaagaccaccaggctttagaggacctggcttcactgcctgggctgcctgccacctcccacacctaaagcatctccccccgccccaccccacccccagctttaaggccacccccgctctgcaggtcagcggctattaaatacatttctccaataaacatcgtatgttagacaggctaagaaacttgtcccagggcgtgcagctgagctgggagttttctgcaggtctcttgggtccccaaagccctaggtcttgtatgaacatgagggtaggagcaaaatcaggccttcccatgtgtattaatgttactctgttctcacactgctataaagaacttccctgagactgggtattctgtagaggaaagaggtttaattgacccacagttccacatggctggggaggcctcgggaaacttacagtcatggcagaaggggatggcaaggcagcaggagaaaggggcaaaggaggcacttgcaaacacttataaaaccttcagatctcactatcacgagaacagcatgggggaaaccaccccaacgatccaatcacctccctccctccacacttggggattacagttcgagattgtcaggcctctgagcccaagctaagccatcatatcccctgtgacctgcacgtatacatccagatggcctgaagcaactgaaaaaccacaaagtgaaaatagccacttcctgccttaatggatgacactccaccattgtgatttgttcctgccccaccctaactgattgaccttgtgacactccttctcctggacaatgagtctcagaagctcccccactgagcaccttgtgacccccacccctgcccgcaagagaacaaccccctttaactgtaattttccactacctacccaaatcctataaaactgccgcacccctatctccctttgctgactcctttttcggactcagtctgcctgtacccaggtgattaaaaagctttattgctcacacaaagcctgtttggtggtctcttcacagggctgcatgtaacagatgagatttaggtggggacacagccaaaccgtatcaccatatgtgcttcttaatgacagttggctcaaggtgttttccccgtaaataacgcaactcacagttataaaattgaagataggtccccatttgcatggtaagcaggtacagctccctgagagagcagttggggagaaaccctcgctttttatatctttgttgggtaaaacatcaaccactgtgcctcaggggcggacttagtgagcatttaagatacattttcagttataaaatgttacttgatttgcagcaattacccagtctccgccttagacagaaacttagaggccatcggcctagacttcctccaggcacagggcttccataacagttgaattaatttaagccttaatgcctcccataagcccccgggaactcaggctgcctctgaggatgaaaacacccgccagtctttgggccccagcctggggcaccctgtagcttcttcagagcttccacctccctgccaggctctccccctccccatgctgcccttgcagctactacagaagctgctctcaacatgccacacagattccagctgggaggaggggagtggtcacagtcacaagggatattttctaattctcctaaggagggtagtagtgtatgtggccctagcatgttaaaaacaatatgacctttcctggtaaaaaggaccctgaagcaatgttaaagctgcaagcttgttagtaagcagggaagaatatccatctgatggccctagtgcaagtgttttatgctcctttattttatttcagcatttttcctttcacaacgctgtccctttaagtgtgccatcatcaacagctgtagttatcatttgatctgaggagtttaattacttgtttagatcctttcttattccacggatttaggattattttatctaaatggtgaggaaaagtgtctgtctgcacagtcccctacagatttataatcccacagttctgtgtcttttaaattaaaagctccatgacattttaagctttaaataaacactgttggaagcatttttagaggatacagctgttttcctgcctttgtccacactcctttcttcctgttcgcacactcgccttagtcagagttccacggagcacctccatcgtcctgcctgccctctgttctgttccttcactcggcttttcaaacccgacagtggtgtctcacttgttcgatgcctgcagtttccttttgtcaatcttcctctctcaactactagaacaaacactcaaggaagtaaaatgtgccgcctcactgccaatccgtccatctccttgccctgagagccttggctctttctccccctcacagagaagaagaaaataaaaggagcgctcatgcctgggtaaccctcccttagaggaggcttttcaccactcagctgttgaggaggagggtgggccagcccttccttctgttctgcagcttctgtagggagaccgagtgcaggatggaatccaggaagccttgagttactcaggttgttacttgaacttcgacttctacaaaccagcccagacttttctaagagtcctgtcttttgtactctcctaaagggctttgagccctccattcagggattgggccttcacagtctgcagtatccagaacggtggaggttctgaggtttgtttggtgtgttttacagcaaacttaataaaatacagcttgtggccaggcgcagaggctcatgccttaatcccaacactgggagaccgaggctggagaatcacttgaggccaccagtttgagaccagcctgggccacagggcaaggcatcccatgtctacaaacaaaaaaataaatgaaaaaaatacagcttgtggtagaaaagcaaggagaaaaatattatagtgctgaaaatgaaatggcacctgcagatgcagctgtgggtggatttgccaagaaaagcagagaaagaacagaggagggctcttcttgttgctgttagcagtcaaaaccagagtatccatcaggaggtggagaagccaggggtcttctgcagggaagagggccacagagggggtcagtgcacagggggaggaaggaagatggggagtgcagggcaggggccacccaaaagcccaaggaagagcccagtccacaataaccagcctctcctggtctccagtgtccacagggtggactgggcccagcctcagccccatcccaggaggaagagccagagagttccccaggcaagtgcagtgagccctgggaccaggagagaagcgtgcacagaggcaaagtccacaccgtggcagccaaagcagtcagtgagcccagtcctctgagtataaggcggcaagagccctagccgatgctgcaggtgcagtcaagagatgcagtttggatgctgctgaaggaacatgatacagggccacacggaaaactttttctcaagacagcagcactctgcccttggttcattcaggaattttgcatataggtggtggatatgattgactgcccaggccttgtgtctacacagatgaccattcaccttctgtgagaaagatgcaggagacaaagcacaggtggccctaccattgcagcggctcacaagagaccttcccggcctcctccatgtgtgacacagcgaatcctgccgtgtggtgcaggcagctctctgcatgcctatctgggaggagcagatattttggagttaaaacctgccctaactctcttttttttgaagacataatttcgctcttgttgcccaggctggagtgcagtggcacgatcttggctcactgcaacctccgcctcttgggttcaagtgattctcctgccccagcctcctgagtagctgggattacagtcacatgccaccatgcccagctagttttttgtatttttaatacagacggggttttgccatgttgcccaggctggtcttgaactactgagctcgggcagtcctcctgccttgacctcccaaagtgctgggattataggcgtgagccaccgcgcccgccccataactctcctttagtcgcagttcataccttgccaactttcaaaacacatcgaggcaattacagacaagcatgcatacctatgtgcatgtaagcatgtgaacatacataggagtatgaagacttacatgcctcttggatacacatagccttctctgtgcgtacacgttacttccctcagtgtgtcctgggtctcccagatactatcttacagggaaaaaaactagtatttagggatgattattgtatttgtttatgtcattgtgggacagttaaaggccattgagatcgcctgctcttttcaggacttcttgttgggtccagctgtacagattcaaggtagactacgtcctgctaatgctgctccacaccctgtgggaaggtttcagtgctaaatctagaacaggtggtcagtctcctaactgaatttgaatccagatttttgtcagatgcatccgtgtgtcttcttcttaaatcagttgtgaacagggctatttccagcctctcgggttcagggactgcctctgtgccaccgcagactggaagacaaggactctgcccaggccttgggatagccttctgccttcactggggccttggggggattgtcatcaggcaacactcagctccatggagcttacctgggtttgaaattccacttggtagacattcctctgtgttgaagtatttctttttttttggcataatgcctcctagcaggtcagttagttggttcttcagtaaagtaatctttctaggcccacactggagacagagtggggaagacagctagtgtgtaacaagcatgctctaggaggctggcactagaatgttacttatgtgccctgaaatattcattctgtaaagtaggattatttcactgtagtagcatcctcagtagtattcttattggtaatatgagtgcaattgatactatgtatatattaaatatacatacagaaaaaacacatgaatagaaatgggtgtgagccagtactagttattatattgtatgtagtgtaatctagcgtatattagtggtactggtactattattagcagtattcctgttcatcttgtgtaagcgtgaggaaagcaggcacctgcaggctcactatgtttctgaggctgtgccctgagtaagtgccgagccgggagttaattctcaggtcagctttcaccatcccgtgacagcctgtgcattaaatgttctgttcttacctgggagcttcacagcagcatcctggccaggcatggtggggattcatcccactgggcagtggaaatgtccttaatactagtgggccatgcagtggactttgtcagctggtgctggcttccatgttgttgggaacaccgagtaatgatgccttgtgctatcgaatggaattgaccattccaaggatatatttagattcaaatacgtacatttaaacagaaaacacaataatacagatttcatttctctcctgagttctgaatttccagatcacaactccagacataactccagcagccttgagaggaggctgcccatagtataatttagtgagaatgacctgcaagcctttctcctgttcacttaggtctccacaaaagcctttgttcatggaatgagacctacacagtgtatgtttatgcggacctgatacaaacttactgttcatacagtatgcactctaaaaatctcttttttttttcctgcagatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggtgcggttgcctcgctgtttgcagggttatgtttgtgactattagcaatggttttgtaaatcacctttaaagtctagcatagggcatgcttagtttgtcctcttttcttcagtatctaaactaagtccctcctggtgctcctgaaagagtttggctgatgctgtgggatgctgtgattcaattttctctttaaaagcttcttaaaataatatgcgttagtttcagtgatttctgggttccaaaaacatttgagtattgtttatattactatatataaagattatgttaatgacagaatgtcttcaaagtttaccttaatagatggttttgcctttttcttttcaaaatcagatataggattaatatttcagcaactattcaaactttaacaaattgataagcagctaaatctccccaaagacgcttaattaaaaaaaaaaaaaagtaaaaagtcgaattcatttttagcctgtgtgtttatatgccgttcagccctttctttacttgtatccagttttcttcggaaaggaaaaacaactttgttccctccgtgcttgttaactgacattcaatcagaacgggcttgcctgacgctccttgttcaagaatattctagattacagaccttgaaaatagactatttgaagatttttctgggatatacaggatgaatactctgtctttagaattcctggtgctaggggagaaaaaaaacagcagttatgtgagtaatcttggatttaaaatgatattaatatgaagcatacctacttttgaaatgtatgttattatttatatttatacatatgtccaaacatgtggattgaccattcctgggcagcacacacacacatgcaaacacacaccctttgtaatcactctgtctgcatccactgaaaatggtagtgtttgtgaatctcaggcatgggtacgagcatcgtgatactcagttctctgcatctagtgtctttctgcaccatttgcacatgaagttaccttgataagtcttggtgaaacacatccatacagttactatatacaaatttaattgtggtaggacacagacacacacactaaaatttaccattttacctattttaaagtgggcagttcagtagtgataagtctattcatgttgctatacaattgacctccagaactttttcatcttgcaaatctgaaacttcgtgctcattgaacaagtccccatttcgccctgccctcaacccctggcagccaccattctactttctgtttctaagatttttactactctccatacctcaaataaggagaattatgtagtatttatctttttttgattggtttatttcacttagcataatgccctcaaggttcatccatgttagagcatgtgataggattttcctcctttttaaggctgaacaatattctatggtatgttagaccacattttgtttattcatagttcatttgttgagggacatttgggtggcatccacaccttggctgttcttgtgaataatgcttatataaacatgagtgtacaaatatctctttgagatcctgctttctagtctcttgggatatacccagaagtggaattgctggatcccatggtaattttattattaatttttgagtgaccaccatattgttttccatagttgttacaccattgtatattcccaccaaaaatctataagggttccaattactccacattctcatcaactcttgccatttcctggatttttttgatagtagtcatcctaatgggtgtgagttgatatctctttatggttttgatttgcatatctgatgattggggatggcaagaatcttttcatttgcttgttggccatttctgtattatctttgaagaaatgtctgtgcacatcctttgcttatttttgatttttgtgtttttgtttttatgttgtaggagttccttatgtattttgaatgttaaactgttatcagacatatgacttatgaccattttctcccattctggctcccttttcgcttagttgttggtgtgcataagtttttgattagatgaatttgacatatgtcatctcatttgtctaattttgctcttgttacctgtgcttttggtgtcatagccaagaaatgattgccaattccaatttcatgaaactttaatttatgttttcttcctggagttttagttttaggtcttacattcaggactttaatccatattgagttaattcttgtgtatggtgttaattagaatctagcttcattcttttgtacgtggatgtccagttttcccaacactgtttgttgaagagacttatcttttccccattgagtagtcttggctggctcgttgaagatcgtttgacaaatacgtgagagtgtatttctgggctatctattctattctattagtatgtaggccagtactgcactgttttgatgaatgtagctttgtaatatgtttggaaatcaggacatgtgagacctccgattttgttctttttcaagattgttatggctatttgggatcccttgagattttttatgaattttaggatgtatttctctgtttctgctcaaaatgccattgggattttgatagggattgcattgaatctgtaggattgctttgcatgctatgaatgtcttaatattaagtcttcccatccatgggcataagatgtctttcaatttatttgtgtctttctttcagtagtgttttgttttgtagtttcagtttataggtccttcacttctcttatttctaggtattttattcttttgatgctattataaatgggattgtttataattttctgttcaacttgttcattgttagtatattaaaatgcaactgatttttgtttgatgtgtattctacaactttgctgaattggcttattggttctaacaattgggtttttttttttaatatgttgaattgtagtgatttctatatatatgatcatgtaatctgtgaacaaagataattttgtttcttcctttccagtttggatgccttttgttgtgttttcttgcctaattgcctggctgagacttccattattatactgtctagtagtgacaagagtgtgtatccttgttgtgttcctgaacttagaagaaaagctttagtcttcattgagaatgatattagctgtgaacttctcatatatggcctttaatatgttgaggtagttttttttttctatccttaatttgactgtttttaatcgtgaaagggtgttggagcttttcaaatgcgttttctttctgcatcaattgcggtttttgtttttttttttttttttggttccttattctgtaaatgtggtttcatatgttgaaccatttttgcattccaggaataaacttcacttgttcatgtatatgatcctttcaatttgctgtggaattgtttgctaatatcttatttagactttttaacctgtgttcatcagggatattgatctgtattttgtttttcatatagtgttttccatgtttggtagggttctccagtgaagccatctggtcctgggcttttctttgtggggaggttttcttttattactgattcagtctccttactacttacagatctgttcagattttctatgtcttcattttttcccccttctcaaaatcatcagggattctctgtcttcatgattcagtttgggtaggttgtgtgtttctaggaattcttttatttcttttaggttatccaatttgttgtcaaaggatatgccaacaaatagtattctcctttatttttgtggcattggttgtagtgttgccccttgcatttctgattttagtcatatgagtgtttttgttttttgtttttttagttaatgtagctaaggtttgtccataaagttactctgtgactgagtgtcttttgtgactttacaaagcactcatgatgtatgaggcatgcacgtgtcttatttcttccatatctacccaagcctttcacatggttttctttctacactttttgttctatattctaagatatacttgaaatatgttctactgcaattcttaaaaagaaaaaaatgttttatctagatagtctggtagtttggctggagtgctagtgaatctgttttatggaatctacttggtgatcccatcaacgtagtgtcttcatttggctttctaagcgagcaggtatcagattaagtaaggtgccaatcatagaaactcatagaaggtgaacaaccagccaggagctagttcttcaaagatagttcagtcctatagaacttatctagatggctctcttttctttctttactactttttgacctctttaacttttttttttttgacttgacaaatcatgttttttggcatatgatttgtgtgtgcgcgtgtgtgtgcacacgcatatacttattttaacttttactagccgctcagttgcgagtagggacttcaatactgaaagtctctctttgaaaatgatcatatctacatgccatatacacaattagctgtgctttgacagagcagagcatgcagaagacttgaagagtatacagaaatgcacaaggtaatgctggagagaagaaacttaaaatcatgctgggatgctggctcagatgatgtgcagggacagtggtcagatgatgtgccgctttggtattctgaaacgagttaggtgtaggataagacaaaattattagaaatcatacttaacctgaagggaaagcaagccagaggaggacaatgttggactgaatgtatagagcagaaagacaggccgtgcctaattccaatccagaaatgtgttcttccttagggtttctgctcaatattataccagtcacaaaaatgaagataaaatagctcttctgtcctgaaagaacattcttggagacctagtttccattcattttgcactcctcccatctcctcttttatctgcgccaaacctgaattcccctcggaaggtgaccttatagcgtcattgctctggtgactagattcagagaaacttgctgctgtagtctttcttctaggtgttcattttgctcacttactactttgttcctgttcttaaggtgtagatgataatataacccttgactttgtttcttttccttctggaagtattttctggtagggtatgttaggttgtggaaatgaccttgagctctttagaaaagaaagctgtctgtagggagggctttttaattcaacgtcattctttttcacatgctttcagagcgacagccgaacccaaggaggtatttagcaagttaaattgccggagtgaatggtagattaccaggggaagcagcccctgatcatgctgcaggggctgtgtgctgtgattaggctgcaggagggtgtctgcttgggccagtcaccagggaatcagcttgattatgctgcagggacatgactacctgggccaataaccagggaatcagcttgattattcttgggggtgtgtctgtcttggccaatcaccgaggaatcagtccaattatgctgcaggggtgtgtctgccttggtcagtcaccaggggatcagcctgattatgctgttggtgggtgggtggtagggggccggggagggggacgggatggggtgaggtgggggacggatgggtgtctgccttggccagtcaccagggaatcagcctgattatgctgcgggagtgtgtctacctagaccaataaccagggaatcagcctgattatgctgcagggtgtgtctgccttggccaatcaccagggcatcagcctgagtatgatgtgggggcatgtctgcctgggccagtcaccaaggaatcagccccctgattatggtgcagaggtgtatctttggcttgatcatggtatagaagtgtatctttgccctgattatgaagcagaggtgagtctgcctggtcatggtataggagggctctttgcctgggccagtctagccactaagaagacaaggtggacctaatggacttgaaagacgaggcagagtggccctgatgcactcgcacatcagctgcctatttgctatcatcacatttctggaaggccctctctatgaaaaggtgggtgggcctacgatgtcctcagtgggaaatccttttgagcagttagttctgtaggcatttcttatatggcttcatggttccatgtaaactgtcggtcagccaaggcttaaattattttaggaaaataaacttttaaattgtggcacaaattttagaggaaaaaatgcatgtggttcatctcttgtgagttttctagggattttaaaaataggtaccgtattacaactggaaatgtatgtcacattacttaaaaaaaatcttcacttaggatatcagaaaatcttgtttaaaacatagcctatgctggttacctccattgtatcttgaacaaatcctttcagtaatgaattccttgggacagatgaaattctacatttcattataactcagcgagggtaatttggattcaaagaccaataagaagaaagttggtgccttttattgtgtagaatcccccaggagttttttctgttgtcccagctctctgctttcccatgtgttttcactaagcatgagattcctagaggaagagcccagggcatggtatctgggccagtagaaaggacagcctgccttgcagatgtgctcctcagcctggccggctctcccctgcatctcttggccggctctcccctgcatctcttggccggctctcccctgcatctcttggccggctctcccctgcatctcttggccggctctcccctgcatctcttggcccttaccgcctgcaccaggctctctggtgttaacttcctgccctctactttccccctctcagaccatctggagcagaaaaagcaaactagaaccctggccccctggagagtcgtggatgggtgccagagctccccttaggtggctgaggggagggagcaggtgtggcctgtgtggtagaaaggatgggtccagtcacagctctgcagcggagcactcctcctgctgtccagccccagtccccttaggacagtaggagtactgactgacatgcccactgtggggtactatgatctgaatgtgtcccccaaatctagtgttgaaacttaattgccagtgtgataggattaggatatggggccttcaggaggtgattaagtcctgaaggtggagcctcatggatgggattagggctgtcatgaaaggactagagggtaaggcctgctcttccattcctctgtcacctgaggatacagcattcctcccctctggagggtacagcaacaaggtaccatcttgaagcaaggagcagtcctctgcagagacagacctgctgatgccttgatcttggacttcccagcctccagaggtgtgagaaatacatttctgttctttacaagtgtccagtcccagatattttgttatagcagcacaaacagactaacacctggggcattgctgtaagacaaccttggagcatgtgtggttacacctggcccagtgagtggctcctagcaggcacttgtgtcatctcctaacccaggaggatccagtcctcaccctgaatcccaccttgaggagttagtaaggtcgttctccatccctgctcggcttcgttgaaaagcacacaccagccatgacatggacaccatgcacatgacatgggctctagtcctctttctgtccaagctgtgtcttcctcttgtaagtaagccttcctcctcaggctgacttaggtaattatggttgtttccatccttctactttttttctttttaattttgttcttggtttattttcttacaccgttgtcttcctggctgttaacagatacacccccaccctttccattaggagcatctggcaggaaggcactcatcctctggaagtcagctaacaacttgcctctctttcctctgaactctcgtgcatgtagtgctgagtgagtgctcggggggacacaggagaaaggtctctttcctaatggagtatgtcatccatttggggagaggggacaggcatatctgcagcatccaagtgaaaacccgtggtaggatattgttgcacagcaaaatgagaaattcaggaaagagatgccaaagggatgtagaattaagtaaagcaagatattcttggagtagtggccgctcctggggtagggggtgacctcgggggagtccacaagaacagaagagatacagatgggagaagccatttcaaaaggaaaacagcacctgtggaggattccagtcagccagtgagtttgcttctatacagcatgaagccaagcttctcatggctcacaagcttcagagaggaattgtggctctatgagttgagcttcttattccccagctcatctgtttgctttctggatagggagaaccattgggatttttaaaaggaggcgtgtcagaatgcaacctgcacttggggagaatcctctgggtttgtggcacacaacgcctgcagcctagaagagatgggccagaggaaggccagggtgatggtaaaagacatgcaccccccttgactgggccatgaggtgtccagacggaacattctttggagtgtgtgtgtgagggtttttctggaggagattagcatttgaattggtggattcagtaaaggagattttcctttccagtgtgtctcatgaaacacatcatttttcgcatcatgaaatttgtcactagaggaatgaaaggatgatcttaagtagggagaatatcccttcaggataaaaaaaaaaccacaatcatgatatgcttttttttccattggagacacagtctcattctgtcacccaggctgcagtgcagtggtgctatcatagttcactgcagcctcgaactgctgggctgaagcaatgctttcacctcagcttctggcgtggctaggactgcaattatatgccaccacacccactaaggtttttttctttttttctttgtagagacagagtcttgatatgttgcccagtctggtctcaaaagttctacctcaagcagtcctccttcctcagcctcccaaagtgctgggattacagacatgagccaccacactgggccttttttttttctttaattacacaaattacacttgtttcacacggtacaaaaatgtatagcattaaaattggaagcccttctaactcccactctcctactccctggagataaccgttactcagtgtttaactatttaaggtacctcatttcaccccttgtcttatgatgcctatgtgtttgtgtgtagacccacaggcacacagagatatgctcacctacactcacctacatgcacctttatggaatgaggccgctgacataattcaccaagatccagagcaagtacctatagattaatgggacagaaatcccaaatgctttaattaaattgttagtcaattttttttttttggaagtaggtctaacaaaagtgaggacatctttttcctagctcttaaatgaattgtcactgtggatccctgaaatgctggacatcccttgggatgggaaggcactcagagcacttcctgcctgggagcacttacaaggttgcattagtccatgcagtgctaacatgattcttgtgtcaaggacagcttccagaagacctcagcaggcaagctgtgctgctttggtttgtcctccttagtgatggaggtattgtgctgtccacacccttacagtcctgtagattttcatatgtccacactgacacagtcacatctcttgttccgtctcctgtgccagtggcttcagggccagctgttacctttaggaaccaggaagcacccaggtcagcttccaggccaagaaggaagccagcagaagaattatagcccttggtttataggccgctctgataatccattactttctaagtctgggcagcaggcctcagtgttgaggggcagtataacacctaggtggcaggagcctcacagagaagagggacccatttgtgtacatggcacaaactgtgtctccacctgcctgtcattcctggcctatcctcagccagatttcacagctcggtgctggggctatgccagttagatctacccagggtgttggggcttcgagtctcattaagatggacagtgcctaggaaccccagaacacattctctgtgccatgttcaggaaacatgcacctgaagggtattcatgccacttttccttgttggtgtccactatggtcgtgttggctcacaagcattgaggactcactgcatgtcatgctctcagtgctttcactcgtgggggtatgtgtcagcctcctgccgccgctaagaagcagtcgctcttagcacagggaatggcaggtaggactgcaggggtcaagttacttgtccaaaagcttgcagcctctgattatggaggctggcctcgaacccaggtggggaatgaagagtccatagctcttagccacggcgctctactgccccagatgatgtggcggtgaccttctgttgaggtagacaacatcagagtacaaaggggagaagatgtgttctgacacgggtcacagggctgagccctttaaggccatatataacccatgtggagaagtccccagtgctcggggactctgcctcgtccagctccgtttctggtggtggtctcgatttggggcactcagctgattctcagtcgctggagaggctctgctggcaaagctggacctcagggatttttacttaggcagattgtactccttggataacagcacaattaaaggacacacacaacaagcgaaaaggaaaattgtacgctgacagtcatggtaacacattcaacttacgctgtgttccttttccgtttaacaaatcgaattagccccatgttcaggaaaatttatgatcgtagggaggaagaagcccatttgccagtcaaatgtaaatgtaaatgaaaattcttaccccccttttcctttaaagtatcagcttattggccaggcgcggtggctcatgcctgtaatcccagcactttgggaggtcgagacgggcggatcacgaggtcaggagatcgatcgagaccatcctggctaacacggtgaaaccccgtctctactaaaaatacaaaaaattagccgggtgtggtggcaggcgcctgtagtcccagctacttgggaggctgaggcaggagaaaggcgtgaacccgcggggcggagcttgcagtgagccaagatcacgccactgcactccagcctgggcaatggagcgagactccgtctcaaaaaaaaaaaaaaaaaaaaatcagcttattcaatgatgtatatggacattattcctcttttctgaatatagtgactttcataggcagctaattgccttgttatttagtaaattgtaatgaagacatcctagactaaggagaataagatacaaatctttgcttctgatcatcctagatattacctcactgcgcatgtggagatgtttctcaaagaattacaatttatattttttgctttgtttgtttgacacaggatctcactctattgccaaggctggagtgtagtggtgcagtcatggctcactgcagccttgacctccctggctcaagtgatccccccaaacccaagcgatcctcccaccttggcctctcaagtagctgacacttcagatgtgtgccaccatgcccagctaattatttctttcttttctgtagagacagggccctactatattgttcaggctggtctcaaactcctgggctcaagtgatcctcctgcctcagcctcccaaagtgctaggattacaggaatgggccaccacacctggcccagtttctgtttctaaatgtgtggtggttctcctgtggatttctaagtctttaggagtataggataatgaacaagagaaatccttacctcaaggacctctcgattcaaaggagaggaaatgagtagataaatgaccacaatgggttgaatcaagtcactgtccctccgggaggggtgtgctcacagcataggacagcactgtggagctgcacagacaggctttgaggggtgttaggtgccagcactctctgcacactgcagtcaggacgagggagtggggagggcagtgacttttaggtgagcatccaggtgtagagcgctgccagcttgccccgagtcccagcacccgctcacagcctcctggcgccagtagtagaaatggttgcacaaagcaaccaatgagaaatactttcagttttccatctgccacacagagaaggtaggagaggcttgcaaagggaatagcatccagtccttttgttacttgggcatggaaagttggggttttccttttgattgagttctgggaagtcagcatgaatcagctttcggttccctgcctccagaccctattctcctgcttcagtatgatgtccctagagttgtcaaatccatagaggcagaaagtagaattgtgattgccaggggctgggggagggggatggaggttttagcatttaatggggacagagtttcaccttggggagatgaacacgttctggacatggatggtggtgatggctgtacaacaatgtgaatgtactgaatgccacagaattgtacactgagaaatcattaaaacagtacattttatattgtaggtgttttaccacatacaacaatagttattctttttcaaatggcaagaagccattcaaggattttggagttgtgttttggcaaagctcctgtgcagatgaggtagaaagcctgtagtgagtagacacaaatgtggtttttcacataagtgttgtggataagtgcatctccttatccccaacagaatcatacactcttatcagggaagacaggtgtctctcatacgccccaagcacctgggtcatggggacttgggcccagtgtcatgggcaggtttgagtgaggtcaggagtacctcgcaccacgcctactctcttgaggtggtttctgcaccacttctatacggtgggacctttcatctccatagcatggtagacacaagaatacagggaaagtcttactctctcctttctagaggattccttagagagtagactgtaagagcaagactttaatatttgagactattgacagagacaccatcaacagaaactcctcacaacaaagctctagccataaaactgaaatttctatgaaatatttgcaaaaaaaaattgacaataggaaactatgatattttatagtaagtagtccacaaattaggttaagaactttaaaattagtttgggattactataacttaaagtattctgttatttttgtcttattgttgaatgcataaggcaaaatgaatccatttttgatgtgagttatttaaaagaagaatacttttctgttacctcttatttgtgaagaaattgaaaactgaaactctttcccaatctttatatcatttgcacttttatgtttgttttgtgacgtagtcagggttgttcttatttgcattatgtaggtgaggatacaggttcagagaagtgaaacggagaaggagaagtttgaccctggccttgtaggccattaccaggctgcttttattgagaacctcaggtatggcattctctacgatgagttaaatgccttcttcagattgggttttataatacttgtgcttgtttaggtaagagaatttacattgtttaatcacgtagagagctatagtagaaaatcaggaaaattgaatgagctattatgttaacatttcctagtttgtatcttttcctttggctattaatcataagctatttaaatagctgttttatacatttattttgtagtgatagatccttagaagtagcaacccgaaaagtgattcaaagtaaatgaaattagtactgtaagcagctttctggcaaatcaaagaagacacaaaatcaaatatttttctgaggatggtcagtattttgagatagttggtcaggttctccagatcttaagaaagccaatgaaagaaaaagtccatttaaggccgggcgcggtggctcacacctgtaatcccagcattttgggaggccaaggcaggtggatcacttgaggtcaggagttcgagaccagcctggccaacatggtgaaaccctgtctgtataaaaatacaaaaaaaattagctgggcatggtggcgggcgcctgtagttccagctacttgagaggctgaggcaggagaattgcttgaactagggaggcagagattgcagtgagctgagatcatgcctctgcactccagcctggtgacagagtgagactctgtcttaaaaagaacgaataaaaagtccagttaaatgtgccttccctttgagtttccagagctttccacattctagtgaaacctaggagacctgagttaccacagtcaagtggtgaactaagtgtgtcctgatcagaacaaaatactgttcctcggtatctttccctttcttttttatttaccattgacagctggctacagagatcatataatctccagaaagaatgctggtatagcttctgtgaggacaggaggctcctgacgatcataaagtctttttcatggagtcaccattgaccctttggaagtgttcagtgccacttctttctcatatcaacgtaaaactctgcaaagtcatctccttctcatctgttacataatacaaaagaatgcattttacttgattttcagggcaaagagcagattctgaaactgatagcacatttgcacactgaactcagaatttgccagtggtagtaacctttgtcacatggcggggagcacaagattgtgtctgattgtgtctggcctggttggggtgaagtcggggctagtgggtcgcttacatggtagcctccagcctcttcattgtgacaacacaggagcttctggtgttgaaactgcctgtccctgtaagactgagatgagatgtgaggcatatgatcaaagggtcacttaccagctagctagggggaagtggacatttcctgaatgtcccacattttagaaaatagtacgaaattcccaatgcagatactgtctgggttgtatgagtcttattttactgagttttctttgtaccatgcacagcctattgtaagcgcaatttaataaggagattttaagcatgttggtatatcaaattgatttgatctttatatacatcctttttgtctattagggatttatatgaattcaatttcacagggctaagaaaaatttttttaaatttaaaaatttctgctcctttggttgcattgaaatggtgggtctatggctcataaaatattctatgcatggtaagctaaaatatatctgtatttggatttagctgcataagtacaggaactgaacatcagactttaataaacattaataaacccttatgctatatgtttttcaatgagttattatatagtatatataatatttagatactatatatactttaaattctcaacattgttttgataatttgctctaataacgctctaataatttgagcacttgtagagaatatttagttaagtggttaatggaagaaactcgttggggatttttggattccgtttctaggagggcagttctctcatgaggtaaatttcctatctggtctgtgcatgaatttcttgaagaactgacaataattcttcctattagtgtcacaggcaagggggcaaaggggttaggtgtcaatgcctggctgatttcctgcattacaaaatttacctcttacttttctgtcttcctgatgttaccccctcttttctttcacctcttgggcctgcacatgatttgtttgctatcaggggccaataagctttctctgtgttttcagctttacagaccccatggtatatgtgtgaagcctttagctttgctgtgttaagaagcaagtagctgtaaacagtgcgtgagtgggtgctggtgctgcactccagtcaaactgtctctacagacacagaaagtggaacttcatctcattttcacaggttataagatcatattttttgactcttttcatttaaaaacaggtagtaagttgaatttgtgtttcaaaaaaaaacaaaaggcaggataaaacgaagagctaaaacaccacagagcaggttgaaatcccggatgtgaagtagtggagccattgggccctccaccccaagctgtgcattcagaatgccacctggggcagaaaacaggtttatacacagagccagagagacttcagatctccggtgatcaggcacagtggaggacgtagataaaagatccctgcaccctgcgctgtgagcccaccaggtcccttcacctcactctcttttatgcacaaccaaaaaagatcctggagaactcttctctggggaaggaagttacctcatgacaacaactcttaaacaccaacatttcgaggcccactgatggaaaaactgactacaggtagtaacttcgagtttggagaaggctcccacctgtgcccccaggtggtgctgtgtagcttactgagaatctgcctggcggctcagcccccactcttctgttgtggcaacccacatctgaaatgttgtcctctggggaacatgcatcctttccagacactcctgtaatctatatatttgttcctccctttcaagaggcttagaacttaaactttggttgtcatttttgttgatattatgctgttcattcctagtatagccgttttctaaaaggagagagaagcaaggatcatggatcagtagccaacgttagagtcagagagcagtttgcatgcaggttgtcacagaggcacatctagaacacaaggaaactctcatgcattccatgtgcttattaaaagggcattatactgcgaagtactagtctaataattctctgcaagggatttaaaaaagggatcaggggttagtactacttgctagagtcagagggcaatttgtatgtaaattgttacagtggcaaatctggaacacaaggacactcacatgtatcccatgctattaataaaacggcattttattgtttaagtcctagtctagtcattctttataagggaaaacaaggatcaaggatcagtacaccatgctatagtgagagggaaattttcacgttaagttgttacagagacaaatctacagcacagggaaatattgagtcatttttaacattaaggtgtcaagtcctgcctggaggaggggcacttagggtcagtaggatcaggtggagaggcttttcttctaaagtcctagtgcttagcagaggaatgagagagaccattcagtcccactatcacattgtacacctgtagttgcagcactgtgggaggccaaggtaggcagattgcttgaggacaggagtttgagaccagcctggtaaaatcctgttgctacttaaaaaaaaaattacacgctgtagtcctacgtttacttcataaaaactaatgtagaaatgcaaaattaattttccttaaataaaatttctgcattactctctatattactttgtctcttttattttcaatggctgaaaaaaatagttttgttttaatttttattatttgatccatccttaattaccaggcattgatcagtggtttgaattgccctccctggctttccattttaatctaaaattctgctataagtctatgaaattggaccagaacacaagctgtgccatcagtgatactgataacgagattctagagaaaggtgcttctttggctggaggagtttaggccgatcacatttcagtgaccccggagaacattagacagcacctattgccacaaagcaagcagccagctgtgggtagaacagcaaaggcagtcggatgctcatcgcctgtattgccctgggaccagcagaccaaataaatgtaaactggactcttgcaactgtttgtttgaagatttgaaaggagttagtttatatttattttcataactgctttatttctgtcagtatttaatgtttgccaaaaaaggaaacacaggtttcccacactgtctccccatcaagtatcacaaatttgtgtgtcaagtaccagaatttgagaaagataattaagatggtttaaggtcatctcacagatagaacctcagtctatccaagttttctcctccagggtcaacccactgtattagcttcctggtagtgctgtgttaattaacaaactccgtggcttaaagcagcagaaacttaactgtctgacacctcagaaggctagaagtccgaagtcaaggtgtgagcagggctgcactccctctcaaggctctagggaaggatccttcctgcctcttttcagctgctggtagttgccggccacccttagctttccttggcttgtaccttcaactccccaatctctgtctccattttcacacgccctccctcgtcctgtgtgtctttgtctccaaatttccctctcctttctttggatttagggtccaaccttaatttagtatggcctcataataacttgattacatctgcaaagaccctatttccaactaaggtcctattcccacgttttaggtgaacatgaattttgtggggagagcactgtcaagccagtacacctccacccatactttcctactcccagctcagactgccactgttcaggttgccccaggagggccctgagctggggcgcggactcagtcagtcgtgtttggctggagtgttccatgaggttcagccagtcttgccagagccttgctcctcttccagcccctcaacccaattcctttctcctgtttcctttccttccacactaccacactgtcttacgtccaggatataggttagtcactcaattccataagccggatcctgtggtgcaaattccataagtggcgatccctgatattagctttgagttggtgccgggtccctagtaaattaggactgaagatctgcacacagccaagggccctctccctagcagcaagcaccttttcaaaagagcagaattcatttggaaggcctagaaaaaggaaggaggtgctctgccaaaatcaatgatgtctgagaaagaagcatgctccctagagcttggagaagatcagaagagggatagcctgaggcatggctctgcagtaaatcattaagagacgcccactcacagtggctgtggctaccagaggtttcctgtgagggaactaaaaagcgcacagtagtgtttgtaagtgatggttccattttaatagataaacatacagaacttataaaaaatcaagaatctatattagccagatttcctaaattagttaatatttcttttaaatttatacttaaagtcacagtttttaaaactatatatatgaatgtgaatactatatgctttggggaatttgactttggttattttctagtgtcaaggataaacacagccagacagtagttaaagcgatcagcacagattttcttccataatatactattgcaatagagaaaagagaccaatgtgaaactgggctcaacatcaattatcccagaggtgactgggcattttaaagggaaattcagggagtagggaggggtcagcaggggctcagcagagttggggaagtgaaaattgcagaaagcaggaagagggtttggtcagtgtgaagccatctgggtttcactggtgctgatagaagtcaggctcctgcccttccacagaggcttgtctgcaggagtggctggaaccaacaatcagttattttggcagccttgagttttcgtaggcaagtactttaagggggctagagtcatgtagcggtgtgaccttgagctgttgaacttgttcaagtctttataggccagtgtgggggccttgtggagaaaaagactcagagcagcctgagtagagtctggtccaggagacacttttgtcactgagcatgaccaatccatttatcacaatggtagcagcgtgtcctcatggaattatgtttccttcgataaatcttgaacaagaaataaatgcatcagcatatgtttttaaaagttaaacagatgttaaacttaaaggaagtttgctaaaatccatttcgtggacccctttgtaaatacctgacctacacagcttaccccttatgatttaaagttaacttgcatccattttatggaatcccaggtgcctgtttgacctgcagacatctttctcccttcttggtcactctctcagggcatcagctcttcacacagcaacagcttcctgcatgtggcccctgactgtccattgatgaccgaaggctcgtggacttgccaagttgcccacgtaaaacccagggttcagagagcgagacaagtccttgcattgtgaagtgccaacaattctagtattccaaagctcagtgttgttcagaacatggtacccttgtgagatcacgtgtgacatttgtgaagaacctggaactgatgtttccttaggaagcctcgcaacagtaagtgctttcagctcgctcaaggaacttcaagtaggcaagaaataagaatggaaaccctgcattactccatcagatcttgaaagttttctcttggataaatgtgcctgtcaatcacatcgaatcttatcccctgcctccatgtgctataccacaacagcgacgtctgctggaccgtgtgtgctctctgggtacacattttccaggaggcagcatcttattagagagtaacaggtctgtcttgtgtaaaggagaatgctaaccgcttcatgagaaggctccccaccatgaactcggataaccggatgctatttttttaacttatttattttttaattgacaaatagaaatcgtatatagttatcacacacaacgtgttttgaagtatgtatacattgtggagtggctgcgtcaaggtaatgaacacatgcatcatctcactttctcatcatgttttgtggggagaacacttaaaatctagaatctgagtgattttcacatagccaaatgttatttttaatgacctttgccttaattgtccattcaatatcggtcatagatatttattgagggcccagcatgtgccagccaagcgtggcctcctaattggaaacacaaaccctgagaaactctgagcattgttgtgtagtgcaggggccatcctcacacccccacagccagcattcagcttgcttcataagccatggatggagtcaaaggaaaactagctcaccttcccactatgtatctgaaatcactttctattccatgctgcacacatgtactgcaaggaaaaggaatgattcctgcccccaccactgccttccattcctaagaacagagaggatggagtacgaggatgaggaaaacagacggcaggaaataagcagtttattcactggatgtctgcatggggtcttgggagtgcagaggttgtgactcattcttgagtggaagtttctaaccacatacatacaaccgcaataactgcagccagctgctggaggtgttgtggtgaatcccagcgggttacaagggtgtgagaagcctggtaaagtttccaggaagtgaaagcacatgagctatgtcttcacccgcaaagatgcaggtaacagctcagattctgagtcttaggaagaggatggaggccggagggtgacagggtttctctgtagtcctcaggaagtgaaactgcctcacaggaaataaagcaatatcaatcaggcagtttctttctgtgtatatttgaatattgtcaatgttttaaaaatcacgacgtatttctttttttttccttctttttttttttgttgttgttgttgttgagacagtctttctctgtcgagtgcagtggtgtgatctcggctgactgcaacctccgtctcttgagttccagtgattctcctgcctcagcctctcgagtagctgggattacaagcatgtgcctccacgcctggctaatttttgtgtttttagtagagatgggatttcaccatgttggtcaggctggtctgcaactcctgacctcaagtaatccgcccacctcggcctcccaaagtgctgagattgtaggcatgagccaccatgcccagccaaaccggacatatttctaaggaacgagaaagagcagccgtctgtccaccacctgccccccacaactgtcttgaaccgcatcccagacagcttggtgtcgtagctgacattgcctgtgtcggccctcctctcctgatttattttaatcctcatatgttctttcttcttctgggaattgttcttttctagcattctgtttttgttttaaggactcagtaacttatatgtcttcatgaatactaattattatcatgactgttgcttcctcgcccacttttctctggattgtcatttttttctggcagattcctgtcttctgcctgtttgagtcttcttccacaaacacctggcagtgtctgttctgctcattcacattcaagaacagagcacctgtgtgttcatttcctggggctgctgccacaagatactgaaaactcagcaacttctaataacagaagttgactgtctcccagttctggagactggaagtctgaaatcaaggtgtctcagggccacactccctctgtaggctctaggggaggatccttcctgcctttcccagctcctgggggctctaggcatccctgggcttgtggccacatcacttcagtctctgcctccgtttccacgtggcaaagtgagctcatctcaagatttttaacttaattacatctccaaagaccctttttctaaacaagacagaagtaccatgggtgaggacttctgtttgggggctaccgttcaacccactgctctcagtcacacaaagcttttgaagcataacacctgctgttcaggcagttgcaaaagtagcccctaagaaagacagcatgccaaagcaccttccccatggtggggtggggtgacgggccaggcacccttaggatgcccatgcaggaagtggaggctcagcagaatcccacaggtgtgtctggtcctgggatagcatcagcgtcttctcacaggtagccaggtggcatccatcagctgaccacatcgtctgccccagtggcacgggctgtcttccatgtctcacttcatagagctcttctagactgaggcccaggacatggttctcggcacacagcgttaatgacatgcacggccctctaagcggttccctctcccactttgcgttgtcaacccccggtaccccccacttgattctgttgctcactgcaggtcttaggtagtacagagaatgttcaggcttgtagggttctgatggccagatcacccaacaaaagaatgccacgaacacctgagaccgcgcggcagctgcctgtcttctgcctctttcctttgtttaatcctgtttaattgcacatccctgttctcacccaccttgggtctctaggatggaggaaagcaggagcgtttcttcccactcacagtgctgattctccacattccccagttcttcccctggagatgtgtcctgtgagctgattgtttggagcaacagatacctagatatctgtctctctgcccttcctgtaaacccacggaagcacaccaaattctaggagctgggaactggagttcatttatacacataattaaccagcttctccctagaacagaactccatttgcattttttcgtcttttacttctcagggaaagccactgagtgagacaaagtttgtgtgcactctttaaaagatgaaaaactttgtgaaggcatcaggcagttttgaatcaggtgattaggatcgttcattcctgatgatacactggagctatatctgatgataacgacactacctaacatttatctggggcttcctcacccatgtcattttccaggcattgttcttcttgtgaattaattccatgaggaacgttaatcattgctctttgacagatgacaaaattgaggcccaaagagggcgtataattgacggatgtcccgtaatctctgactgtggtcatagtcttgtcttggctttcatcttcataggagtcccaagcattttggagatctcagtatgttgtggtggtgtaaagcagtcgtccaaaaccgtttttgattcattctccatcaataagaatgttgagctgcattccagtctagacacattggtgtgtgtttgtttatctactccaccttagaaataattcacagcaatagaaatgcaagaaggataagctaaaataaaataatcggccgggtacagtggctcacatctctaagcccagggctttgagaggccgaggcaagaggattacttgaagcagaacttcaagactagcttagctaacatagggagaccctgtctctacaaaacataaaaaaatttaccaggcatggtgacatgcacctgtagtcccagctattcgggaggctgaggctggagaatcgttttgagcccaggaggtcaaggctgctatgattgtttgactctgctccagcctgggtcacagagcaagatcctgtctcaaaacaataataataaaataatctgtttaagtttttaaaattaatagcaccaaagtactttaagaaaatttttatacagtgtgttttacagagccatgtgtttaagtgtgctccattttttaaaatattggtttaaaattgtgtgatctagcaatttaaaaatcttgttttaaattcagattgttttgatactcagctttaatcactgtttatatccagacagaagttcatgattggctaattttttttttttttttttgagatggagtctggctctgtcacccaggctggagtgcagtggcgctatgtcggctcactgcaacctccacttcctaggttcaagcgattctcctgcctctgcctcccaagtaacgggttacaggacgcactgccacacgtgactgtctcttttttaaaaaaattagagccttttatctcatccatcagttaggttaaggtttaaattgaaatttagctaataaatatagtcctctgtgatactaatcagtggttgttgcaaactaatgaaatagtgtggcattttagtatttttaactaatggattcaagttctgtagaagctctttaggtggagtacttctacactgattgaatattgtttttatgcgtggaggtatgtgtatgtatgttcatgagatctgtcgttttcttgtctggcttttgtctggttttgggatcagggaagtgctgatgtaaaatgtaaaatgagttgagaggtgttccctccaatttcctgaaaagtctgtttagaattggcatcctttttttcttgggaagttggtaaatttaccagcaaggccatttgatcctagatgtgggaaggaggtttttaattacaaattcaattcctttcataggcagaaggctattcaggttatttgtgtcttcttgagggagttttatatctttcaaagaattatctcatttcatctaaatggtcaaatgtgttgccattaatcctataataattaagtttttatcattttatcgatgttagaatctgtagtgatgtctgtcccctctttccctgctaatgttagtacatttggatcttctttatttttttgatcagtttagctaggagtctactaatttaattgctcttctcaaacaactcgcttttgatttagttggttttctgtattctacttttatttcattgattttctctctcatgtttattatttccttccttttatttgttttgggtttaatttgctcttttccttcactttcttaaggtaaaagcttaaatcattgaacttctttctttcaggttttcaatgtggcaacttagatcacttatttgagaccttattatttaacatatcactcaatgccatcagttttcatcgaagcaatgttttagccacatcccagaaattttggtagtttttagttctctacaaaatattacctagtttccctttgtgatttcatctttgacccatgtcttacatagaagtgtaacatccaaatatttgtgattttccacattcctattattaatgtctattttaattctaccatcgttagataaggtattctgtatgattttaagtattttataatttttgagaatagttttatccttataataggatatttcttgttgaatgttccacgtgcacttaaaaataatgtggtttctgctgttgttgggagaagtattacataaacgtcaattaggtcaggttgcttgacagtggttctgaagtctgctgtgtccttacttcttttctgtctacttgttttatcaattactgatagaggagttttaaacttccttctacgtttgtgtttctccattcagttctattggtttttgctttatgcattctgaagctctgctatttgatgtttacacatttagaattatgtcttattgatgaactgatctatttgtcattatgaaatgtccctatttatccctgatgatagtcattcattgttctaaaggcttgtttgttattaatgtaagtaacctggctctcttttgagcaatagttatgtggtatgtagttttctatccttttatcttcaatctatctgtgtagttatatttaaagtaggtttctgtagacaacatgtagttgggtcttttgtttttcttttttattctgatagtgtctatcttaggtgtgtttataatacttataaagccgttacataaggtcatgatctgctaattccatctgtctctatcatttctgtgtctatttctcctgattgtgggtggtatttgcttctttgcagcatggtaatttttgattgaatgttagacactatgaattctacacccagtggagtgctagattttgcttgatttcatttgctttatttaactttgtcctggaactacattatgatctgtccatgccttccttttaaaaatctttagagggtcaggtgctccagatatctgttaccttatcctgaatgactgtaggtgttcggaaaaaatgagtctgttgattgttttgtgtaacaattgacaaagtagggacattaaatcatgacattattaaaataggcatgattatacaattatttaaaataattttaggccaggcgtggtagctcatgcctgtaatcccagtactttgagaggctgaggcaggcgaatcacctgaggtcaggagtttgagaccagcctggccaacatggtgaaaccccatctctactaaaaatacaaaaattagctgggcgtggtggcacatgcctgtagtcccagctactctggaggctgaggcaggagaatcgcttgaacctgggaggccgaggttgcagtgagccaagatcagccattgcactccagcctgggcaacagagtgagaccctgtctgaaaaataaaatgaaattttaggcaaaccgtcacaccttgtgtggatttagatgttcctgttgtgctagtcgcataagttaaaggtaggaaggactcctggtatttttgattctttctgataactagtcctctcatgattggctctatgatgacctccatggacctgtgtggtccctgtagttaatccgtgtggctaatgacagtgtgaggatgctcttttcatatggcacgttgctgttgatcagctgtgttcagcagctttcttttgtcccctgatcccttgttaagtagcgctgcagcagtccctcagccacagccttcttcagcatctggtggacgcctttgtgtaatttcctctccttagcagggtgaagaatgattgaagtgttttctgtagaatacagcatttttgcagaaaacaccaaaagcatagtccttgtgtatttactgctctggaaaaaaaagtatggttcagcgaggccctgctgaagggccttccccggtgccctggccagatcccaggtccagtcacctcctgggcctgctctctgcccttctccacgtttcataaggaggcccagcaggcaaagcagcagtgcctcccagtgcgctcttcttctgttcctttgggaaacgtatcgctcaaccgccaatagcttttttgattttttggtttgttttatttgagcagggatgttgtggagctgacaaccgcttttagacaatctgtcctaggtcagaaattcctcaaaaggagcagcctgagagtgtgctgccacacagctggagggactgtccctgcaagaaggtcttatggtggaggcctcgcccctcacctcagtccttccctcctcctccccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaaggtaagtgggtgccggtgacacgggccgtgttccacaaccatgttccaccaaataatatccatgtagtgtttgctaaatgtgaaaagttgtggtttgtgctgttgaaggccactttgcaatgctccctagaacttgggtatgtgggcagggagatggtctggttggaagattttgtgaggaatcgtggccgcacctaagtcaccaggccagggagactcagccagaatccactgggtctcagggacaatctgagaagcttacagtgccagaacaaggcctattcagacattttccagggaagcggcggttttaatgatgtggggcttaaaacagtcttattgtctaggtgcaggctttaaggtgagtattcactgcagttcagatgtaaatcactaaaactcacttcccctccccaactgcttatagagtgctcgttggttgctgcagtttttgcttgtgtagtgacgctgggtttttatcgccaagtttttggacttccatccatttctccattggaaagtggcagctggtgggcttgtatgccgtggcaccccctgtcccgcaccacggctgcttgaccatgcagggtatgcagtggagacggcccctggctccctcttcttgttaaataaggctcctcctcaggtgacctgggcagagcgtttagagagccgaccgcttgtggtggctgggcctggctccagattcctctgaccgttctgtgactgccaagatggagtccttggcctgaacgatctgcaggtacagattccagaatcacaggaagtcacccttgaaaggggggctcccgctggcgatgtaagtgtaagcagctggggagggcatccgtcggggagtctctgcaaatgcctgcttcccctgggttcctgcatgtgaggacttttgtggtttgtggggaagagcctttcagtgagaggtctttttcaggcctcacctctcattactaaccagtgacaccaatcacgagctcagggaaattactcagaaaccttcccaataaagcggagctaccggagtagtcttgaaagacctgttttttgttgttgttgttttgttttgttttgttttttgcccagggtgcaacttactaccttgagcctatagaggcagccggaacctgtgcctcagtacacaggcctctgattctctgaagctaagtgggcatccagcaattcagttcagttctgacactgactcctacggttagcccagaccccgaaggttaaggccccagtcccacaagacgcccattgcacgttccaggggccacctgtacttctgattggctacaaattgggggttcctgcaatcctctcttcaggtctaataatcccctaacatgactgacagagctcaggaaaacactttcatacacttgctgctttgttatgaaggataaaactcagggacagccaaatggaagcaaggcattggccaatgtatggcgggtggttgcaatgctcccctgccctctctgggcacctgaccctcccagcacctccatgtgctcaccaaactcaaagctccccaggccccttatgtagaggtttttatggagctttcttacgtaggtgtgagtgatgacatcactgacgattgctcattgaactcaatccaggccaaggtgccctccctggagatgagggggagggctgaaagttccagtcttgtttgtttgtttgtttgtttgttttgagatggagtctcgttctgttgcccaggttggagtgcagtggcatgatctcggctcactgcaacctccacctcccgggttcaagcgattctcctgcctcaccctcctgagtacctgggattacaggcgtgtgccatcacgcctggctaatttttctatttttagtagagacagggtctcatcatgttggccaggctggtcttgaactcctgacctcgtgatccacccgcctcagcctcccaaagtgctgggattacaggcgtgagccaccgtgcccagacctaatcttctaatcgcatatttggtctttctgatgtccagaccctgtcctaaagctatcctgggtccactagaggcatcttattaggttgaaaatggcttattaatgactcagaaattccaagtgttttaggagctccatgtcatgaactggggacaaaaaccaggtgtgtagtttttatgatgccatagctataaacagtcattgaaagacagtggggcattcttagcaacacacatacctgggctgattgaaatctcattcttgatttaagtctcattattgaattcaacttgactgcaattgcttaacgtgggacgtgcctgagacctcccagctagtaagtcagagagtcaaggctgagcctccaggtgcggctggaacagctcccagtgggaacatgtatctgcttcttatgtctggacatgtgtatgtctgcatgcttggcaccctgttacaaattcctctgcaacatgttcatttttccttagaatttcccccttgtggaagaattattccatagcttcaggctataaagccttcttcccagaaacaccatttttgttgttgttgtttaacctgagttattgttcactagaaaagtgaaggtgctgcactccataaccatgtcccagaagcgatcagagtatgttggcacttgcattcagttctgtatttacaaactgataaagacaaggtgaaatatttgccttgttaacatgagctgttcctatagctaaggcaattaaacggaatttcaagtacaggcagtccttgttttgcaaggtactctgttaatggaaacatggtgtttcatgtggggttttttggttttggttttgttttccttttgtttttcagatagggtcccctttgttgtccaggccataggcggtggtagcacaatcgtagttcactgcaacctccatttcctgggcgtcagcaatccttctgcctctgcctcccaagtagctgggaccataggcacacaccaccatgcgcagccgggtgtggcagctcacacctgtaatcccagcactttgggatgctgaggcaggaggatgcttgagcccagtagcttgagaccagccaggtcaacatagccagaccctgtctccacaaaaaattagccatgttttaaaatgtatatggaagcaaagtgtatgtggaaaccacatgctgccattgcatgggaccagttatggtgaaacccacagagcaagggccctcatgaggaggaatttctctcacaaggtaccctgcaaagaggcccatggaatgaattgtgttttaacatcttggtgttctcattgacaatgtttgttttagacttgtcaaagaaaaatgagcagttgcattttttaaaagtcatttagcttttagaaagttctaaacattttccttattattaatctacatttacttacagatatatttctcttgcagaaatgaaatgtttcctctcatgcttcttacttagagacagtgacacattgtgggtcttcctcctgtgatgtgcatattgtaatactaaaggaagtttttcccaagctcctgtcagggaagcagccctggttttgtacttggcatttgtgtcaggaatacaggaggcagtggccaggggccgtgtggacgatcttggagctcttcagtcaggccctgctgctgcttcttgcccgcagtgtgggtgtgagctcacaggagcagcatgcctccagagttcaagggcattccattaaatcatcagtcactgaagagacttctgaatctcttagggaattgccttagggaattgatcatgccataggtgtcaccaggttaattaggcatagtagtagtagtagtcataggaaagtagtcaaaaacaagtaggatcaaagggttattaattatgttaaatattaattcccatcttactaggagaaagtgtccaacagagctgacattaaagaatcaagttttcactgagaatattttctaagttattcatgtatcattattttgttctaaaaaatatcaagcaaacataaggccaccttcagaagccccccagaaaccaccttcaggataatgagcacccatcgagtgaaagcacccgcccactgtgtgccaggcagggtgcgacatctgccaacacatcccctgaaggccagagacccagtgggtagagggcctccatgtgccgaacgccaggtcctgagacttgcgagtgtgagcacactcattgcttggtggggacttgagcgaccaagctgggaggcaccccagggctctctgttcccagccacaaaaatgccatcattgttgtgaaacaaaaatgatggcattgcttacatatcacttctagggttgatatttattacaagtaaaaccagaaatcggaaatcagttttgttttttttttttttttttgagacacagtcttgctctgttgcataggctggagtgcagtggcacgatctcggctcactgcaacctctgtctcctgggttcaagtgattctcctgtctcagcctcccaagtagctgggattacaggcacacgccaccacgcccggctaatttttttatttttagtagagatggggtttcaccatgttggccaggctggtcttgaattcctgacttcaggtgatctgcccacctcggcctcccaaagtgctgggattacaggagtgagccactgttccggctggaaatcaattttttacagcctagccatcactactttgcgtgttttagttttcttgtacttgttagtgttgttttaggagctgaatttcaggttttaaaaaaattatttttgtttttgtttttctgttctattttcaagaaagttatacatgttaaactgcataaacagatagagtagactcattttgccagcctaagttttgtgtatattcggtatctgtctttttttgtataataccagggttgaagttgtgagataatattcacaattaataaacaagggacgtggtagattctactctttttcgtggaaacctgcatatttcttaatgaataagggctaagtccacataaataggtagactgggctcatttcaaccagcctttagacatttctactcatagcccaaactattatgctatcaccttgttaagaatacagtcttacaggtggtggttcatgcctgtaatcccagcactttgggagtccaaggtgggaggatcacttgagctcaggagttaaagactagcctgggaaacatagtgaaaccgtgtctctacaaaatataataatgatgatgatgataaatttgccaggtgtggtggcgcctgcctgtagtctcagctacttaggaggctgaggtgggagaatcacctgagcctaggaggtggaagtttcagtgagccgagatcatgccactgccctccagcctgggtgacagagcaagactctgtctcaaaggaaaaaaaaaaaatagagagtacattctgggtggtgacttagggatacaggtgttctgtgaaattctttcaactctgctgtacgctggaccatctctacagtgcaatgttgggggaggcagctctgcctagtgtgacagtcagaccaaaagttcactcaggcacaaattagagcatcataggggaactggggatggcacagggcctgagataaatgctcagcgtttttacagagaagaacagagggtgggattagtgctgaacagaacaagtccaacaggagtgcagccaacacagaatcaatcgtgaggactttggaaaccaagcagaaaagtttacacatggtacaataggcatttgagctcactggaaattcttagaaggacacattggccatgtctgtgttttagagctcagtggagtactgggtgacagattagaaataggcagtaagggaggaggaagtgccaggtgtgattccaatgtgatttccttcagggaacttatagttcaattagaaaaaaataagtaatgtcaaaagttataggaggcttaggagaaagtgaaattaagaaaactgtcgctgggcatatattcatatcaacttgtaccaaatttgaagaactttttgcatctctgtgactctttcctagatttaaaaaaactgaaaaaaagatgtagctagttaaaaatacatgtatttttctaatacctgtaactgcatgtgacatttacacaaagtttcatcttaacttatccttatcgtacattgcatatgtcccaaaagaatgcagacaggagcaggcaggctgtcagtgtgagctgacctctgtaactggaacttcttttcctccgagaataatagagaacaaatagctgtatactacttatgtccaatttaaagttaatatttgggccaggcgtgatggctcacgcctgtaatcccagcactttgggaggccaaggtgggtggattacttgaggtcaggagtttgagacctgcctggccaacatggtgaaacctcatctctactaaaaatacaaaaatcagctaagtatggtggtgcacacctgtaatcccagctactcgggaggctgaggcaggagaatcgcctgaacccgggaggcagaggtgcagtgagccgagattgtgccattgcactccagcctgggtgacagagcaagactccttctccaaaaaaaaaaaaagttaatatttggtgaccagctgagctttgctggacctctggttttggggagattagatgttcttgaatcagcttcttaccctgcaacactgagttacgggcacagccacactggagctgctccagagggtgaggaccgtcacctgccattgtttgccaccctctgtgggcctcaggaccccacagcctgggtcctcattgctccagcctcaaggccacctcctcctgtcacccatcatcgctgaacaaaataggcatgcctctgctcacttgtccttggtattatttcatttccctttctcccttctttcgttatttaaaaaaccgtaataacaaggaccttcacggttactgtccttacacttcttttctttcattgaacttgcctttgggcttggtgtcccttctgaatttcctggcacgagggcacttgcttaaaccaaatttcactgtcagaggaaatgtgtttcctctaccctcttaggtgcagtgattgggggcctgtaaatcagactaacaaaagacagactatcaagagtaaagatagatttgtatttacatacaacgaaggagttcacagaaaaatgtgactcaaggaggcagttagaatttcggatttgtatgtcatcttaacatggatgggagagaggcagaaggacacacagaagaataaacttttaggaaaacttttaggaaaactaagtgggccgttaggagactagatggtggataagatagttttataacaacatcttttggggcgatttctcatctaggtgtgacaggtgctgacttcttatctttggtgataagactcacacttccctggttgtgaaactcctgagcattggatgtatgagggctgagggctgaattcttctggaaggctttccttagaaagggaagggagtgcagaagccttctgttcctgtacttgatgcttactgtcttcagctctaataaccctcatgccactgtggcatgttcctcagtccatggaggccccatctgcttctccccaacaccccatcattactcccctgcccccttctctgaatgcccagcacccagcactaataagaggccctctgcctgccgagcgcacgtggcatccttgtttctaaacaaccctgaggtgcccggcccctggttctcaggtcctgcctttatccagcccgagtagccttacgtccgtgtccagaacactagccttggggcatcttgctctcccagatgacctcggtgtccctcagtcttgttcccacattagctgccaggtgccacaatccctgtttctgactgcatcctcgcctcctcacctcgcctcggggggcatttcatcctggcatctgccgctcctgactgctgaaaccacagacatccgtttcccacgctcctctgcaacgtctccctctgctggctgcaccatgcccatccgccctcatccactgctcccactgtttctctctgcacttcctctcacccaggaactcggttcagcaatccccaaatgtcagcatctgtgtgtgtgcaggtgttgttttggtgttcatctcactctgtcccatccccctgggtgatcttatctgctacttgttgtcactgtgcctgactcaaatcttggtttctggacatgggtagagtcctgggcccagtggtctggaaaggggccttgggaaaatcttatgtaaaagttcagccaggccacacttactaggagtctcaatagaggttctcctaccttaaatctactcttggggaccctgctgcttgtctgagccccaggctcatgaatctgcactgcctggaagtcatgagcacctctgaaaacacggccaacactccattttcccacattttccttcagcctgctcctgtccctccaggcaccctggagtccctcagccaaccttgaagcttctcattgcacgaggattctctctcctcacatgccgtctgcagccagcaacctcctttatccatccacttcttaggccctctcttctgaaaacctcccttgtcctcatttgtacgtttcttcccttcctgaattgaggctgtaggtagcagctgctatgttgacttcaaggtctcattcccagcctgagaacacagactcctcccctgtccccacacccaaatcagaggctatcaatgcacgatatacggaagcagaagccaatagacacagaatccagtcactgattctgtaggtaaagaaacagattcacaccaagggactcaattcccctctgtaagcttttattgaacctttcgtgtacgtgccattttatcagattgcaagatgccaggaataccgagtgatttaggagcacacactgtcatttagttttaataatagccaatgtcatttcttattagaatttagtagttatttcttgctctttgattttcagttcttataaactttggcaaagaaaccctacattcccagctatagtgtggccttctatattagtctgttttcacgcttctaataaagacatacccaaaactgggtaatttatacaggaaagaggtttaacggactcacagttccacatgactggggaggcctcacaatcatggcggaaggcaaggagcagcaagtcatgtcttacatggatggcagtgggcaaaaagagagcttatgcagggaatctctcccttacaaaaccatcacatctcatgagacttactcactatcacgagaacagcatgagaaagacctacccccctgattcaattaccttccaccgagtccctcccataacatgtgggaattgtgggagctacaattcaagatgagatttgggtagggacacagccaaaccatatcaccttctttttcttttcccgtggtgttccccacaaatagagaaggcattcctcttctgtactgttatttcacaaaccctgactgacacttagtctcgtgatccttgtctccatctcctgccactacagctgcagtgatgtcaatggggaggctgtctttttcaccttcaggctctccctctccccttgggtacatcatcagctttgataggaggtggagctgtgctttggccaggtcacagctcagtaagtgttctggcttcttggcagacccacagccacctgcgttcctccagactggtttccagggcttacagtcagcggcagaatctgtcctcctttgatggagagctgctcgtcattcttggggaacttggggcactgcagtgttgatttctagttcacagccctgcagagacctcgacacaggttgcatgcacacgggcccctgtactgttctgcagaattacgccagagctgagccattcctggggcatgagggtctctgggaaaacacaaattagaggcatgaggcccttctgcactctgtcaaatgcagagaagtgaagaaataatttcactaaatgctagagaaaaacagcaaatctcagaacagaatgaagttctgtcctctcataattactcttcatatgtcttgccttcagatatcttctttatgcttggctggagaaattccaggatggcactgtgccctgtgctttgtgtggagaaaatatgatggatgaatccctggtccactatttcccttttaaaggcagatacttgtatgacaatggaaaatgtaacaaaacttcatttaatcagcactgtgtgtgtgtgcgcatgcatgtgcgcacacgtgtgtgtgtttatgtgtgtgtgattgatatgtgttatggaaaaagctcatgtctctggaaatactttccagcaaaaaacatctaatagcttaatctttatagcagtgctggttttggccctttaacttccccgaagttgtaaaccaaaaaattgcagtctccatatatgttttattgcatcctctaaaacaggagtccccaatcccctggccatggaccagtactccatggcccgttaggaagcagggcgcacagcaggaagtgagcggcgagtgagccagcattaccacctgagctccgcctcctgtctgatcagaggccacattagattctcacaggagcctgaaccctagtgtgaactgtacatgcaggggatctgagttgtgtgctccgtatgagaatctaatgcctgatgatctgaggtggaacagtttcatcccaaaaccagcccctttcaccccccacctatctaggaaaaattgtcctctacgaaaccggttcctggtgccaaaatgctggggaccactgctctaaaacatgtatttttttatttctggactgtcactcaaatgcctcaaaaaaatccatgcctcgtagttccttgaaacactttttaaaagaactagtagccactattagtacaaatgccactaccctactcggggcatttcattaggttggctggtgaccagctgtgcattttttgtaatgatactgtgttcactgagtctttttgatagcaaggtttcagacaactagccagtaaaaatacaatctagtcactattcccccatacactagtgcatcaagttcgttggtcctgcattaccagttatcttttacaattgtgtcaattttcaaaatatcttttagcttttaactagtaattattactaataattattggatgttttgggctaaaaccttgctaaatgtttagcatctcatttaatgtagtaccacagattattggcaaatttgggcattgtttctcttcactgcgattggaggagaatggtgtattgaatacagagaacacgtgacccataagtagcactagtgctgtttgtatgtatggctccccaccttgcattgcataacattgctgtagttgaggaatccgctttttaaaagtgtttggcctgggctaatttgcaataaagcccgtgaactctcccacccctggacatgttgtaccttccttgtaccttcctcacccgatctggcctccacaatgcttgtgtacacattctcggacttgccctcacccaaactagaatagggagaataaccagtgaattcagcctcgttatgtttggggatttatgcgaggatcaaggtggcatttcagattgttgtgaaacagatggatcagtcaggaaataataccggggtagatgtcttgccagtggagagggggacataaaccccaaggctctggcttacttccaacactaaggtgaatcctactccaatcaaatattaacatgtaaaactcgaaccaagtctccttctggtgataggacctaagcaagctgcgctaactctccccttaagaacagtgagaaaaactggacaaaaactcgaaagcatctttttgaagggatctgattacccagcaggtagggaacggtgggaccctttacccctagagctgtccccagaagaagtggctaatgagaatgagaagcccgagtttgttttttgttttttgttttttctttttttggtttgggggcaggggggctgaggtgggagaatcacttgaacccaggaggaggaggttgcagtgagctgagatcacgtctcttatatagaacctagtttgaaaaggaagggatattttaagtcttttaagataatgttaactatttttctttctttagctctatttctgtgtgtagctgttttactacaccagaattcagcaagtgatagtttcttaagagttagttgctatgtggaaattgaagccctatcagtaaccttttcctcctcgtgtatcttcaaatctattaccgagccttaaactttgaatggatcttgtatccctagcttattcaagggttaagaaaatacgttttctgtagaaaagaagacatgttctgtggctcatccagagtattatttgagctgcatgtctatagtttaatcacatactgttggaggtcttcctgggagatgctggaggcccaggagtcaaggggctctgtgtgccgttctccaaacacagctctctagaaagaaggttccagcatgactcaggagaggttggtgcaaactgggaccctctgggcacctctcagggacacagactgtccagctggttacggaagcacatctcccacctgatttattcctaaataggagcgaggagggggacaatctttcccttcacccccacatcttcctttcctcttccctacctccctgtattaatactgagaaaccacacctgaacaatgaaatgactaggaactacggtttctggttgtgttcccaagtgggaatatgggctgttcacgacctcggaatgtagaatgccctcattatttattcagtagacatccaataaatgcggatcaacagcttgcctatctttgatagtttttggcagtgtgtgctggttttaatctttgtacttgtcccataagtgaccccatgactagagagtgggctcttccatcttgtaagagccttctgttcacgttctgttctttttatgagaaggaagttccagtgcatatcccaacataaagagaaacgttgaatacgtactgtttttctcttatatatatgctcaaaataacgactgtagtaaacagtcgtcatgattataggatgaattacgcagccattcatagatttttgtagttgtcatttacaagtggactatgcaatagttcataggcttatgaatacataatctaacaatattagctgggtgcagtggctcacacctgaaatcccagcacttagcgaggccaaggtagcttgattgctagagcccaggagttcaagactagcccgggcaaagggcaaaaccccatctctacaaaaactacaaaaagaaattagccgggcatggtggtgcttcccggtagtcccagctacttgggaggcaaaggtgggaaggtcacctgagcctgggggtgtcaaggctgcagtgagctgtgattgcaccactgcacccgagcctgggcgacagagtgagaccctgtctcaaaaacaaacaaacaatattatacttgtagtatttaaaaaacataattatctggtattcccatagctaatagaatgaaaggggagactttatctccctagacaggaagcacggtacctcctacactctcttctccccacatcaactggataggtgtgtgaacgcatttcaaagtcaagtatggttagtaattacttgatctttttccagccccttcagataagctgaattgaacacccaaaagtgatagtaacatcattttcctttgcaattacaaagaccattaacccaacagaatctccatgctttacctgtttgtgatgtttttgttccattttattaagtatgactcctgataaatgaatcactacacaattaattttttctcattctttagattcatacacacagacacatatatcaagcaaactataaattgctaaaatgacaggccagcagtgactacttgttatcacgtgtgtaacatctcttgagggctgctttgtaattcatttgtatggtgttgttgtaccagtgtaactgctaagtggtttctctggttccatgtgcatttgtacatgaagttgtgcaatctccacataccagcagtttcaaagaatgacagtttgcatgaggccatcttaatagcaggtagcatgtaaccaacccatctgaattaagccaccattgcagaataaaacatttgacactaagccaggtatttcagtggatgagttgtattttggatttccaaaaaaaaaaaaaaaaaaaaaaattaagcagtcatgctctcgaataatcttactagacataaacaatactgctagggtaggggggcactgcctttaacaatggtcagagtttcttggtaaatcagtggttttgcttctttgatgtttctaaaacactgatatgcccagttgccctgctctgacctcatctcaccctccccagcttccctccccacccacctcgtaaagcacagacctctcagcctgaccccttgctccctacctcactcattacttctggtttccttttggggccttgtcttctgcctgcccccagtacaatgtttatttttctgcatgtccatctcatcctgacaagcctctccacactggagtgcagccagtagctgtctctgctaagctcttccctctgcctgcatttctcaccccacacacaccttccatttcccagtggctacatacatcatgtgcgattatgcctgtctttcatgacctgcctctgaccagaaatccctgagtcatcttccctaaacccactccttcaaatccaccttccaaatcctggtgaatggactgctgtccctgctccagaggactgtgtgcctcaaacagggctccccacagtgggcctgtattagcagggattccccagtgcatgtttcctgccttggagaccatgaactccagggaggctggagagctgtctgctctgctttctgtcttctgcctgcccaagacagtactttatgtaggtgttaatttcctaaaaatatgtctaacatgcttgaattgctgatagctattgattaaagcccagcttctaatataaatatgcatttctgatgaatctcacaaaaaaacaggaagaaacaaatgccattaatttgcagtttatcaatatcctggctagtaattgagatatttagtggcatagtcactagaatataaggtgctagtcccagtcccaacacgagcttgagtaattttaaacttcatagtgaattttttgtaacgtctacagaatggatcaccattatcataataatagctgatagcgacggagcatgtcccatctgccaagcactggatatcattgattcattcatttataaaatttgaagttggtgggagggcatatttaaagactgctacctggaatagtgttatttgtcagagattcatttgtttgttctccacattcttcaatatatgaattattccatgcaattgaacagctccccaagtacgtcatagttatgaaatgttgtgtgttgactttggaaggttacagttcatttgtgatcttccaggcagcgggggtgggggtggggggattcttctctgtagtgaaagtgtttttctctgaaatcttcagctactttcctactctgtgaagccttcttctcctgggtcagtgggacccttccttgagagtggtttcagtaggttctccaaaaactgttcaactgagtaaaattgaatagaatagtccatgcattttgtcccaaggtataaaaattggctttggggaggtgaaaatgaaaccttacttttttttaatgtatcaagcaccaatacacatacagaaaaatatagtgtatctgtgttattataacatgttatggggatagactgttggggaaaaataactggaaaagcttttttgggggtgatcatgaatgaaatggttgagaaacactgagttagtcatacacagtatcagacaagtactgtgtcagtagccccagtaatttccaccctcaggccaggccccacatccagcacattctcgctcttctctagcccccacagccaggtcagtcttctagcccaggctccatcagcatctcaggttagagaaaggaaggcaagatgccttccacctctgttttccaggattgagaatatgctcacgcccctctctatctaaaggaaaggagagagggatggaccaggccctgtgttgccctcacaggtgccctgggcgccattttgtcatgagtggtcagcagagcccattgccgaggggcctagggagggtgccctcacagagctggtcccttcagttctgaattaagcagtagcctcaatgccatgtaagcaaccattcctgcaagaggataggcatttaaggtgaaatctgcctcatctgtcgttatttacaggtaagattcagaatagttcaagaaaacaaggcaaatgaattgcatttgcattgacgtgagtcatgccacattcagctactctttgtgaaaacgtccccaaaatagattcctcggagtgctgctttgcgggaccttcatcgatttgctctgaagataggtgtccatgcctgagaggcctcagtgaggtttcaactacacagttatccatggcagcacttctggaaacatttctgtgctaattgtacatggcaggtccccagttcctcatttaatgggaggaatctcctttttctggaaaatttctctggactgctgtgtcacagaacattctagaaaccccttacctcatgaacattctactactagacaatttagaattgaacgttaatatgggcatgggaggccagtgaaaacaacataagcctcacctggtactgcaacacatctttgtttgggaaacactgactttgcaaccacagctataaacaccggcttttatttcaggagtcagcagttactatatttgcaggaaggagaactgagggcatccctgtgaaaaccagaaaataaatccatcctgaagggcattggctttgtaggcctctcatcccctgttgagtaggttgctgggccatgcacaacgggtgtcagtatggaaaggaccaaggagaggaccgaagagaggcctctgcattgccagctgccacgtgctcaccacacagacagctcattggctcatccaccagctcatttaatcacgaagtcttttaatcccctccaggtccaatgaattccttaggcttttttctctgtgtttatcagttcccattataaatggcagcttcttctacatggcacatttggagatgacatggaaaaatcactcacacaggccagcaaaggcactctctttatgctgtgataatcctgtttggggaagccccctctgtagcttctctcaaaagcaggcaaacatcgctgtgcttttgctgtcctgacaatgtgtggagtcatattatacagcaagcataccacaagcaagtcacatctaaggcacctaaatgtggtttttccataacgaaagtgctgttgaaaataaacacaacttgctgctctacaggttagagcattttaatcccgtacatggctaatcttcccgagtctgtctgaagtcataatgtccctctaaacacacaaaaccgataggggcctcccgtcacacttgcggatcatgagtctcatgcagaaggctacgtaagatgaattgatttcacatgttttactcagaggatgtggaaaaagaaaatgattctagtgaccatctagaaacttgcggtttgtttttgactttaagacagtcagcacctttcagggccttgctgggttttcactggtttctgacagattggtggacgcggcatctgtaccattaaaagaggaaatcaggaaggttttttgagctgtcttgaagtcttttgctcaccacttaatttacatacatacactttaatatgcatgctaagagtgcccgtaatgtacttttattgagtaaaatgacacagagagaattcgttaggaagctttcctgcccaccccccaaccaagtcgttaaataactttttcaaaggctgttctctataggagaaggaatcaatttaggggtgtagttcattcatttacctagcttgtaactctaaagggttttgttataaacatgtttatatcaataatggttttatagtttgattttcagagcactatcgattcagtaaaacagtagctctgcggtgcacaagggatactgacctccacctcagcactattacttagaggaatgcagcaccatatgtagcttactagtaggtaggtggatgtttggatgaaggaagggagagcaggaggaagggagggatggatagattgataaatagggatggatggacagatggatggattgatgaataatataaacaaaagtactaattaataacaaaatacacacatacctcagcagtcattttgacagcagtacttaaaagtttcatgtttaaacaaacatctaatagtgtatatgtatccaacatgacaacattgtggtacttatttacagatcactgtctgacaaggaacatgaagtcaaacagaacttaaaccttagatatgagcactgccaatcaaaattaaaaacaaagtttaaggcccccttgaagttttgatgtctcaccatgtgaaaattgaacttcatattacaaaattaatgcataggaaaaaacctcctatgaaaaagcctggttttggtgatgagattcagatcatacatggctttataattgatgaatagttgtgagcagctgctgtactttctgtgcttccatgtaattccaggaccgcttctgggagccctgaaagtacccttcagtgacttccttccaaatgttgtatttcactaagcaaaagggaaagctttattccttagagatgatatagtaatatttggaaagctcactagttccaatgaagcacataatttaaaacagacacatcatagtttaaaaggtaaaatcggttacgaaatgtgatcccaagtaggcacgggcagcactctgcctgtggcctggaggaggtcccggtgtgcaggattggaaaggggctggctccttccctgctgtgactgttctgtctgcttcccgatgggacgtgctgttgatcccagctgctgagaagaaatggtgggcaagtgccacggggacaggatttgcagcagggaggagccaaaggtggaagcatcaccgggaagtgagacctggggaggaacacgagagcatcacaagccgcgggcccttctccttccctcttgaaaacctaacctagctcctgacactgcctcctactgtgttcccttcctgcccaaactgtacctagagctccatccatagacctcgtctgctcaccgcacagaaatgccagggctgccgggatcccttc

SEQ ID NO: 5450 - DNA, 63401 bp, human
cttcctcctcgcccccacccagacccagaaggcgccaccatggcggcgcccccgcagcccgtcacccacctcatctttgacatggacggacttcttctgggtgggtagtgtgcagccgccgcctccagtaagggcggtcttgtgtgggcgtggggacggtcggcgcggggtacgtcacggcctgggggccgcggcggggcggtgttcatgcagggacgctcgggctcccgcgcgctctgcccccggctggccccgaagtcgggcggcggccaggagcgcccgcgggcccatgtccgggctggcgggcgcgcgtggccgcggcgtctacgcggccccagcacccgcttccggtcggcggcccgcgcgtggggccggagcacgtgggagcagtccctggggtccaccgggcgggcgcgcggctccgcgtcctctcctcagagcgaggcgcggcgggacctccgcgctctcttttcggttacgcatgcgtgcgaccttgagcggtgcccagcctcagcttccccgtctgcaaagtagcctggaggatacttgcctgcctgctccaaggttgctgctgtgggcgcactttgatggtagcatcctgcatggtagcggttctctacctggcggttttgcagccctgagggcatctggcaatggcgatgtcaggagacattttggctgtcacagctggcgaggagtgatggggtcactggcatctagtggagtccagaccagtgatactgttaaacttcccgcagtgcacaggagtgccctatgcaaccataaggaattatcccgcgccgtcaacagtgtagaggcacagaaggtccgtcaagtggcctggctgcctagggtgaccagcaccggggacatcacctgtgggctacttgtaaatgtagaagctggggccccaccctacccctgcccaatcagaatctgcattttaagcgcgtgaacgtttgagaacagctgctctatcaatccgaggcattaagaaacccttggcagtgtactaaggtagtcagtcttagcacatgtgaacttcaccagccaagaggaattcaagtagaattcaaagaataaaaccctgtttttaactcaagacagaactatgctgagctctaccgaaagccttgacacagttaacactatgacacataatcaccaggaggcttcatatatctataaacatgtctgcatactctttgtagacagctgacctgcttggttacgtatatcattccttcatttcaaaaccctgcaagttaggaggaagtatttgcatgtcactaattaaaaaaaaaaaaaaaaaaaaaaccctgcagctcagagaggtaaagctacttgcccaaggtcacacagctaataagccaagctgagaaacgattctggattgatccagttctaaatataaatgatgttgagctcatcttaaattgtgaatgtgaccttgtttctgctcatcatattgctgggtaattccctagcagtgtttccttttaaaaaggcatgcagaaaccattctcttcattttatgaacacagaggtgtaaactgatgaattccaaaggaaaaaaaaaatccccgtagaggtcactaattggagccaacggtgtatgcagctactaaatttgaaatgactcaatttcagaaagcttgtgggatacataggtatagtttgtagacatgaattttcctactccggtggtcaaaaagttaaattgtcaaataaatttcttatcctctaataaaggtccagagaacctgttctgggagtctcatgaattttaataccaaacaagatgtctcattaaaattaaatttattaaacttctaaatgagcttggtgcctaattctgattctagattcacacatagccatgccctgaagtgatgaatgtgacttaaatggcattacaagcattgacctcacattgttacccaatcctctgatctagtcagataaccaagaattagtgctatttggaaaaataagccctgcttctttttattcccccccctcattttctgcccatttcctcctttcctgccctacctcttctttgaggtggtaaggccttgcaaaactttcttggaaatatacctttgtttatcccattctttcaccaaatgtgtaaatataaaacacagctttccaagatgtgccactttaatttaatctaccagattatgcctgctgtcattctttagcacctcacttcagtgtatctgttgtttgcataacaatatactatcaatttataatgagttattttacaataggtctgtttttcgggaattttgaatgcatttttctaggaagttctgtttgtctatgtagccccaatacttgcatacttggggaagtaaaattgaaaacgaatagtttcatggaggattgttaacattagaggagaagattgtttaatcagaggagaatgaggaagtaaatggagattttagaggaaatgttgaccaggaagaaagccaggacactttcccatgcttttgacatgcacgatgctgttagttgtcctttaaaaaaaaaaaaaaatacacttcggtttctgtttctcatgaccaaggtaagagtcagttatgatttaggtaatattaataattttggctctcaaatgccattcagagaaagagagtaggggagtgggattagttaaaaactgggatgattttgaaataagaagatgacaattattaaacagtatctcagcagctggacagggaagattattctgtttgtaaataactgaaattaggaacacaaaagatggtcccaatttctttaaaagagaagacagtttgttgtccagagcagttctgtctcatagaattgagccaggtaaaaattttggggagcaatttttaataagtaaaaagatacagatgacattgatttggatgatgtatgttatgtaacctaatgtatcaaaaatattatttaatacaaagtcagtataagaaaatctttgaagtgtttgacattaattttgatactaggtcctcaaaatctgtgtgtgttttatacatacaacacatcttagtttgaactagcctcatttcaggcactctgtagcctcatttggtgggtggctactggcttggacagcatgggtctaggtctttgtggagcaacccaagatgtctgttgataatggctatgctgggagggtcaggcagagggtgggtgttaagaatattcagaattaggagttttggtgtatgtaaaatgtggtatgtgtaaaatgtgttttcttggagtctaatacagaattatttaaaatccttttaaaatcaaaggaaaataagcttatttccagtttcttaaatatcgtaaaataataaggtagatctgcgaagggtaataagaacatttgcagtgttgaccataatataccatatctttataaatccagattgcaggattttaatgagtgacttctacttcacctttagtaaaatgaagacctcttctgtgcctttttgcactcccgtagcttcctccttgccaaataatagcacttgagactataagtgcctgcctcactgtctggggcccaggagaccctaaaaggtcatggaggtagggtctctgtggggattaccaagcccagtactgatgggattgtgggctgcctgagacagttgacagtcatgtccactgtgtggccaaaattccacagacatagcgtgagtgtgttttgcgctgtcattctttgttaacttcatgtaggctgtttctttagacaccagaacatctatatagctgatgacaaaaatagatttttcttacgtaatattagcgcatgccctaggtggattgtcagaagaatctatgtatgttgtcatttgaccccatgaaatacgtctgaggtttaaaagtgcagctgacaagcttttcagcctcagtcggttcttactacttgatgttatcaagtcattcattccaagtgggatttctaagagttttggcacatttctgaggaaggtggagcaaagtgaaggatcattctgcatgcttccataggtggttattgtttaaccccagaacgtgcagtgatcctagttggaatgagatcgtaatcacaatctcccctccttccatcatttgtaatgggtcttgctctggatgtcaaagcaactctggtggtaggttcacattctttctttgccctgtcttccctggaggctgacagtgtacccttgggttttacccttgctaggtgaaatgtaggttctcttccacgtttgcaaaggagatggctgagggtggaggccagtgtgagggcttgggacagagatgaacccttatctcaggggccatgattggcctttcactacagggtgatcaatgagtaatctgttgtttctggaaactgaaaaggcttctggaatatagaaagcacaagacacgtgtgttcctattaagggtccgaagagatttagagtaagatgctatattgtatgttggagaaacagcatcagattatagatttagctccgtttggttctgttttctaattgacctgaaccatgccaaccttaagttcttgtagtaagtggttggttgtccactgcagctgtttctgtttctagaataattgagaagggggtaaaacttaaattgcaaaattctgcagataaataataagagttttgtccagctggcaacacaaatattcagcagattctaggcatgcaggtgtaaaatatccttttcttttttctagctctctctttcaaataaaagcaatatggttttatttagaatctttaagtaaactggatacaggcatgtgtgagaactattgtgggttcagttccagaccatcacagtaaagcaaacatcgcaataaaattagtcacatgaagtttttggtttcccagtacacataaggttaggtttatactatactgtattctattaggtgtacaatagcattatgtctaaaaaatgtacataaccttaaatacattttattgctttaaaaaaaaaagtgctagggatcatgtcatccttcagtgagttgtaattcttttgctggtggaaggtgttgtcttgatattgactgttgaccagagtagtggttgctgaaggttggggtggctgtggcaattttaaaaaataaaacagcaatgaagtttgccacatcacttgattctttcttttacaaaaaaattctcttttggcgaggcatggtggctcatgcctataatcccagcactttgggaggcagaggcaggcagatcacttgaggtcaggagttcgagaccagtctggccaacatggcaaaaccccatctctaccaaaaatacacacacaaaaattagccaggcatgatggtgcacacatgtagtcccagctactcaggaggctgaggcccgagaatcacttgaacccgggaggctgaggttgcagtgagccgagatcccaccactgcactccagcctggacgacagagtaagactctgtctcaaaaaaaaaaaaaaaaaaaaattggagtcctctcaaactctgctgctgctgctttaccaactaagtttatgttaatatagtgaatcctttgttgtcacttcaacaatgttcaacaacatcttcaccagaaatagatttttatctccagaaaccactttcttttcgcgtccctaagaagcagtgtctattcagttcaggtttcatcctgagattgcagcaactcagtcaaatcttcaggcttcacttctaattctagttctcttggtatttccatcacattctgcagttacttcctctgctgaagtcttgaacccctcaaagtcatccatgaggattggaatcaactccttacaaactcctgttaacattgatattttcatcttttcccatggatcatgaatgttgtgaatggcatctggaatgctaaatcctttcctgaaggttttccatttactttgcctagatgcatcagaggaatcactatctatggcatctataaccttaggaaatgcatatcctaagtaataagacttgaaagttgaagttactcctcaatccatgggctgcagagtagatgtcgtgttagcaggcctgaaaataacacgaatctccttgtacatctccatcagagctcttgggtgaccaggtacgttgtcagtgggcagaaatattttgaaagaaatatttgtttttgagcagtaattcttaatagtgggcttaaaatattcggtaaaccatgctgtaaacagatgtgctgtcatccaagctttgctgttccatttacaaagcccaggaagagaagattcagcatcatttttaagagcactaggattttcagaattgtaaatgagcactggcttcaagttaaagtcaccatctgcattagccactaacacaaaagtccgcctgtcctttaaagctttcaagccagacactgacttctcctctctagctatgaacgtcatgggtggcattttcttccaatagaaggctgttttgtctacattgaaaatctgtttagtgtagccactttcatcggtgatcttagctagctctcctggataacttgctgcggcctctccatcagcacttgctgcttcaaggagctgttcaaggacagagcaaggagcaattctttccttaaacctcatgaacttctgctagattcagacttttcttctgcagctttctcacatgcctcagtccccatagaagtgaagagagttagagccttgctctaggttaggctttggcttaagggaatgttgtgctggtttggtcttctacccagatcattaaaacttcctctatgtcagcaataaggctgtttcactctcatcattcacgtgttcactggggtagcacgtttaatttccttcaagaacttttcctttgcattcacaacttggctaattgggtgcaagagacctagctttcagcctatcagcttctgacatgtgttcctcactaagcttaaccatttctagcttttaatttaaagtgagagatgtgtgactcttcttttctcttgaactcttagaggccattgtagggttattaattagcctgatttcaatattagtgtgattcagggactagggaggcctggaggagaggaagagagatgggggtctatggagcaatcagaacacacacaacatttatcccttaagttctctgacttatatgggtgcggttcatggtgccctaaaacaatgacaatggtaacatcaaagatcactcatcacagattgacgtaacagatgtaataatgaaacgatttgacatattgcaagaattaccaaaacgtgacacagacacgtcacgtgagacatgctgttaggaaaatggtgttgatagactttctcgacgcagggttgccaaaaaccttgaatttgtaaaaactacaatctatgaagcacaataaaataagatatgcctgtataatatgggacagcagtgcatcgttttgttttgttttgttttttgagccagaatctatttttctccttgaaaagctatatattagagattatttggtcctttttatctttgcgattattcactccttactctgattctatttctttttttttaaactgctataatttatatactattttctgtcatttttcaggagtagatggagacttaaagcaatgtaaaggagcaaggtaaatgatatctcctaagaaatgtcccctgaaagcactccttatatagatgctcaggcgactggtcagaccttctgatgagatgtttgaaaagtgattgataggcagtctgtaggtagaaagcacaatagtgttattctggaatacattacgcttgaaaataatgctcctaccatcggctataagggaattttagtgattaataaatgcagcatttaatatattaagagcttccttcaatagtgttaaaatggtggaagggggcaaccttgattttgtgttgcagatatttgcagtttaaaattgccttgttggtgcttaaagagcatttttttgaagacatagtaatcctaacacatgcatttctactgtgtaagagcacaaaaaggaagacttttccccatggcttttcatagctgggccatccatgtggcttctcttcacatcccttttcagcaatgtctggcagatagatcaccacctttcctgatcctcctttatcctctgtctcccttgtgtcctttgctgtgatgccaacagtgagtagcagctaaggaccctggtgcagctggccacgtggcaaggtgcctgcgtatgagaggaggatggtcacctcttcacagccatgcctggcaggcagtttcatggcattgcttgtggcgcttggtggggcccttgactcttctctctctgagctctgggagctgggccgaatgatgtgcccttttgtgattgatggtgccttatttaaaaaacactgcagatgacatagctgttcaaggacagagcaaggagcaaaccaaagtttgctctttgactcccaatagactgttccatgtgtctatgaagtaagagcaaatggtcatagttggcacatcgaagcttatctgagccttcagacaaaagccaaaataagcaccaaccctctcccacttgtgtcagctgccatgcacatggaagagaagcacatggtccttgagcactgtgcgcctgtctgctctctagcccagcactgtgtatccagcaaatcttcctgccaggatggaaatgttctgtaactatactgcatccgatgggagccacagctggaaactgggttcatgagatgtgactcatgcaactgaggacctgaatttctcgtgttatttaaatagcccccaatgactaattgccaaaacgtaacatagagacacaaaatatagagtggacagcacaactctagaggaatgcattcactcatccttaatctatttagaaaatactctgctgggtgttacaaaggcttcaaaattagtctcttcctttaaggatcttagagtcctgctggaatctaaaacatgattggtaaaatctgtgaataattgctaatgatatacacaataagaatgtgttagcaacagtgcaggattttgaactgaaatcacatttggggtagcatactgtcaaggatagataggagccaagaagaaaaatggatattccagaccaggagaaatggccaagccataggcatctttactaaagcatagaagagagtcgttttttgttgttgttgtttttatcaagcaaagactgtattaaaaaagatcttgctaatgattacattgaagtgtggaggtgagaagagatttgaaaacataataatcctaacacatgcatttctcctgtgtaagaacacaagaaggaagactttgttttccccttgggtttgcatagctggagcacctgtgtagctcctcttcacatctcttttgagcaatgtctggcaggtagagattagaaatctctaatgtttcattgagaaatacgagactggggctggggacagtggttcacgcctatcatcccagcactttgggaggccgaggcaagtcgatcgcttgaggccaagagttcgagaccaccccggccaacatggcgaaaccccatctctactaaaaatacaaaaattagtctggcatggtgatgcgtgcctgtaatcccagctacttgggaggctgagacacgagaatcacttgagcctgggaggcggaggttgtagtgagctgagatcacgccactgcactccagcctgggcagtagagctagattctgtctcaaaaaaaaaaaaaaatactagattaatctctgtcaggctaagattagtatttcttaaactgggtgcccattggtaatatccctttagcctattttaaagtgaaaatctcaccccatcctgcaagcacacatcctgggttttccccctatgactttcagaagagtctaggatggttatcgagacaccagcctacattctggatttgtctgattgtttccacatgataccaccttacttgttcctctgtcccctgtatttcctctaatctagaaattatgcctagtgcttcagttggacacaggtcagctgcctctggcaagaataatgctgtgccccttcgtcacctttttggggagatgtttgtattcagtctatatagggtcagtaccttcatgctagccccagccctgcagagtagagttgtcctcaggaaagctggtgaactgactcctctcccatagtggtacatggaactttttagtgagaagttcagagcctgagatacaagttagaagtactggctataatgcctgtgtgtgtggacagccggaacccttaggcaggaagaggaggctgccggggacagaggtgtgccatgctgtgcacccttcgaagagaaggtactcacaggaacctaaataggtttcacgtgtatgggttcctctgttccatgcagtgggatacaggaaagaaagagcagccatgcagctgttttctcactgtgtcggagcacacaccacagtctctttgatgtttgctcatgagattgaaggacactcatggctttgtcacaagatgcctgagaaagcacagaggttttttgtttgtttgtgtgtttgtttttgagacagaatctcgcactgtcgcccaggctggagtgcagtggtgcgatctcggctcactgcaagctccgcctcccaggttcacgcctttctcctgcctcagcctcccgagaagctgggactgcaggtgcccgccaccacacccagctaattttttgtattttttttttagtagagacagggtttcaccatgttagccaggatggtctcgatctcctgacctcatgatccatctgcctcggcctcccaaagtgctgggattacaggtgaaccaccacacccggccttagttttattttttttttttgagatggagtctcgctcttgtcacccaggctggagtgcaatggcgcgatcttggctcactgcaatctccacctcccgggttcaagcaattctcctgccctagcctccctagtagctgggattacaggtgcctgccaccacacccagctaattttttgtatttttagtagagatggggtttcaccatgttggtcaggcaggtctcgaactcctgacctcagcacagagttattaaaatcaaatgcagttgcctacgctttgtctgcttttgaaaagtaaacttaatgtttcagactgaggtgtatttgtcattggggtcctatgttctgcacagtttgtaaatctacttcacccaaagtgatacagtgatactcaggagggcttaaaaaagattaaatccttcatttggaaacatcatgcccagtgaaaggaacacaggccctaaggagatgtggctgattctagggaccgggaccagtaaaatacaacatgagcacagagcactttctcatgccaggatgcagtgggcggggttgggggggggggtcccactggcacaatatgaaccatttgtaatcaaaagaataatgaccagaagagagtataatactctgtctatatattttttaagtctctgtgttatgattctcaaaagagtaaaagggtggctgggggtgagctcttttacagaagaatgccagttaataaatatggacagaatgggagaattagccaggtcaccattttgggatcccgactgtaagtggttcccacaagcattgtcagtggaagccaaaatcatagagtaatcatgcaggagacgaaggtgcccgcagtgccatgtcagaagtcactgactgataacagaggcaaacgggccttcagagcgggcagctctgggggccacaattgaccctgtggcccaactgatgtagctttgccatccagaaagcagcatgtcacgtcacgtgtgctttctgaagtgacctcagaaatggttaacctgaatccatctggacctctagcagtttcagaggggtagaggaacacgggagggggtgtcatgtggaaacagcaagacaaatcctgaatgtaggatgttccaccaggtacctggactgggtccttgaaaatgttgactatcatggggaaaaaataggggctggcttttccacttttaaagaggctaaagggacatagtcaaattcagtggaccttagattggggaaaaaaatctataaaagacatttttgtgacaattggagaggtgtgatgtgtgctatttagggggtactatgaaatattgctgatttgcctgggtttggcagtggtattatggctgtgtaggagagtgttattctgaggagaaacgtgcagagagctagaggaatgaagagttagggcatctgcatgttttcaggtgtgttgcgtgcaggtatagggtatgtagatgtttcctatcctactattgactcttctgtatacttgaaaagttaaaataggaaagggaagattaagtcttaagcatgaaccactaaaaacaaccccaaaagcagtattaagtagtagtcagttaattctgtttaagagacaagaatgtaaagcatgcatctttagaaaattgatgttggagatatggaagaaatagtttcagaaccttcagctctctcgaacattacagtggcaatgcattcattgcaatgtgtattatagcagaaaacattctgaaggaagagtcccatttcctagtgctcatttttcagttcctcgtctctctcatagtgcaggagatttgtagacaaatgtctacaggatttagacagatgtcaggaaaattgtcttttgttgatgtcttaattggaatccgatagtttgtcagggcatgatgcttataaaaggaataaaagctttctaaaattcttcaaagagtagccactggtacctgtgtgtcacatcatatgctgatgagacatgacagaaaatgctcctaagtagccttatagctgatcctgaggagctactgtgactgggctctcactgcacctctcagctgacttctgcctactgggtctgtgtcatccctttttactctgaggctaccaaggtcttaggaaactggaggttggagcttgaactgagtgatgggaggaaaagacttcctgaagtgctgcccacatctcatgtatgttctcttggacccagttgtatccctgccattccctggaggttacctgttcatacgcagacttctctttcccttatttacctcaattgcagtagcttggcaaccttttaactcttgctttttaaaaggaaaattatttggttatcgtagaaacattttgtgcagcaaagtgttacacatatttctgttctggcctcaaataatcatggatttcattaaatactaaacattttgctgattttaatacagtgctttagtgtattcttattttctttttgcatctcttatttgcctcgtttatcttaacataaagcatttcctttggttaagtagatccttatatctgctttttctttttgtatgactcctatttaggttggtgctaaagtaatgacggtttttgccattacaatacctgtagacataaaggtctagcttactttttgccatttgctaccctgtgtttagtactggcattttgctgactgctcatcagcttttgatacggtgtgcttacgtgacaagctctttaaagtgaaatcataatcagatttgagatttagaattgaggcgacttgtcctgtctacagtgaaactgaggcaggacaacctggggagctatgaatagtaggaaaatcccagtgaaaatccagcacttctaacttctactcctgggcgcttcatcacttagagttaccagcagtcttggtaccatttgttcatagttttgccagccctcacaggtacaggtacaattgtagatactgaaactctcaccagctgacatctaatttaccagctgatttaattttatctcattgatgattgagaggctctactgatagcccaaaaccactttagcttaggtgaaacatgagctgcgttggtaactgaagcctggcccatctcattgacaacttacttactgtactgatttagtaaaattacccatcctctgtgtccccgagtatggtttgcagcatatcacaggcaatgtgtgacatcttccaggatattgcatgcctaccaaaatataatcagattaaagaacatgttcagttcatatctgacctacggccccattgcactgtttaacatgattttgcaacagagatgtaaccatctgcacatgttatgcatccccttataccattagggtttatgctgagatcaagtaaaatcatatcctctcatagggaggggacgggacttctgtgaagtagcctgaagaaattaacatctttatatgatcacatctataatacagaataataaatgccatgtacctgttgctgtgtttattgcttctgctggctgggactagtgagtgtcccgattttaaggacgtgttttgaaactggcttgtctgtctttctgcctctcttctcagccaagtgtcttgctaaagtgggctgtgtttgccgaactcactcccccattttccttccctcgctatgagctggctttttggccctaccactcacagaaattgttctgacagaggtagcagtgatgtccgtgctgctaggtgcagagggcacccttttcttaaattgccagaacttccggcttcctttgccgcttctgcaccctccttggaaatctttctctttggcttcacggatagttcctcttctggcttccccatagctttcttttcctcctggtgcctgtttggcgtccctatggctttgttatgggccctgtcctcttgtggaaacctcttctgagctcatggcttcggcacatgcttctgctctgatgaccccttgacctccctggctgggcctcacctcttttgagttcctgtctacgtttcccagtgaccacaggctcttcctacccgcgtggccaagaggcagctctgaagcattgtattttaaacggggcctctagttctctgccagatctgctcttttcctgcattccacaccaggcagcaaaccccgaaagccccacagcagatggctgggagttatcttccagtcttcaattccttgccatccccacccacaccttccaggcacctcctgatttataaatatttcaaagccacttctgtgtcattccagctgccatttcctgcttcaggctttcaggcttttttctgatctaatagcaatatttactgagaacctttaccacatgcagttctgttggttacctgcagtgagatcagtggtggctgtggggttttgatgctcatgagggtgaaatcgcagagttctggggcccaggtgtatttgcatgaggtggctttggtgagagcatagccttcaccaggatgtttttggaggtttttctcctagtgtattttcctagattcctttgtcaaaggaatttggtcataaactggcccttaagtactttctaagagaagccttgttcatgtggatcacaatgaccttagactttgtgtgcgttgtcagtgctgccctctcctgggcattgcttctgcattcttaatgcaaatatgtgagttattcctgggtgtggctccatgacttgttcctttctggaagctctagccttatctcagccctcatcttgttaaaccagttgtgctgaccttgcttctctgacagcaacctgataaaagcctgtaaagttgcccacttcaagtcattgagcaatacaggtagccaagcagtagaggtggttacaataaatggcttaacattcccagcatttaggtggctccattcagatggcggaaggcaggtggcactttctgttgtggagaatttgaggagagagctttaagttcaaaaggaatttaagaaaagcctaagttggatctatgagggctctggaggagagattgagatgttcagggtgttccttcgattcatgaacccgactgacttttcacagcaggaccaccagttgccagatactgagacaactgagtcaaatgaatacaacagcatccctgttcttcaggggactgcaggcaggggtgctgtaatttgtacgggggcgggggtggacatgatctgttcttctatattatcatcattcatctgctagagacaactcgattttcttgggagccaggaaaaggaagttggccagtcggatgtgcctcacagcagagcaaacgcatcccaaatgagccaccggaagggttggggagtcactgaggtggaggaggaagggctgagggtatttcaggccaagaggactcggtgagaggcggagcacaggtaaaaaggcctgccaagggcagatggcggcgagccctgtgccaggctaaggaattcacattttatctcgtagccatcatacagcctggcgagcacacgatgtctagaagggtggtgcttctgatgatgtggactgttggcgcttagacactggagactggtagaaggctgttgccattgtccagatgaacgatagaaggactgcatgagttttccacaaactggggggcctaaaacaacaggagattactttatctcagctctggagacaagaagttggaagtcaggatatcagcagggctgcgtttttccttggcttgtagctgcatcgctccggtctcagcttctctccacgtggccttctcttctctccttttgtctcttataaataaggacccctgccattggatgtagggcccaccgggataatacagagtgccacatctccagatccttcacttaatcacatctgcaaaggtcttttttccaaataaggtccgattctcgggccctagggattaggacgtggacatatatttttgggagccacccttcaactgactacaaggacccacagggttggaatgaaaggaagaaaagtggctgattcagaggccgttcagctgacagctgggcatagagggatgggagggagaaggcaggtgaatagcagtgacttgtcctgaagtcgaaattagaggaagctgtgaggcctgaaaatagggatgagttccattttaggcatttggacatgttgagtttcaggaaactgaaagactgggcacctcttaggttgacagcattgatggaaacaaccatgatttcccatttaagacaaacaaaactcttggtgccgttaacccatgaagaaaactgacataggtggccatcgacctacactcgtctttgaacagctacagtacctagaagccattttagtttttacttttattattattattttttgagacagagtctcattctgttgtccaggctagaatgcaatggcacaatctcagctcattgcaacctctgcctcccaggctcaagtgatcctcctgcctcagcctcccaagtagctgggactactggtgtgcaccactgcacccggctaattgctgtatttttagtagagacggggttttgccatgttgcccaggctggtctcgagccgtgcacccggctaatttttgtatttttagtagagatggggttttgccatgttgcccaagctggtctcaaactcctggactcaagtgatccacctgcctcggcctcctaaagtgctgggattacaggtatgagccactgtgcctggcccctggaagccattttaaacttatttctaagtccccttcctcagagagaatacatgcacacacacagttggataattagcctaggaagggtctggaaatttagccatatgcccaccatgttttgtcctcctcctccttttgtgtgtgtgtgtgtgtgtgtgtagtatgtgcatctctgatacaaagggagcagctctggatccctagtcattctccaatcagcctccgaattccccctaaccctgcatcaaaacctgaatccccccaaccctgtgtgaaagcctgccacttcaggcttaatctttgttgacacgtaagggtgccgaactcacaactttgaagtccttttattctactcccttctccttttctcatcccagctgggttgtaaatgtcagggagaagtagagggcccagtcctccttcctggggtagggagattatttaaccatgggatgcaccatgatttccaaacacagttgattttccagagaagggagtgaaaagaaaagtgctttggaataacctttggactccacgcaccatgccggggataaacatggaaaataaccatttgttgggcggtgctccgtgtcacatattctagtatgtagttttatacccagccattgcccttaccctttcgatttttgttagagcgggacggtgccctgcatgctgtgtgctgtctgagtatgacatttctagtagtaaggaaggttaggatggctctttcctttgccttcattaaagttctcttgcccagatgtgagatctttaaaaggtcagtgtttttgaataaggaatgaaatcatattctaagataaaagttcagagagttatacaataaaataataaattagtaaatggcacttccctgagaggcgatggtcactggtcactgttgttgcatcccattcctcttgccttcagggaatatcccctcaggtatgagaatgctcagggctcaaagacagagaagagctgtacgtcacactgttggggctggcagcaaaatgctgagcaaccttgggctctacaacatgtcctccatggaggtcaggctctaggcctgttctgttgactgctggagtctcaacattcagaacacgggtccaacatggcatgtgtattgacagagaagcttcaggtaatttttatgtccttgaatgaatgggcacatgttacatgacagagcagggactagatggagccaatatattagatccccttctctccacacctcattttctatatagtgcagccagtatgagaatataaaatggaaaggaagaaggcatatcattttgtatgtgctctatgatctttaaatgttattaaatgttggtaatgaaatgctgtggtataactaattatatcctagcacctctttcccatatacttgcattctctaattatgttcaaagcaatggttgcccgaaggctaagggtactcggtcctttcctcccccatgaggactatgttttagcttgtaatttcacctgcaggagctcacaaaccagctgcatttgagtgcaattatactttattcatagtgactaataacagaaaagagacatcgtgggggtttgggctggagatttataatctcatataaaaaatacgaattcttgcttatttatgggttgagcaccttgggcccccgctgtttcatctgatggctgcctgatttttatccgcaaaatcattcattagtatctacactagaatgtaaacacagaatgtaagataaatttgttgtgcagtacttggatagttagaacacatttccccagatagaaacattaaaactagaggttattcactcccatattcacacaacctttatgcacctgaggaggttccgaatgtccctgaccatctcttatttcttatgggaaagtgtttgggtaccagcttggaatgccaggagtgtaattctccagggcagcgactgccgcccgtgccattgggtccctagccctttttcatgctctgctttctgatgagcttacacacacaggcatggtgtactgtgggtgcttagtattgctgtaggacttcttgtgtcctgagttcaccactaccctttaattctaaacatttataaactattgaagttagattcaaaactttcttttccctaagcttttactttctgcttattctgcttataaattagtaaatgttggccgggcgtggtggcacacatctgtaatcccagcactttgggaggccgaggcatgtggatcacttgagcccaggagttcaagactagcctgggcaacatggcgaaaccctgtctctacaaaaaatacaaaaatcagctgggtgtggtggtgcacgcctataatcccagctactcgggaggctgaggcatgagaatcgcttgaacctggaaggcagaggttgcagtgagccaagatcataccactgcactccagcctgggcaacagagtgagactctgttaccaaaaacaaaaaatctagtaaatgttaacagtcactgttcagaggccataacagtgtttgagtctcaacctttacaattttttcataaacttcacctttatactgttaactcacacttacaaaactctaatatattttatttctttgttgagtacttcagttgtctgaattaaagaatgaaactcttttagtcaataatcatcttaaacataataagtttataaaaatgatgaacctaaaattcttaatatttcaacatcattctgatcatgccttaaattgcaaatgtaaataattcaggtatgcatttaaatggttatttattagcattattgttctcataggccaaattcaattaaaaagtacaagtaataaaataataagtaacatggaaaatgtattcagtggtcttgctgcttttaagcatccctctaaatgatttgggagttgagagatgtctgttcattaaggaaaacagttccctcccaggtactttacattcccatgcaggtgattagagttttcatttcttaaaataagtaaatatctttccacctaactccagtaatctttgaacttgggaggaattctccattcttttatgcttctcaggtcagtacaagtcgtaggtacagctattaaaaggatatctgattgaattctggatatctttcatgtagtttgactgacagtaacacctcatagggccacattactgacatagttagaacattgtgctagccttagttatgtgtctgccaagcccctagctgttcaaagaaaaggcggtctcttaccagctgtccttccctggtaattggagctgtggaataaaggtcagttgctctttgagaatgtgagtgagcatttctgactcctcatccttcagtgcccccatgtgtggaaggcttggtaaattgagctgtgcctgcagttaccaagctatgcctccttttgtcaatataattcccactttgctactttgggtaccagaggtacactctgcatagcaggaaccataccctatgctttttggttcttttgagaaatcctaggtagaattagatacataaaatctgagatactcgaaccaatttatacatatgcaaatatgtattctttaaaaaaggatcttgatccttatttcttagtgatcttcttcatcccttccccatgttaagatagcaccttccattaacaaactgctcttgccttttatataaaaaaataaaaattaaaaaaaccaagtagatgaagatgaataacccagtgttacgggctgagtcatgtccccctcaaacttacgtggtggaggcctaaccccaggacctcagaatgtgactatatttggagataggtctttaaagggctaaacaatgtcctaatccaatgggactggtgtccttataagaggcgattaggacacagacacactacggacaaccacgtgaggacacagggagaggacagcatctactaaccaaggagagaggtctcagaagagaccaaccctgctgactgactctgatcttagacttccagcctccagaattgcaagaaaattaatttctatgtaagccacccattttgtgttattttgtgatggcggccctagcaaacttacagtcccaagaatctaagatttttgattgtgtgaaggatcaagccatctggaccaatgttttcctgaatttctgggcagacctttccaggaaggtgggcagcaaatggcccaggtctgttcagttagaggatcaccagagaagtttctccattctcagctcctatcatctttttacagctgaattttctgacattcctccacccccaccagcacacaaaaataagtgaaccaaaagcataacagctaaagaaatattcctgtgacatggtcactcatgtgtctttaggagagaagcactttgtactgtgtattgctgtttatattcttaatgtttttcttacatttcatgatgatttacattgccctaaattttttaaaaatgtaattttggcattatcttcatatatatgcatatatccctggtggtaattcctaacaggccattgatagggaatgctaagagtaaggatagtgatatggtttggctgtgtccccacccaaatctcatcttgaattgtagctcccacaattcctgtgtattgtgggagggacctggtgggaggtaattgaatcatgggggcaggtctttcccgtgctgttctcgtgatagtgaataagtctcatgagatctggtggttttatgaaaaggagttttcctgcacaagctcgctgtcacgtctgccgccaagtgagatgtgcctttcatcttctgccatgattgtgaggcctccccagccacgtggaactgtgagtccattaagcctctttttctttataaattacccattctcaggtatgtctttatcagcagcctgaaaatgactgatacagatagaaatggaagggtagcggagggcctgtcaccttcactgaaaaagaatagaagtgattgagttttggtaggaaagatgatctttaaataaagcctttgtgcatgttgtggaggacagttgctggttttcattaattcaaaaggcctagggatatgtgggtttggcattaatctataatgcctcagacactggaaaactagctctgagaagggtttaggcaaagtgacatccatctagagctctatgtttgtatatttagctcttaaaattcaaaaagaatttagattattgccattagctaaatggaagcatcatggtgcatcaataggaaatgggaaaaaaaatgattaatagtatttatacatatgtgttattctgtagcaataacgaaggcctagcatgctggggtttgttttcattttgtgaggactatactgtgctgttttttagtaaactggtgaactgcctcagataaattgtcacacatagttctgtaaactctgcctgtagctttcattgactttaggttgtgaatgaaacgtttaaaagtttatttttatgttttttttatgtttttttttaatatgtttgaaagtcattgtacagtagcccgatgagggaaaaacaaaaagatagccaaagttactttttttttgagacagagtctcactctgtcgcccaggctggagtgcagtggcgccatctccgctcactgcaagctccgcctcctgggttcacgccattctcctgcctcagcctcccgagtagctgggactacaggtgcccgccaccacgcctggctaatttttttgtattttttagtagagacagggtttcaccgtgttagccaggatggtctcgatctcctgacctcgtgatccacccgcctcggcctcccaaagtgctgggattacaggcgtgagccaccgcacttggcaacaagatagccaaagtttcttaaatgccttctatttctattgctgctgtaacaaattaccacaaactgaggcctgattttaccaatctcttggtaaaatcgggtgttggcaaggctctgtttgtttctggaggctctaatggggaatgttttcttgccttttccagctattagaggccacccacacgtcttgactcatcttcaaagctagcactgtttcacctctttgaacatacttttttagtgcagacgtttgtagccataatttccctccacgcagtgcttttgctgcatcccataagttttggtatgttgtgtttccatttttattcttctcaaagtatcttttaatttctctcataatttcatctttgacccacaaatttttaggagtatgttgtttaatttccacattatttgtgaatttcccaagttttcttcagttactgatttctaatttcattgttgattgggaaaatatatgatttcacttctttgtaaacttattgagacttatgacccagcatatggcctattctggataattttccatgtgcacttaagaataatgtatattctgttattattgggtcagttttgtatagatgtctgtcaagttttaatggtttacagtgtgtaagtggattaaatcaagtcttgtatttgtcttccgtctagttgttctgtccattgtcaagtgtggcattgaaatctccagctactattattggaatcagctatatcccctttcagttttgacagtttttgctgcttgtattttggggctctgtggttaggttcatatatgtttataattgttgcatcttcttgatggggtgacctttatcactataaaatgtttccattaaaattgtttggttttttttagtgaaatggtttgtcctaagtctactttgtctgatattactatagctacttcagctctctttgggctgttgtttgcaaggaatctcatttccatcattttactttcaatgcttttgtaccatttggtctaaattgtatctctattgtagatatcatatagttagatcatgtcttttttaaatccattcttcaatctctaccttttaattggcgtttttaatctatttacatacaatgcgattattggtaagacaggatttacgtgcggcatgctgctgttttctgtgttaagtcttcttgttaccttatttctttattactgccttttttaactttagatattttttagcgtgccattttaattattctgtcctttactgtatttcttagtgattgctctgtggactatgataaacatcttaaccacttattttaagtagttcacaaacctctgctcctatgtagttccgtttccgactctcttatttctgttgctgttgtcatacaaattacatgtttataccttgtttgcccatcaacacttataatttacttcacacaaaatttgatttacaaacaaaacataacgtttatactgtctttaatatctcccaaggggcaaaagcaaagcccagttgtgagccattgccttaaagtataaaaaataagtgttacagcattcttgtcctttatctcattttaaggtaacttagcacgatttagaaagaacaccagagacgtttttttaattggttattggataatgagaccccaaaaaaccctggataaaaaatgttccatttttaagtgtttccaaatctggcttgatagtttccagaacaaaaaataaagtaaaactttataacaatttttggtataaatacttcaagttagaactttgattcattaatctttattcaaatactgaaagtatgttgagaaggaaaatatatacaaactcataacgtaactctagtaataatctcaagtgagtttgacctggggagaaggtctgttcagagaaaggtgcatgtaatcgggtgatgagaatctgaatttgagccagctgtatccacacagtctttataagtcatccctaacactcagagcaattgcgcgggatagctgtttgccctggaaaaaagcttgactcttgctggtggagcccagattcaaaacgggggcagggggtggttacaaagcatatcaatctgttatttcatcacatacctgctgccttcttaaaggaaacaggaaagcattctttgatcagcatctacagggtctgagattctgctttgaaaaaatccatgtaggaaaagcgagaaggaaaggaagtacacaggaagggagagccaattcatctctgtgaccagaaaaattaaaagttctttttgcactggtcatctactgccaaatatgtgcttttaaatgggagagagaacaatatgcatgtacatagcagtattattcagtatcctgggctttttcctcttcattatggttatcagatttgtgtgcaaatgaatgtaaacacacacacacacacacacacacacacatatatgggtttttttttttgagacagggtcttactctgttgcacaggctagatagagtgcagtgcagtggtgcaaccatagctgactgtagcctcgaactcctgggctcaaccgattctcttacctcagctccccgagtagctgggaccagaggcacatgctaccacacccagctaatttttaaatgttttttgtagagacagggtctcgctgtattgtccaggctggtctcgaactcttggtctcaagcaatcctccttgccacagcttcccaggtgcctgggattacaggcatgagccacagcccccagctaacatattctttaaccccaatatctacaggatttaagactctctctgttggatagctcaacttaaagatatggtagagctctcctgaatttataaatccaaatcaacagttatttattctcccaagctagggacccaccctccttatggtcgcagggggttccctggcacactgcatgctagttagaaagccctcacactgaccccaggctcctccctatatgcctgtaccctttggccacctacctgtggatcttttctctctgggagcctccttgttctctgtgtttgggacaggctgtcaccttctgtcaactagggtaccttgctcttaaattatcccttcaatcccacctccaccataattaaagttaaaacagtagtgggacctgcttttagcctgcagtgtgtgggcgtggagggaaggcaccctgaagctccagggaaggaatggcgccatactttgtgcgctcaccagtgccccagaaaggatggcactggggacaagagccccaaaacatgggcatcccctcctccctaagaaggctcaacagagggtccccttcagggattccatcaataaagaaagcacattttatgaaggggagttgagaagtcccaggaagatttcctcacattggattccaggggtcatttatgagtgttgtgatggtcggtgggtattttttgtcattcagggctacttctattaacattgtaactgttcattttttcccaacctaataagtttttctttttaaaacaactttatggaggtttaattggagtacaataaactgcacataaagtatactgtgtgaccagttttggcatgcagttaccgtgacacagttcccacacccagatgacaaatcttcccacaactcccagaagtttcacgtgcccactgcaacccctgcctctctctgaccccatgccaaaggaaccactggtctgcttctgaaattaaagatttcctagaattgtatatagaaccacacagtatatgttctttttttaatctggcttctctcattgagcataattttgggaactcatgtcattgtgtgtaccagtagtttttatgccttttattcagttgtgtggctgcaccacaggctgaatatccattgacctattgacagtcttggcttctttccagtttttagctgttacaaatgaaactgccataaatatctgtgcctaagtctttgtgtaaacataggcttttctttcttgagtaaacatgtaggactggactgattccttcctgaggattgtatggtaaatttatagttaacttttaaagaaactgcccaaagagttgctatgttagccttttattactgctgtaaccagttgtcacaaacagtggcttaaaacaacacaaatgtattgtcttacagttctggacaccagaattggtctcagttggtaaaatcaaggtattggcagggctgtgttcctttctggaggctgtggggtattggctgtttccttgcctctccagctcctagagtggccgccattcctgggctctgactaccgctcctcttcataccttctctctctccctcctggccgcctcttataaggaccttgtgattatattgagtccacctggataatccagggtcacctccccacctcaagattcttaattacttttgcaaattccctgttgccatggaatttaacattcacaggttctgggaattaggacttggacatctttgggggacaattattctctctactgcagattgcgtcatcactgagttgtaaagttcagttccttacgtattctggatacgagtcctttgggtgtctgtgtgtgcatgtgtgtatgtatgtattgtaaatattttccctcagtctgtagcttgccttttgctttcttatgtgtatgtgccttttaattttgaagaaagcccctttatccatatgttctcgtacgacccttgctctttgcgttctatgtataaaaccttcacataatccaagcctccaagaatttttctcctgttttctttacagaggtttatgatcctagggatcaatatttttccccaatacagatatgttttcatacagataggtatggtctagcaacaccttttgaaccagttcattttttaagtgattttttaaatttaaatatggatgagaaaaaaattcttagaccaattcccatacctattaaatagaattgctaatgcctgtgaattatgccacatgctaatcaagagttttactttgcagatgatcactcaattatctttacagatctctattttaagcaatcatatttattattttttctctacagttcaaaaatgatagcttacagctacaggaagcgatatatcaaatacttaaatacttttttctaagcccactagagcaagcttctcatttgaggcaatattactgagactcttaattttatgcttaattattcatttcagtcctttaaattcctaaacacgagaaagcactagcatttacatgcaggctcatttgtaaaggtgaaacagtgacagcacggtgctgtggaagtttctatcctgtatatataaagcacaaaatacgttagtggttgtagggaaaagcgcggtagtgctcacagcgtgttaacaacttgcaacatttgttgaagaacagatgattgcacttctcatcatttgatgttctcatcaccgtgtcttctcccttctcatactgctaggaatttgtgcttggcttgtaacattgcttctacctgacttctgttttcgggtctgagaggacatttcttagataataggtcattgaaattagttagctgaaggtgacatatggataggtcttcaggtgagaaaaacattctgatttacatagtgatgtattcttaatcactgtttttgcaaggtttctctttgtcagtatttgtttcaaaatatattaatgaacttatcatttctgattactgatttatttaaccttgtaaggactgtctccatgtcagttgtcacatttttcttggtgcctagcacaaagtaggtacccagtcaacatttgtttaattaaactgattgtattctgagcatgtgccatttctgcatacccgggatatctggcttctcgagatttttcatctatgatttgaatcaatattacatgttatgtttacttgtgtgacacaggatggtcccaacttagaaatatttgtctcagaaggggctctgtgctcagtcactggaaacctggactgaattttaatttaaggggaaagtcaattttaggttcgtttggattctagttcatagcattacagttttgttcttcagtttccacagtgtaaatgaaataacacatatagcagcaaggagcagtgagccagtcatacgggtgcagtacagtacttaaccaaaacaagcaaaccataccgttaaattttgaaccaggtaggtttgggttttctcctagtttatagacaggtatttattcatggaaggcaagttggatggagattgcagaaaacctaaaagagaggaatatattttgtgtttttggactttaacagcactaactttgatttccttttcctgtgacatacttacctctgatttttgctcacactcagcctcactgttctatagttttggagtgtttcctgcaaatcacagtgtctttctgctatacattgggataagaaaatatatacatgaattagatctggtaatggcaggccttgagaatagagcaaagggtaaaacccaaatatgtcagcatccaagcccacataagtgtgacagttctccagactgtgttaaagtttcctgattgtattaggacatattgtattgctataaagaaatgcctgagtccacgtaatttgtaagaaaatgggtttaaatggctcacaattctgtaggctatacagaaagcaagccactaaggcgtgtggcttgtgtgcctacagagcaccaggatgagctccctttgagccctggctgaagcaggagcagtggggatgaggggagcagtgtcctgaggcagctgggccctgggcgtggctcaggaaaccacccttctcttctaggcccctgggcctgtgatgagagaggctgccttggagacttctgaaatacctgtgagacctttcccccactgttttggtgtcagcacttccctcctttttagatatgcaaatttctctggcaagtggttgctccacagcctgcttgaattcctctcctgaaaaagctttttcgttctctgccacatggccaggcagcatatttcctaaacttttttgctctaccttccctttaaatataacttccaactttgtcatttctttgcttctgcatctgagcgtagtctgttagaagaagccaggttacacatagcatgctttgctgcttagaaatttgttctgctagataacctaaaggattaccctgaagttctaacttccacagaaccctagggcatgaacagaatgcagccaagttctttgctaagaaataacatgtgtgacctttcctccagttctcagtttctcatttccatgtgagaccttgttggcctggacttcaccatccatatcactatcagcattttgatcacaaccatttaactgttctctaggaagctgcaacttttctctcatcttcctgtgttcttctgagccctccaaactcttccaacctctgcctgttacccaattccaaagtcacttccatattttcaggtatccttgtagcaacacgccacttctggtaccaattttctgtattaggccgtgcttgcattgccttaaagaaatggctgagtctagataatttagaagaacaacggtttaattggctcacatttctgcaggttatacaggaagcatagtggcagctgcttcgggggagtcctcaagaggcttacaatcacggtggacgggtaagcaggagcaggcatgtaacatggcaaaagcatgagccagagagagagttggggggaggtaccatgcacttttaaaccaccagctctcatgtgaactcagagcaagagctcactgatcaccaagtggaggatggcccaagcgaaggatctgcccccatgatcagtatacctcccaccaagccctgcctccaacattgagggctacaattcagcatgagatttgggagggaataaatatataaactctattactgaccaatgcagtttctcctcataaacactgacctgatgcagggtctttttggcgtagagggggcatggagattagttcattctgattggtcattaccaaaggctgggcaagggcatgtggtaagggatgcaggagtgcctgtggaatatagaatggtgaatgaggctgagcagggcaggggtcccagggcccagagagaagtgcctggcccaccatccacctgggaacatgctaggggtttgctaacggatggccaaggtggctgggaagaaaccaggaggcaggccagggtaggagggcagccacactcatcccatgagtctagtcggcagcccagggtccttggccagctcaatgacttatctcctttaagggacttgattgtctcaggcatgcctacagagtttccaccgccagccagagagccaaaatgtttcccaagccaatcccatgagatgcctcacttctagtgagccacccccagcccccacaacagcctccagtcagggcccacctgaagcctcccttttccaactgtaaagctttcccagctccccaacctgcatttgagcttctgccaaaggcaagtgctggtgtccaactttcttgctatgcaatctctgaatgaatagcctctgctcgttctcatttgaagagattttcatttaccttcacacatggacagttatctttataacttaactcagtgcctcctcatttaccagaatctggtcttttcgtgggcttctcttgtcttcccgcaaatgtaataatgccttcctatgacactaggatgctttgagcagatagactcttccagtccatgcaaagaggtggtgtggtttggcctcactcctcactgcaggcttaggccagctcccccttgcagccacgtgcgtggacgtgactctgggagtgaagtgaaatagcgctgccgacaggatctgggctctgtgctgtgtgccaggagcatagagagcaatgtgaaacagctgttgcccacagtgacctttcagaacagtttttgctgttagggttctagggattactaagtaagcttggctggttaagaaggtcaaaaaaagcccaaggcaaccccagctgtctgaactagccatttcagaaggctgaaacctttctgctgtgaagggctggatttcctagcttatgtagttcaaagctcagtttttaggattgctgtgctacttactgaccgaaagttggtttttggaaattgacccttattttccaatatctttcataaagctggaaatgctttcactagaagaaaaggaggatcttatgttagaacatatatatatagcgatgtaaaagtttcagtagttactctcaaaagaaggtcaccaaggacaactgtgatttcatatgtaatgattccagcctagaaaatgtttttttcttgatttccatttaagagagttgagccaattaactaatccttgcatatggtatgttccattaagttgtcagtgtttttattccaagatgcatgtttctttaaaagagctagcttattagggcatgtcttcataagcactttaccctggccatgtccgtgagaatgctgtgcataactttcattgaattctacatctcatttgatgcaggcctaattaactattattaactgagaactccaatttattggaatcatttgctgcagttaacttgagaaagaatggggcatgtttaagggtccttatttttaaatctctctttcattacaaacacattaacataagtctgatttgggggtgacagaaggaaataggaaaataaatgtaactaaaccataatggggtacaatataaaggaaagtaagtactgggatgaatatcatcatagattgtttattctttaatttgtactaatttgtacatttgtatatgtacaattaagcacttcttagttaagattgatatatttttaaaatcacaactttatagagcacaagtcttacatgaaaacataatgccaggtcagtggccctccacttgagcacacattcaaatcactgagagggctctgtaaaacacacattgctaggtcccaccccagcttctgattctgtagatctggggtagggcctgctgtgtggtttgaacgtttgttctctctgaaactcatgttgaaacttaatccccaatgtggcagtattgagaggtgtggggtctctaagaggtgttgggtcatgaaggctctgccctcatgaatggaccctttcgttcatggattaatagattagtgagttgttggatgaatgcgttatcaaaggagtgggactgctggctttgtaagaagaggaggaggctgggcactgtggctcacacctgtaatcccaggactttgggaggccgaggcaggtggatcatgaggtcaggagtttgggaccagcctggccaacatagtgaaaccccatctctactaaaccccatctctacaaaaaattagccaggcatggtggtgtgcacttgtaatcccagctactcgggaggctgaggcaggagaattgcatgaacctgggatgcagaggtttcagtgagctgagatcacgcctttgcactccagccctggctacagtgcgagactccgtctcaaagagagaaaaaagaaaaaaagaaaaagagagagagagagagagacctgagctagcatactcagccccctcaagatgtgatgctctgtgctgcctcgggactccatggagtccccaccagcaagaaggccctcccaaaatgtgtcccctcgacgttggacttctcagtccccataactgtaagaaatgaatgtcttcatacattaccacgttttaggcattctgttaataagcagcagaaaatggaataagacagagtccaagaatatgtagttggacagcatctcacttcatactgatgctgctggtccggggacctcatttcgagaatcaaggtgtttaggaaacaagcagtagaatatcttagatgaacaatactagtggtgtacattttaaataaattgaacaattactgattagctactatgtactgtcaaaatggttcagaaaaatgacaccaccacttctatcaaaatgtactggatgttgggttttttaattaaagcaacttcactttaaaatgtggttttacacacattcaaaacactgctgaccctctttcctcagctgccattaaggtgcttagcccttccgaggaagctaaggccttgtgaagctgtcactcattgggtgactagcaccctgcccggtggcaccagccccgcactcgcccacaccatggcctccatctttgtttgagctcacttgcatctactcggccctcattctacagtgcagtgtggtgaccatcacataagaccgtcgccctcattaaagcagctagtgtaaatggtgaaacttttgggcctgacctgtttgcaagggcctggccagtgtcaacatcgggagcctttttggtagcatgggggctggtggacctgtacctacaggcagttctgcccctgtaccatttccccagccagagtcaacattgggaacctcctctgcagcagcatgggggctgctggacctgtacctgtaggcagtcctgcccctccactgctgccccagctgagcagaaggaagtgcaagcaaggaaagaagcatctgagggatctacttaggacacgggctttaatctttttgaagaaacctcttttgtaacatgatcagtgaaaagctgaactcttggctgggcaccgtggctcacacctgtaatcccagcactttgggagtccatagtgggaggatcactccaggccaggagttcaagactagcctgggcaacatagggagaccgtgtctctacaaaaaaaattaaaaatcagcctggtgtggtggcgcacacctgtagccccagctacttgggaggctgaggcgggaggatcacttgagcccggggggtcagggctgcagtgggatgtgatcaccctactatactcaggtgagaccttgtctcaaaaagaaaagctgaactcttaaaacgtgcacacacacagtcagctaacatcttcataactgtcagattgtgacaatttgattctaactcaagatcagcctttcttgtagtttattttgtgtctttaaggaactagcctatctaacacaaaacactggctttaagttttttctcttttttgtaattgggaataaaaattatgctcaagatacatcaagattagttttggagaaaaaaagcattaagtagattcagttgtgcaagatgcacaaagtgtaacttcataagtaagcggtcacaaactcgggttcataatccgttacccaaaatctatggagccagatgtatttaaatataggttatttttaaaaggtattagaattcatatgttccatgacacagaacgttctcaggcagcacccgtaatcaaatccattagtatttctatagggaagtgcttgaagagtcgcactaagtatgataaatgtggaccattaaaaccacctcatgctagcccagtacagattttgcagtgttttcagaagcttttgggttatggaattgggaacagaggctgtgtttgttcctctgcagccccggcaattaagaagtgtttgtgaagctggtttaatgtgcctagcaggtgtgatgtattggtgaattccaaataattgatagttttgtttgcttttttttttttttaagcaaaatatttggtaggaggcactttagtttctcaagttcaatagctgtttgctcttactggagcgttgctgttaagggagacagcagatcttgtcaattccctataactcacggttaacaaaagcattccctaatgattccatatgttgatgctcagaggtaattctgggccaagcgctcagagcacaacacagattatttcactccatggacgcaaccgcctagaaggtgtgtggcatgactacatcattaggatcccattttagaggtgtgcaagccaaggtccagcaggcttataagacctgcagtatgaataggatcctcattttataggtgctttacccaaggctgctagcttccagagtttccggctagaaagctgcagagttggggtttcccgaaagaccaccaggctttagaggacctggcttcactgcctgggctgcctgccacctcccacacctaaagcatctccccccgccccaccccacccccagctttaaggccacccccgctctgcaggtcagcggctattaaatacatttctccaataaacatcgtatgttagacaggctaagaaacttgtcccagggcgtgcagctgagctgggagttttctgcaggtctcttgggtccccaaagccctaggtcttgtatgaacatgagggtaggagcaaaatcaggccttcccatgtgtattaatgttactctgttctcacactgctataaagaacttccctgagactgggtattctgtagaggaaagaggtttaattgacccacagttccacatggctggggaggcctcgggaaacttacagtcatggcagaaggggatggcaaggcagcaggagaaaggggcaaaggaggcacttgcaaacacttataaaaccttcagatctcactatcacgagaacagcatgggggaaaccaccccaacgatccaatcacctccctccctccacacttggggattacagttcgagattgtcaggcctctgagcccaagctaagccatcatatcccctgtgacctgcacgtatacatccagatggcctgaagcaactgaaaaaccacaaagtgaaaatagccacttcctgccttaatggatgacactccaccattgtgatttgttcctgccccaccctaactgattgaccttgtgacactccttctcctggacaatgagtctcagaagctcccccactgagcaccttgtgacccccacccctgcccgcaagagaacaaccccctttaactgtaattttccactacctacccaaatcctataaaactgccgcacccctatctccctttgctgactcctttttcggactcagtctgcctgtacccaggtgattaaaaagctttattgctcacacaaagcctgtttggtggtctcttcacagggctgcatgtaacagatgagatttaggtggggacacagccaaaccgtatcaccatatgtgcttcttaatgacagttggctcaaggtgttttccccgtaaataacgcaactcacagttataaaattgaagataggtccccatttgcatggtaagcaggtacagctccctgagagagcagttggggagaaaccctcgctttttatatctttgttgggtaaaacatcaaccactgtgcctcaggggcggacttagtgagcatttaagatacattttcagttataaaatgttacttgatttgcagcaattacccagtctccgccttagacagaaacttagaggccatcggcctagacttcctccaggcacagggcttccataacagttgaattaatttaagccttaatgcctcccataagcccccgggaactcaggctgcctctgaggatgaaaacacccgccagtctttgggccccagcctggggcaccctgtagcttcttcagagcttccacctccctgccaggctctccccctccccatgctgcccttgcagctactacagaagctgctctcaacatgccacacagattccagctgggaggaggggagtggtcacagtcacaagggatattttctaattctcctaaggagggtagtagtgtatgtggccctagcatgttaaaaacaatatgacctttcctggtaaaaaggaccctgaagcaatgttaaagctgcaagcttgttagtaagcagggaagaatatccatctgatggccctagtgcaagtgttttatgctcctttattttatttcagcatttttcctttcacaacgctgtccctttaagtgtgccatcatcaacagctgtagttatcatttgatctgaggagtttaattacttgtttagatcctttcttattccacggatttaggattattttatctaaatggtgaggaaaagtgtctgtctgcacagtcccctacagatttataatcccacagttctgtgtcttttaaattaaaagctccatgacattttaagctttaaataaacactgttggaagcatttttagaggatacagctgttttcctgcctttgtccacactcctttcttcctgttcgcacactcgccttagtcagagttccacggagcacctccatcgtcctgcctgccctctgttctgttccttcactcggcttttcaaacccgacagtggtgtctcacttgttcgatgcctgcagtttccttttgtcaatcttcctctctcaactactagaacaaacactcaaggaagtaaaatgtgccgcctcactgccaatccgtccatctccttgccctgagagccttggctctttctccccctcacagagaagaagaaaataaaaggagcgctcatgcctgggtaaccctcccttagaggaggcttttcaccactcagctgttgaggaggagggtgggccagcccttccttctgttctgcagcttctgtagggagaccgagtgcaggatggaatccaggaagccttgagttactcaggttgttacttgaacttcgacttctacaaaccagcccagacttttctaagagtcctgtcttttgtactctcctaaagggctttgagccctccattcagggattgggccttcacagtctgcagtatccagaacggtggaggttctgaggtttgtttggtgtgttttacagcaaacttaataaaatacagcttgtggccaggcgcagaggctcatgccttaatcccaacactgggagaccgaggctggagaatcacttgaggccaccagtttgagaccagcctgggccacagggcaaggcatcccatgtctacaaacaaaaaaataaatgaaaaaaatacagcttgtggtagaaaagcaaggagaaaaatattatagtgctgaaaatgaaatggcacctgcagatgcagctgtgggtggatttgccaagaaaagcagagaaagaacagaggagggctcttcttgttgctgttagcagtcaaaaccagagtatccatcaggaggtggagaagccaggggtcttctgcagggaagagggccacagagggggtcagtgcacagggggaggaaggaagatggggagtgcagggcaggggccacccaaaagcccaaggaagagcccagtccacaataaccagcctctcctggtctccagtgtccacagggtggactgggcccagcctcagccccatcccaggaggaagagccagagagttccccaggcaagtgcagtgagccctgggaccaggagagaagcgtgcacagaggcaaagtccacaccgtggcagccaaagcagtcagtgagcccagtcctctgagtataaggcggcaagagccctagccgatgctgcaggtgcagtcaagagatgcagtttggatgctgctgaaggaacatgatacagggccacacggaaaactttttctcaagacagcagcactctgcccttggttcattcaggaattttgcatataggtggtggatatgattgactgcccaggccttgtgtctacacagatgaccattcaccttctgtgagaaagatgcaggagacaaagcacaggtggccctaccattgcagcggctcacaagagaccttcccggcctcctccatgtgtgacacagcgaatcctgccgtgtggtgcaggcagctctctgcatgcctatctgggaggagcagatattttggagttaaaacctgccctaactctcttttttttgaagacataatttcgctcttgttgcccaggctggagtgcagtggcacgatcttggctcactgcaacctccgcctcttgggttcaagtgattctcctgccccagcctcctgagtagctgggattacagtcacatgccaccatgcccagctagttttttgtatttttaatacagacggggttttgccatgttgcccaggctggtcttgaactactgagctcgggcagtcctcctgccttgacctcccaaagtgctgggattataggcgtgagccaccgcgcccgccccataactctcctttagtcgcagttcataccttgccaactttcaaaacacatcgaggcaattacagacaagcatgcatacctatgtgcatgtaagcatgtgaacatacataggagtatgaagacttacatgcctcttggatacacatagccttctctgtgcgtacacgttacttccctcagtgtgtcctgggtctcccagatactatcttacagggaaaaaaactagtatttagggatgattattgtatttgtttatgtcattgtgggacagttaaaggccattgagatcgcctgctcttttcaggacttcttgttgggtccagctgtacagattcaaggtagactacgtcctgctaatgctgctccacaccctgtgggaaggtttcagtgctaaatctagaacaggtggtcagtctcctaactgaatttgaatccagatttttgtcagatgcatccgtgtgtcttcttcttaaatcagttgtgaacagggctatttccagcctctcgggttcagggactgcctctgtgccaccgcagactggaagacaaggactctgcccaggccttgggatagccttctgccttcactggggccttggggggattgtcatcaggcaacactcagctccatggagcttacctgggtttgaaattccacttggtagacattcctctgtgttgaagtatttctttttttttggcataatgcctcctagcaggtcagttagttggttcttcagtaaagtaatctttctaggcccacactggagacagagtggggaagacagctagtgtgtaacaagcatgctctaggaggctggcactagaatgttacttatgtgccctgaaatattcattctgtaaagtaggattatttcactgtagtagcatcctcagtagtattcttattggtaatatgagtgcaattgatactatgtatatattaaatatacatacagaaaaaacacatgaatagaaatgggtgtgagccagtactagttattatattgtatgtagtgtaatctagcgtatattagtggtactggtactattattagcagtattcctgttcatcttgtgtaagcgtgaggaaagcaggcacctgcaggctcactatgtttctgaggctgtgccctgagtaagtgccgagccgggagttaattctcaggtcagctttcaccatcccgtgacagcctgtgcattaaatgttctgttcttacctgggagcttcacagcagcatcctggccaggcatggtggggattcatcccactgggcagtggaaatgtccttaatactagtgggccatgcagtggactttgtcagctggtgctggcttccatgttgttgggaacaccgagtaatgatgccttgtgctatcgaatggaattgaccattccaaggatatatttagattcaaatacgtacatttaaacagaaaacacaataatacagatttcatttctctcctgagttctgaatttccagatcacaactccagacataactccagcagccttgagaggaggctgcccatagtataatttagtgagaatgacctgcaagcctttctcctgttcacttaggtctccacaaaagcctttgttcatggaatgagacctacacagtgtatgtttatgcggacctgatacaaacttactgttcatacagtatgcactctaaaaatctcttttttttttcctgcagatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggtgcggttgcctcgctgtttgcagggttatgtttgtgactattagcaatggttttgtaaatcacctttaaagtctagcatagggcatgcttagtttgtcctcttttcttcagtatctaaactaagtccctcctggtgctcctgaaagagtttggctgatgctgtgggatgctgtgattcaattttctctttaaaagcttcttaaaataatatgcgttagtttcagtgatttctgggttccaaaaacatttgagtattgtttatattactatatataaagattatgttaatgacagaatgtcttcaaagtttaccttaatagatggttttgcctttttcttttcaaaatcagatataggattaatatttcagcaactattcaaactttaacaaattgataagcagctaaatctccccaaagacgcttaattaaaaaaaaaaaaaagtaaaaagtcgaattcatttttagcctgtgtgtttatatgccgttcagccctttctttacttgtatccagttttcttcggaaaggaaaaacaactttgttccctccgtgcttgttaactgacattcaatcagaacgggcttgcctgacgctccttgttcaagaatattctagattacagaccttgaaaatagactatttgaagatttttctgggatatacaggatgaatactctgtctttagaattcctggtgctaggggagaaaaaaaacagcagttatgtgagtaatcttggatttaaaatgatattaatatgaagcatacctacttttgaaatgtatgttattatttatatttatacatatgtccaaacatgtggattgaccattcctgggcagcacacacacacatgcaaacacacaccctttgtaatcactctgtctgcatccactgaaaatggtagtgtttgtgaatctcaggcatgggtacgagcatcgtgatactcagttctctgcatctagtgtctttctgcaccatttgcacatgaagttaccttgataagtcttggtgaaacacatccatacagttactatatacaaatttaattgtggtaggacacagacacacacactaaaatttaccattttacctattttaaagtgggcagttcagtagtgataagtctattcatgttgctatacaattgacctccagaactttttcatcttgcaaatctgaaacttcgtgctcattgaacaagtccccatttcgccctgccctcaacccctggcagccaccattctactttctgtttctaagatttttactactctccatacctcaaataaggagaattatgtagtatttatctttttttgattggtttatttcacttagcataatgccctcaaggttcatccatgttagagcatgtgataggattttcctcctttttaaggctgaacaatattctatggtatgttagaccacattttgtttattcatagttcatttgttgagggacatttgggtggcatccacaccttggctgttcttgtgaataatgcttatataaacatgagtgtacaaatatctctttgagatcctgctttctagtctcttgggatatacccagaagtggaattgctggatcccatggtaattttattattaatttttgagtgaccaccatattgttttccatagttgttacaccattgtatattcccaccaaaaatctataagggttccaattactccacattctcatcaactcttgccatttcctggatttttttgatagtagtcatcctaatgggtgtgagttgatatctctttatggttttgatttgcatatctgatgattggggatggcaagaatcttttcatttgcttgttggccatttctgtattatctttgaagaaatgtctgtgcacatcctttgcttatttttgatttttgtgtttttgtttttatgttgtaggagttccttatgtattttgaatgttaaactgttatcagacatatgacttatgaccattttctcccattctggctcccttttcgcttagttgttggtgtgcataagtttttgattagatgaatttgacatatgtcatctcatttgtctaattttgctcttgttacctgtgcttttggtgtcatagccaagaaatgattgccaattccaatttcatgaaactttaatttatgttttcttcctggagttttagttttaggtcttacattcaggactttaatccatattgagttaattcttgtgtatggtgttaattagaatctagcttcattcttttgtacgtggatgtccagttttcccaacactgtttgttgaagagacttatcttttccccattgagtagtcttggctggctcgttgaagatcgtttgacaaatacgtgagagtgtatttctgggctatctattctattctattagtatgtaggccagtactgcactgttttgatgaatgtagctttgtaatatgtttggaaatcaggacatgtgagacctccgattttgttctttttcaagattgttatggctatttgggatcccttgagattttttatgaattttaggatgtatttctctgtttctgctcaaaatgccattgggattttgatagggattgcattgaatctgtaggattgctttgcatgctatgaatgtcttaatattaagtcttcccatccatgggcataagatgtctttcaatttatttgtgtctttctttcagtagtgttttgttttgtagtttcagtttataggtccttcacttctcttatttctaggtattttattcttttgatgctattataaatgggattgtttataattttctgttcaacttgttcattgttagtatattaaaatgcaactgatttttgtttgatgtgtattctacaactttgctgaattggcttattggttctaacaattgggtttttttttttaatatgttgaattgtagtgatttctatatatatgatcatgtaatctgtgaacaaagataattttgtttcttcctttccagtttggatgccttttgttgtgttttcttgcctaattgcctggctgagacttccattattatactgtctagtagtgacaagagtgtgtatccttgttgtgttcctgaacttagaagaaaagctttagtcttcattgagaatgatattagctgtgaacttctcatatatggcctttaatatgttgaggtagttttttttttctatccttaatttgactgtttttaatcgtgaaagggtgttggagcttttcaaatgcgttttctttctgcatcaattgcggtttttgtttttttttttttttttggttccttattctgtaaatgtggtttcatatgttgaaccatttttgcattccaggaataaacttcacttgttcatgtatatgatcctttcaatttgctgtggaattgtttgctaatatcttatttagactttttaacctgtgttcatcagggatattgatctgtattttgtttttcatatagtgttttccatgtttggtagggttctccagtgaagccatctggtcctgggcttttctttgtggggaggttttcttttattactgattcagtctccttactacttacagatctgttcagattttctatgtcttcattttttcccccttctcaaaatcatcagggattctctgtcttcatgattcagtttgggtaggttgtgtgtttctaggaattcttttatttcttttaggttatccaatttgttgtcaaaggatatgccaacaaatagtattctcctttatttttgtggcattggttgtagtgttgccccttgcatttctgattttagtcatatgagtgtttttgttttttgtttttttagttaatgtagctaaggtttgtccataaagttactctgtgactgagtgtcttttgtgactttacaaagcactcatgatgtatgaggcatgcacgtgtcttatttcttccatatctacccaagcctttcacatggttttctttctacactttttgttctatattctaagatatacttgaaatatgttctactgcaattcttaaaaagaaaaaaatgttttatctagatagtctggtagtttggctggagtgctagtgaatctgttttatggaatctacttggtgatcccatcaacgtagtgtcttcatttggctttctaagcgagcaggtatcagattaagtaaggtgccaatcatagaaactcatagaaggtgaacaaccagccaggagctagttcttcaaagatagttcagtcctatagaacttatctagatggctctcttttctttctttactactttttgacctctttaacttttttttttttgacttgacaaatcatgttttttggcatatgatttgtgtgtgcgcgtgtgtgtgcacacgcatatacttattttaacttttactagccgctcagttgcgagtagggacttcaatactgaaagtctctctttgaaaatgatcatatctacatgccatatacacaattagctgtgctttgacagagcagagcatgcagaagacttgaagagtatacagaaatgcacaaggtaatgctggagagaagaaacttaaaatcatgctgggatgctggctcagatgatgtgcagggacagtggtcagatgatgtgccgctttggtattctgaaacgagttaggtgtaggataagacaaaattattagaaatcatacttaacctgaagggaaagcaagccagaggaggacaatgttggactgaatgtatagagcagaaagacaggccgtgcctaattccaatccagaaatgtgttcttccttagggtttctgctcaatattataccagtcacaaaaatgaagataaaatagctcttctgtcctgaaagaacattcttggagacctagtttccattcattttgcactcctcccatctcctcttttatctgcgccaaacctgaattcccctcggaaggtgaccttatagcgtcattgctctggtgactagattcagagaaacttgctgctgtagtctttcttctaggtgttcattttgctcacttactactttgttcctgttcttaaggtgtagatgataatataacccttgactttgtttcttttccttctggaagtattttctggtagggtatgttaggttgtggaaatgaccttgagctctttagaaaagaaagctgtctgtagggagggctttttaattcaacgtcattctttttcacatgctttcagagcgacagccgaacccaaggaggtatttagcaagttaaattgccggagtgaatggtagattaccaggggaagcagcccctgatcatgctgcaggggctgtgtgctgtgattaggctgcaggagggtgtctgcttgggccagtcaccagggaatcagcttgattatgctgcagggacatgactacctgggccaataaccagggaatcagcttgattattcttgggggtgtgtctgtcttggccaatcaccgaggaatcagtccaattatgctgcaggggtgtgtctgccttggtcagtcaccaggggatcagcctgattatgctgttggtgggtgggtggtagggggccggggagggggacgggatggggtgaggtgggggacggatgggtgtctgccttggccagtcaccagggaatcagcctgattatgctgcgggagtgtgtctacctagaccaataaccagggaatcagcctgattatgctgcagggtgtgtctgccttggccaatcaccagggcatcagcctgagtatgatgtgggggcatgtctgcctgggccagtcaccaaggaatcagccccctgattatggtgcagaggtgtatctttggcttgatcatggtatagaagtgtatctttgccctgattatgaagcagaggtgagtctgcctggtcatggtataggagggctctttgcctgggccagtctagccactaagaagacaaggtggacctaatggacttgaaagacgaggcagagtggccctgatgcactcgcacatcagctgcctatttgctatcatcacatttctggaaggccctctctatgaaaaggtgggtgggcctacgatgtcctcagtgggaaatccttttgagcagttagttctgtaggcatttcttatatggcttcatggttccatgtaaactgtcggtcagccaaggcttaaattattttaggaaaataaacttttaaattgtggcacaaattttagaggaaaaaatgcatgtggttcatctcttgtgagttttctagggattttaaaaataggtaccgtattacaactggaaatgtatgtcacattacttaaaaaaaatcttcacttaggatatcagaaaatcttgtttaaaacatagcctatgctggttacctccattgtatcttgaacaaatcctttcagtaatgaattccttgggacagatgaaattctacatttcattataactcagcgagggtaatttggattcaaagaccaataagaagaaagttggtgccttttattgtgtagaatcccccaggagttttttctgttgtcccagctctctgctttcccatgtgttttcactaagcatgagattcctagaggaagagcccagggcatggtatctgggccagtagaaaggacagcctgccttgcagatgtgctcctcagcctggccggctctcccctgcatctcttggccggctctcccctgcatctcttggccggctctcccctgcatctcttggccggctctcccctgcatctcttggccggctctcccctgcatctcttggcccttaccgcctgcaccaggctctctggtgttaacttcctgccctctactttccccctctcagaccatctggagcagaaaaagcaaactagaaccctggccccctggagagtcgtggatgggtgccagagctccccttaggtggctgaggggagggagcaggtgtggcctgtgtggtagaaaggatgggtccagtcacagctctgcagcggagcactcctcctgctgtccagccccagtccccttaggacagtaggagtactgactgacatgcccactgtggggtactatgatctgaatgtgtcccccaaatctagtgttgaaacttaattgccagtgtgataggattaggatatggggccttcaggaggtgattaagtcctgaaggtggagcctcatggatgggattagggctgtcatgaaaggactagagggtaaggcctgctcttccattcctctgtcacctgaggatacagcattcctcccctctggagggtacagcaacaaggtaccatcttgaagcaaggagcagtcctctgcagagacagacctgctgatgccttgatcttggacttcccagcctccagaggtgtgagaaatacatttctgttctttacaagtgtccagtcccagatattttgttatagcagcacaaacagactaacacctggggcattgctgtaagacaaccttggagcatgtgtggttacacctggcccagtgagtggctcctagcaggcacttgtgtcatctcctaacccaggaggatccagtcctcaccctgaatcccaccttgaggagttagtaaggtcgttctccatccctgctcggcttcgttgaaaagcacacaccagccatgacatggacaccatgcacatgacatgggctctagtcctctttctgtccaagctgtgtcttcctcttgtaagtaagccttcctcctcaggctgacttaggtaattatggttgtttccatccttctactttttttctttttaattttgttcttggtttattttcttacaccgttgtcttcctggctgttaacagatacacccccaccctttccattaggagcatctggcaggaaggcactcatcctctggaagtcagctaacaacttgcctctctttcctctgaactctcgtgcatgtagtgctgagtgagtgctcggggggacacaggagaaaggtctctttcctaatggagtatgtcatccatttggggagaggggacaggcatatctgcagcatccaagtgaaaacccgtggtaggatattgttgcacagcaaaatgagaaattcaggaaagagatgccaaagggatgtagaattaagtaaagcaagatattcttggagtagtggccgctcctggggtagggggtgacctcgggggagtccacaagaacagaagagatacagatgggagaagccatttcaaaaggaaaacagcacctgtggaggattccagtcagccagtgagtttgcttctatacagcatgaagccaagcttctcatggctcacaagcttcagagaggaattgtggctctatgagttgagcttcttattccccagctcatctgtttgctttctggatagggagaaccattgggatttttaaaaggaggcgtgtcagaatgcaacctgcacttggggagaatcctctgggtttgtggcacacaacgcctgcagcctagaagagatgggccagaggaaggccagggtgatggtaaaagacatgcaccccccttgactgggccatgaggtgtccagacggaacattctttggagtgtgtgtgtgagggtttttctggaggagattagcatttgaattggtggattcagtaaaggagattttcctttccagtgtgtctcatgaaacacatcatttttcgcatcatgaaatttgtcactagaggaatgaaaggatgatcttaagtagggagaatatcccttcaggataaaaaaaaaaccacaatcatgatatgcttttttttccattggagacacagtctcattctgtcacccaggctgcagtgcagtggtgctatcatagttcactgcagcctcgaactgctgggctgaagcaatgctttcacctcagcttctggcgtggctaggactgcaattatatgccaccacacccactaaggtttttttctttttttctttgtagagacagagtcttgatatgttgcccagtctggtctcaaaagttctacctcaagcagtcctccttcctcagcctcccaaagtgctgggattacagacatgagccaccacactgggccttttttttttctttaattacacaaattacacttgtttcacacggtacaaaaatgtatagcattaaaattggaagcccttctaactcccactctcctactccctggagataaccgttactcagtgtttaactatttaaggtacctcatttcaccccttgtcttatgatgcctatgtgtttgtgtgtagacccacaggcacacagagatatgctcacctacactcacctacatgcacctttatggaatgaggccgctgacataattcaccaagatccagagcaagtacctatagattaatgggacagaaatcccaaatgctttaattaaattgttagtcaattttttttttttggaagtaggtctaacaaaagtgaggacatctttttcctagctcttaaatgaattgtcactgtggatccctgaaatgctggacatcccttgggatgggaaggcactcagagcacttcctgcctgggagcacttacaaggttgcattagtccatgcagtgctaacatgattcttgtgtcaaggacagcttccagaagacctcagcaggcaagctgtgctgctttggtttgtcctccttagtgatggaggtattgtgctgtccacacccttacagtcctgtagattttcatatgtccacactgacacagtcacatctcttgttccgtctcctgtgccagtggcttcagggccagctgttacctttaggaaccaggaagcacccaggtcagcttccaggccaagaaggaagccagcagaagaattatagcccttggtttataggccgctctgataatccattactttctaagtctgggcagcaggcctcagtgttgaggggcagtataacacctaggtggcaggagcctcacagagaagagggacccatttgtgtacatggcacaaactgtgtctccacctgcctgtcattcctggcctatcctcagccagatttcacagctcggtgctggggctatgccagttagatctacccagggtgttggggcttcgagtctcattaagatggacagtgcctaggaaccccagaacacattctctgtgccatgttcaggaaacatgcacctgaagggtattcatgccacttttccttgttggtgtccactatggtcgtgttggctcacaagcattgaggactcactgcatgtcatgctctcagtgctttcactcgtgggggtatgtgtcagcctcctgccgccgctaagaagcagtcgctcttagcacagggaatggcaggtaggactgcaggggtcaagttacttgtccaaaagcttgcagcctctgattatggaggctggcctcgaacccaggtggggaatgaagagtccatagctcttagccacggcgctctactgccccagatgatgtggcggtgaccttctgttgaggtagacaacatcagagtacaaaggggagaagatgtgttctgacacgggtcacagggctgagccctttaaggccatatataacccatgtggagaagtccccagtgctcggggactctgcctcgtccagctccgtttctggtggtggtctcgatttggggcactcagctgattctcagtcgctggagaggctctgctggcaaagctggacctcagggatttttacttaggcagattgtactccttggataacagcacaattaaaggacacacacaacaagcgaaaaggaaaattgtacgctgacagtcatggtaacacattcaacttacgctgtgttccttttccgtttaacaaatcgaattagccccatgttcaggaaaatttatgatcgtagggaggaagaagcccatttgccagtcaaatgtaaatgtaaatgaaaattcttaccccccttttcctttaaagtatcagcttattggccaggcgcggtggctcatgcctgtaatcccagcactttgggaggtcgagacgggcggatcacgaggtcaggagatcgatcgagaccatcctggctaacacggtgaaaccccgtctctactaaaaatacaaaaaattagccgggtgtggtggcaggcgcctgtagtcccagctacttgggaggctgaggcaggagaaaggcgtgaacccgcggggcggagcttgcagtgagccaagatcacgccactgcactccagcctgggcaatggagcgagactccgtctcaaaaaaaaaaaaaaaaaaaaatcagcttattcaatgatgtatatggacattattcctcttttctgaatatagtgactttcataggcagctaattgccttgttatttagtaaattgtaatgaagacatcctagactaaggagaataagatacaaatctttgcttctgatcatcctagatattacctcactgcgcatgtggagatgtttctcaaagaattacaatttatattttttgctttgtttgtttgacacaggatctcactctattgccaaggctggagtgtagtggtgcagtcatggctcactgcagccttgacctccctggctcaagtgatccccccaaacccaagcgatcctcccaccttggcctctcaagtagctgacacttcagatgtgtgccaccatgcccagctaattatttctttcttttctgtagagacagggccctactatattgttcaggctggtctcaaactcctgggctcaagtgatcctcctgcctcagcctcccaaagtgctaggattacaggaatgggccaccacacctggcccagtttctgtttctaaatgtgtggtggttctcctgtggatttctaagtctttaggagtataggataatgaacaagagaaatccttacctcaaggacctctcgattcaaaggagaggaaatgagtagataaatgaccacaatgggttgaatcaagtcactgtccctccgggaggggtgtgctcacagcataggacagcactgtggagctgcacagacaggctttgaggggtgttaggtgccagcactctctgcacactgcagtcaggacgagggagtggggagggcagtgacttttaggtgagcatccaggtgtagagcgctgccagcttgccccgagtcccagcacccgctcacagcctcctggcgccagtagtagaaatggttgcacaaagcaaccaatgagaaatactttcagttttccatctgccacacagagaaggtaggagaggcttgcaaagggaatagcatccagtccttttgttacttgggcatggaaagttggggttttccttttgattgagttctgggaagtcagcatgaatcagctttcggttccctgcctccagaccctattctcctgcttcagtatgatgtccctagagttgtcaaatccatagaggcagaaagtagaattgtgattgccaggggctgggggagggggatggaggttttagcatttaatggggacagagtttcaccttggggagatgaacacgttctggacatggatggtggtgatggctgtacaacaatgtgaatgtactgaatgccacagaattgtacactgagaaatcattaaaacagtacattttatattgtaggtgttttaccacatacaacaatagttattctttttcaaatggcaagaagccattcaaggattttggagttgtgttttggcaaagctcctgtgcagatgaggtagaaagcctgtagtgagtagacacaaatgtggtttttcacataagtgttgtggataagtgcatctccttatccccaacagaatcatacactcttatcagggaagacaggtgtctctcatacgccccaagcacctgggtcatggggacttgggcccagtgtcatgggcaggtttgagtgaggtcaggagtacctcgcaccacgcctactctcttgaggtggtttctgcaccacttctatacggtgggacctttcatctccatagcatggtagacacaagaatacagggaaagtcttactctctcctttctagaggattccttagagagtagactgtaagagcaagactttaatatttgagactattgacagagacaccatcaacagaaactcctcacaacaaagctctagccataaaactgaaatttctatgaaatatttgcaaaaaaaaattgacaataggaaactatgatattttatagtaagtagtccacaaattaggttaagaactttaaaattagtttgggattactataacttaaagtattctgttatttttgtcttattgttgaatgcataaggcaaaatgaatccatttttgatgtgagttatttaaaagaagaatacttttctgttacctcttatttgtgaagaaattgaaaactgaaactctttcccaatctttatatcatttgcacttttatgtttgttttgtgacgtagtcagggttgttcttatttgcattatgtaggtgaggatacaggttcagagaagtgaaacggagaaggagaagtttgaccctggccttgtaggccattaccaggctgcttttattgagaacctcaggtatggcattctctacgatgagttaaatgccttcttcagattgggttttataatacttgtgcttgtttaggtaagagaatttacattgtttaatcacgtagagagctatagtagaaaatcaggaaaattgaatgagctattatgttaacatttcctagtttgtatcttttcctttggctattaatcataagctatttaaatagctgttttatacatttattttgtagtgatagatccttagaagtagcaacccgaaaagtgattcaaagtaaatgaaattagtactgtaagcagctttctggcaaatcaaagaagacacaaaatcaaatatttttctgaggatggtcagtattttgagatagttggtcaggttctccagatcttaagaaagccaatgaaagaaaaagtccatttaaggccgggcgcggtggctcacacctgtaatcccagcattttgggaggccaaggcaggtggatcacttgaggtcaggagttcgagaccagcctggccaacatggtgaaaccctgtctgtataaaaatacaaaaaaaattagctgggcatggtggcgggcgcctgtagttccagctacttgagaggctgaggcaggagaattgcttgaactagggaggcagagattgcagtgagctgagatcatgcctctgcactccagcctggtgacagagtgagactctgtcttaaaaagaacgaataaaaagtccagttaaatgtgccttccctttgagtttccagagctttccacattctagtgaaacctaggagacctgagttaccacagtcaagtggtgaactaagtgtgtcctgatcagaacaaaatactgttcctcggtatctttccctttcttttttatttaccattgacagctggctacagagatcatataatctccagaaagaatgctggtatagcttctgtgaggacaggaggctcctgacgatcataaagtctttttcatggagtcaccattgaccctttggaagtgttcagtgccacttctttctcatatcaacgtaaaactctgcaaagtcatctccttctcatctgttacataatacaaaagaatgcattttacttgattttcagggcaaagagcagattctgaaactgatagcacatttgcacactgaactcagaatttgccagtggtagtaacctttgtcacatggcggggagcacaagattgtgtctgattgtgtctggcctggttggggtgaagtcggggctagtgggtcgcttacatggtagcctccagcctcttcattgtgacaacacaggagcttctggtgttgaaactgcctgtccctgtaagactgagatgagatgtgaggcatatgatcaaagggtcacttaccagctagctagggggaagtggacatttcctgaatgtcccacattttagaaaatagtacgaaattcccaatgcagatactgtctgggttgtatgagtcttattttactgagttttctttgtaccatgcacagcctattgtaagcgcaatttaataaggagattttaagcatgttggtatatcaaattgatttgatctttatatacatcctttttgtctattagggatttatatgaattcaatttcacagggctaagaaaaatttttttaaatttaaaaatttctgctcctttggttgcattgaaatggtgggtctatggctcataaaatattctatgcatggtaagctaaaatatatctgtatttggatttagctgcataagtacaggaactgaacatcagactttaataaacattaataaacccttatgctatatgtttttcaatgagttattatatagtatatataatatttagatactatatatactttaaattctcaacattgttttgataatttgctctaataacgctctaataatttgagcacttgtagagaatatttagttaagtggttaatggaagaaactcgttggggatttttggattccgtttctaggagggcagttctctcatgaggtaaatttcctatctggtctgtgcatgaatttcttgaagaactgacaataattcttcctattagtgtcacaggcaagggggcaaaggggttaggtgtcaatgcctggctgatttcctgcattacaaaatttacctcttacttttctgtcttcctgatgttaccccctcttttctttcacctcttgggcctgcacatgatttgtttgctatcaggggccaataagctttctctgtgttttcagctttacagaccccatggtatatgtgtgaagcctttagctttgctgtgttaagaagcaagtagctgtaaacagtgcgtgagtgggtgctggtgctgcactccagtcaaactgtctctacagacacagaaagtggaacttcatctcattttcacaggttataagatcatattttttgactcttttcatttaaaaacaggtagtaagttgaatttgtgtttcaaaaaaaaacaaaaggcaggataaaacgaagagctaaaacaccacagagcaggttgaaatcccggatgtgaagtagtggagccattgggccctccaccccaagctgtgcattcagaatgccacctggggcagaaaacaggtttatacacagagccagagagacttcagatctccggtgatcaggcacagtggaggacgtagataaaagatccctgcaccctgcgctgtgagcccaccaggtcccttcacctcactctcttttatgcacaaccaaaaaagatcctggagaactcttctctggggaaggaagttacctcatgacaacaactcttaaacaccaacatttcgaggcccactgatggaaaaactgactacaggtagtaacttcgagtttggagaaggctcccacctgtgcccccaggtggtgctgtgtagcttactgagaatctgcctggcggctcagcccccactcttctgttgtggcaacccacatctgaaatgttgtcctctggggaacatgcatcctttccagacactcctgtaatctatatatttgttcctccctttcaagaggcttagaacttaaactttggttgtcatttttgttgatattatgctgttcattcctagtatagccgttttctaaaaggagagagaagcaaggatcatggatcagtagccaacgttagagtcagagagcagtttgcatgcaggttgtcacagaggcacatctagaacacaaggaaactctcatgcattccatgtgcttattaaaagggcattatactgcgaagtactagtctaataattctctgcaagggatttaaaaaagggatcaggggttagtactacttgctagagtcagagggcaatttgtatgtaaattgttacagtggcaaatctggaacacaaggacactcacatgtatcccatgctattaataaaacggcattttattgtttaagtcctagtctagtcattctttataagggaaaacaaggatcaaggatcagtacaccatgctatagtgagagggaaattttcacgttaagttgttacagagacaaatctacagcacagggaaatattgagtcatttttaacattaaggtgtcaagtcctgcctggaggaggggcacttagggtcagtaggatcaggtggagaggcttttcttctaaagtcctagtgcttagcagaggaatgagagagaccattcagtcccactatcacattgtacacctgtagttgcagcactgtgggaggccaaggtaggcagattgcttgaggacaggagtttgagaccagcctggtaaaatcctgttgctacttaaaaaaaaaattacacgctgtagtcctacgtttacttcataaaaactaatgtagaaatgcaaaattaattttccttaaataaaatttctgcattactctctatattactttgtctcttttattttcaatggctgaaaaaaatagttttgttttaatttttattatttgatccatccttaattaccaggcattgatcagtggtttgaattgccctccctggctttccattttaatctaaaattctgctataagtctatgaaattggaccagaacacaagctgtgccatcagtgatactgataacgagattctagagaaaggtgcttctttggctggaggagtttaggccgatcacatttcagtgaccccggagaacattagacagcacctattgccacaaagcaagcagccagctgtgggtagaacagcaaaggcagtcggatgctcatcgcctgtattgccctgggaccagcagaccaaataaatgtaaactggactcttgcaactgtttgtttgaagatttgaaaggagttagtttatatttattttcataactgctttatttctgtcagtatttaatgtttgccaaaaaaggaaacacaggtttcccacactgtctccccatcaagtatcacaaatttgtgtgtcaagtaccagaatttgagaaagataattaagatggtttaaggtcatctcacagatagaacctcagtctatccaagttttctcctccagggtcaacccactgtattagcttcctggtagtgctgtgttaattaacaaactccgtggcttaaagcagcagaaacttaactgtctgacacctcagaaggctagaagtccgaagtcaaggtgtgagcagggctgcactccctctcaaggctctagggaaggatccttcctgcctcttttcagctgctggtagttgccggccacccttagctttccttggcttgtaccttcaactccccaatctctgtctccattttcacacgccctccctcgtcctgtgtgtctttgtctccaaatttccctctcctttctttggatttagggtccaaccttaatttagtatggcctcataataacttgattacatctgcaaagaccctatttccaactaaggtcctattcccacgttttaggtgaacatgaattttgtggggagagcactgtcaagccagtacacctccacccatactttcctactcccagctcagactgccactgttcaggttgccccaggagggccctgagctggggcgcggactcagtcagtcgtgtttggctggagtgttccatgaggttcagccagtcttgccagagccttgctcctcttccagcccctcaacccaattcctttctcctgtttcctttccttccacactaccacactgtcttacgtccaggatataggttagtcactcaattccataagccggatcctgtggtgcaaattccataagtggcgatccctgatattagctttgagttggtgccgggtccctagtaaattaggactgaagatctgcacacagccaagggccctctccctagcagcaagcaccttttcaaaagagcagaattcatttggaaggcctagaaaaaggaaggaggtgctctgccaaaatcaatgatgtctgagaaagaagcatgctccctagagcttggagaagatcagaagagggatagcctgaggcatggctctgcagtaaatcattaagagacgcccactcacagtggctgtggctaccagaggtttcctgtgagggaactaaaaagcgcacagtagtgtttgtaagtgatggttccattttaatagataaacatacagaacttataaaaaatcaagaatctatattagccagatttcctaaattagttaatatttcttttaaatttatacttaaagtcacagtttttaaaactatatatatgaatgtgaatactatatgctttggggaatttgactttggttattttctagtgtcaaggataaacacagccagacagtagttaaagcgatcagcacagattttcttccataatatactattgcaatagagaaaagagaccaatgtgaaactgggctcaacatcaattatcccagaggtgactgggcattttaaagggaaattcagggagtagggaggggtcagcaggggctcagcagagttggggaagtgaaaattgcagaaagcaggaagagggtttggtcagtgtgaagccatctgggtttcactggtgctgatagaagtcaggctcctgcccttccacagaggcttgtctgcaggagtggctggaaccaacaatcagttattttggcagccttgagttttcgtaggcaagtactttaagggggctagagtcatgtagcggtgtgaccttgagctgttgaacttgttcaagtctttataggccagtgtgggggccttgtggagaaaaagactcagagcagcctgagtagagtctggtccaggagacacttttgtcactgagcatgaccaatccatttatcacaatggtagcagcgtgtcctcatggaattatgtttccttcgataaatcttgaacaagaaataaatgcatcagcatatgtttttaaaagttaaacagatgttaaacttaaaggaagtttgctaaaatccatttcgtggacccctttgtaaatacctgacctacacagcttaccccttatgatttaaagttaacttgcatccattttatggaatcccaggtgcctgtttgacctgcagacatctttctcccttcttggtcactctctcagggcatcagctcttcacacagcaacagcttcctgcatgtggcccctgactgtccattgatgaccgaaggctcgtggacttgccaagttgcccacgtaaaacccagggttcagagagcgagacaagtccttgcattgtgaagtgccaacaattctagtattccaaagctcagtgttgttcagaacatggtacccttgtgagatcacgtgtgacatttgtgaagaacctggaactgatgtttccttaggaagcctcgcaacagtaagtgctttcagctcgctcaaggaacttcaagtaggcaagaaataagaatggaaaccctgcattactccatcagatcttgaaagttttctcttggataaatgtgcctgtcaatcacatcgaatcttatcccctgcctccatgtgctataccacaacagcgacgtctgctggaccgtgtgtgctctctgggtacacattttccaggaggcagcatcttattagagagtaacaggtctgtcttgtgtaaaggagaatgctaaccgcttcatgagaaggctccccaccatgaactcggataaccggatgctatttttttaacttatttattttttaattgacaaatagaaatcgtatatagttatcacacacaacgtgttttgaagtatgtatacattgtggagtggctgcgtcaaggtaatgaacacatgcatcatctcactttctcatcatgttttgtgg

SEQ ID NO: 5451 - DNA, 135354 bp, human
cagtgctgttggccaagcctccagcagctgacgggacccagctgtagtgaggttgcagtgattgagtaggattggcctgcttcaaagcagaggtttctcatgggaatatgcttattaaactcccactggtgcagaaaccatgaacagaggatgaacaagtgaagttgcaatctcctccatcacagctcagttccccaacaacaggatcacaagctggagatgcctttaaggtaagcgtctattcccctggccaggctgggagtttttaaccctgaaacatactagttgggatgttcacagcagctacctgcttgtgttgcatattctcccaacatgtgttgtcttgttcttgtttcttaaatctgtttttgcttggtaatttccattgattataatgattttctgtgaggcttagcgagggaacattttaggagaggttataaatgcggctaattagtgacatgcaaatcgcttttgtggctgtttcaaaacatctaaatgacctataattaaattttgttgccaaattatttgttaattatcatcttcctatcaagtttattgcatcaggagatgtcattcactgtctaaaaggtggagtgaggaagagcatcatgcatatgtgttgcagagtgggaaagaatgcttgttttgttgggtttctgtctccattggtgtgtttttattttttgttcccacttctatgtatctcagatgacgagtttgtctatgggctgtcggaatcttctggttgagaaagatggtgggagccactttgtttaaatttcctaattttccataaacgaatcccttctgcaatatccccgacagatgcggcttttcaccctccacccaattccctcatgggaggaagggactttgagaggctgatcatttcgtggtctggcagcacttgtaagtccctggttctgttctggacactgtcccagctgtggcttctgagacaatggctaaatcctttctctcttttacagaccaccattcgagcacacttaagtgcaactcgaatgccattttccgctctgggtgaaatgttaccgattcctaagaaatcctggatgtcagatttttttttttttttttttttttgagatggagtctcgctctgtctcccaggctgcagtgcagtggcgcgatctcggctcactgcaagctccacctcccgggttcacgccattctcctgcctcagcctcccgagtagctggggctacaggagcccgccaccacgcccggctactttttttgtatttttagtagagacggggtttcacgtgttagtcaggatggtctcgatctcctgatctcgtgatccgcccgcctcggcctcccaaagtgttgggattacaggcgtgagccactgcgcctggccatcagatggtttttatacccttaagcatcctgatcactctcccttgatatgccactgaatctccatccctcttaaatcgcagggatctgcactgaaaaatattccgactctggtctgacttcgtgtaaacagctgagtggaactcatcttccttgtcccaaaagcatcttcttcttaacgtacaccaaactagtattaacttcagtcttctcagtcattcccttccccaactgacaaaacttgctttgtagttgtctaaagtcttcttcgtaggagctgcaagtaggtcacgtctgaatattggcatctttgtgtcattgattacgtttcttaaataagaagattatgtgttttccccattgcatttaattttgtgacttccatcttttgttccacttctcaaggtcttttctgaatctctgttctcttctgacgcacatgccattccccatgttggataaatattctgatagtcgattcatacaaatcattgatgtaaattatggaatagtgcagagctgtatagcacaggctcagtaacctctctggttcggtacaaagctttaatcagcacccttgtggagcgtttgtttagctagttacaacttttagatgctgtaacacatgattttctaattctaagctagatggctattcattctattgctgatattactggaaggaggaagtctggtagcattacctcaaaagacaggaggccaatgtcgttcccagagagctcaagatggcaccaaaagttcacggtttagcttcctaagtgcacaggaaccatctttaggaatatgaattcaggaatcttatgtcagacaaattttgcattgactagtctaactaaaagaaagataattaatatcttctttgtttatttaaaaataacatggttgtttataaagtgacatcaaaccatgtgcgcctctaggcagtaaatgtttatcggtggacattcacctaatatacacagcatactctctggctatattgggcatcttttgtttgcatttgcataagcactgttatagactgcttctgactccccaaaattcatatgttgaaaccccaacccccaaaatgatggtatttggcggtggggcttttgggaggtgaagaggttctgaaggtggaaactcatgaatgggactagtttcccatagtgattataaaagaggccccagagagtccccttgcttgttccaccatgtgaggacacatcaggaaggcaccatctatgaaccaggaagcaagtcctcactaaatactggatctcttggtgccttgttcttgcacttccaagaacagatgtgttgttccaggactgtgagcaatatatttctgttgtttataagccacttcgtctatcgtactttggcataacagccaaacagaccaatgcaagaaccattttaataaacaaggaattgtcattggctaattaagtagaattgtgtaatcatgttgtttgaatttggatcttgttggtttattgttgccataactgtctgtctgcaagtaacaataagcttgaagcctaagcaaacttaacatatgaaaatctgtgtcaagggcatctctgctttataaaagacagtcttcaattaggacccctccccagtgggattgagcacaaaaacagctatttgtgagaaaggatgccctcagctgcaaaaaaaaaaaaaaaaaaaaaaagatgttttcagtctttttcaaaattatgtttaaagacaactatcatcattaagttttttgctctatctagactttgcaatgttttccatctcagaacagaaactactgccctaaatattcaattaatattaaatggccctataggaatttatgtctaagagatagcattcattatctgtattttttcctattgctttttaggcatttatttatttttatatatttagggggtacaagtataattttgttacagggatatattgtgtagcagtagtctggacttttagtgtacccatcatccaaatagtgaactttgtacccattaagtaatttttcaaccctcactcctatctcactgcccaccttttatactctccaatgtctattattccaattagtatatccatgtctatccattatttagcacccacttataagtgacaatatgcagtatttgactttctgagttatttcagtaatgataatgacctttagttccctccattttgttgcaaaagacatgaattcattcttttatatgactgagaagtattccacggaatatatatataccacttttttttatccaatcctctgttgatggacacttaggttgattccatatctttggtattgtgactagtgctgagattaatgtacaagtgcaggtatctttttaatacaatgatgtctttccctttgggttcatacccggtagtgggattgctggatcaaatggtagttctatttaattctttgagaaatctccataccgttttccatagaggttatattaatttacattcccaccaacagtgtgtaagtgttccattttctctgcattcttgacaacatctgttgtttttagactttttaatatagcccttctgatggtggaagatggtacctcattgtggttttgatttgcatttctccgatgattagtggtcttgcacatttttgttttcatatgtttgttgggtgcttatatgtcttcttttggaaaatgtctgtttgtgtcatttgactcctttttaatggggttatttgtttttgtttttttttctcattgagttgtttgagttccttgtggattctagatattagcactttgtcagatgcatagtttgcaattttttttccattctgtaggttgtctatttactctgttgattgtttcttttgctgtgcagaagctttttagtttaagtcctgtttacctaattttgtttttgttgcatttgcttttgaggacttggtcatgaagtaaagccaagagtgaattagatatatttttttaagtttatggaaaccagcagaagacatagactacatagacattcatttttttttcactttcctcatcatggaaatattctgagacatgaaacatcactgtgacccaaggagaggcattggcgagagttagttgaaagagaaggagaaaggaaaagagtggaatatcattcactaaacacctcccatctgccttggaagttgggtgcacttcatctcttttaaaaatggagataatgggacatggaagcttggagtgataaagccaatatttgaaaaggggacgagttgactttatgatctgatcttttcacttaaagctctcagttcttcaatgagaaaagtaggtgtcctggacattattttatactagccaagttctgacttgagcaggaattaaaatgtaatggtttcaaagcactggataattcatcaaccagtagcactaagcacaggggtagggttagtccctcctcataccaattttatggctgtcattagagttaagcatttaacctccctggacttcagtcccttcacttgtgcaatggactgactgtttatttcccccccaaattcatatattttaattctaacccccaagatgatggtatttggatgaggggcctttggaatgtgattaatcatgaggggtttgtcctgaaaaatgggattagtacccatataaaagagaccccagagagctccctcattccttccaccatatgagaacatggggagaaggcactgtctatgaaacaggaagcaggtcctcaccagcacagaatctgcaataccttagtcttggacttccagcctgcagagctgtgacaataaatttctgttgcttataagctacccaatctgttgcattccacgatagcagcccaaatagactaagacaatctgtaaaataagggtattcaccacccatgaggtctcatagaaccttctgggtctaatcgtctgtggttctcaaagccttccccatttgaaggttgatgtttcctacttggtggaacatttctcttgcttccaactttattttgctctttctggcttccttggctgaattctctcttccctgtaattttctctgcatggcacttgcagtttcaccagtgggctatggaagatgtctttcaaagcctctggctaaggtgtaagaacagctggggtcctcattgggaagccgattaaactttaaaacagtaggctgaggtctagaactgttccaggaggtgagatgacagcaattgtccctgtgttcataccctctggttaatgtgactcccagctatgaatcaacctttatataaatgcattttggctcactggactgaatgtagctcggattcaataatagaaaatgtgtgggaggagacagtgagaaccccgaagccagaatggtctgatgttgtttcttgtgctggaggtccccaggttcagcgattcaccagaaggactaacaggctcagtgcatagtggggctcatggctaagatgtatttcagcaaaaaaattcagaacacattgaacaaagggaaacggcacatggggtaaaggctggcagaatccaggcataagcttccaggtatgtctctgaaaggagtcacacgggacatacttaactcctccagcagtgagctgtcaacacatatgaagtgttgcctacaagggaagctggttagagactcagtgcccaggttttttattgggagctgttcatataggtgccctttgcctagtactaccaaaattgcagactcccagacaggaagcaggtgttcagcataaactatgttgtttgtacaagcatttcaggcagagtgagccattcttgttaattctgggaagggtgagaaccctccccaaatctaattcccaattgccaaccaagagcacatgttacaagcaggcctttctaaggagagcaatctcaggtcctctatgttaacttctttctgcatatttctaaagtgttttatatttattatctttttaaggaaacaaactctgtcaccatgaagtcctagatgcatcccggaatgtaaaagctagaggagaatgttggatgtagcccatgacttcattttatagataagaaagccaattctcttctttttctcttttcttatttttagtatatttttatgagatataattttcctacagtaaaatgcacagatcttcaatgttccgtttaagttttgataattttatacaaacatataatcactgtcccaaacaaaatatatagagcatgtccattatcatctcagaacgttcctgttgcccctctctaatcaataccccagccagagacaaacacttttcagagttctatcaccacagacaatttttgccttttcttggactgcatatgaatggattcaagccatatagattatttggggtctcacctctttcactcaacataatgtgtgtgagattcttatgtgttgttgcatgtatcagtggttcatttattttcatggctgagtagtcttaggttagattgatgttccagagtttgtttatgcattctcctgttgatagttatttggattgtctccagtttttggttattgtgactaaggctttgggtggatagatagttttatttctcttgtttaaacatcgagtagtgtaattgcttgacagtaagatacatgtatattcaattgtataggaaatggccaaacttttctctaaaacgtttgcatgagtttacacttcaacaagtgatatataagagttctaggggccaggaacggtggctcatgcctgcaatcccagcactttgagaggctgaggtggaaggattgcttgagcccaggagtttgagaccagcctgggcaacatggtaagacctcatctctacaaaaataaaaaaattagccagggtggtggctaatttgcctctagtcctaactacttgggaggctgaggttgggaggattgcttcaacccaggaggtcaatgctgcagtgagctttgttcgtgctactgcactccagcctgggtgacagagcatgaccctgtctcaagaaaaaaacttagagttccacttgttctgcatcttcactagcatttgatattttccgtttttcgttgttttgttttgtttttattttagccaccgtaggggttgtaaaatgctatctcatggtggtaattttcacttctctgattactaatcaggctgaatacctatttatttgcttattagccttttgtatatcttcttgtataaagtgcatattcaattgttttacccatttcattgtttcattccttttttattattgatttgttctttacatattctggatataaatcctttaaaaaataattgtcttacaaataagtttccctggtctatgttgcttatctatattcctttttccttaatttttaaaaaattgaatgttactttgaattattttatctcatgtatcctctcaatagtcccactctcttcacttgatgataaattagaagcatctaaaaaaaccaatcattccccaaaaagtaaattaaaacctttctatagccattgttcagttctagttactctattagccttgttcaaatcgttgtttttttttttttttataaaagcaagctttattttgctatctgatgagacaatatgctagtttgagagtttggaataaaaaacatggatatttgtattattaaggaaagtttccaagcacatagttattaaggaaagcacatattattaggccaagtttccaagcaaaagtcttagaatagacataaagatgtgaaataatgaacggtgaccttagtatttgccattgtcattgttccatgcaatatgtttaaaaaatgtttttatttgatagtgataagaatactatcagatctaacctcttaaaattttaagtgtgcaatacagtattgtcgactgctgatacaatgtttgactgcaggtctctggacttaatccatcttgcttacctaaagttttatgcctgctgactcataaatccccattttcccttcccctatcccctggaaaccaccactttactttttggtcgtatgaatttagctactttagatacctcctgtaagtggaatcatacagaatttgtctttctgtacctggcttatttcacttaacataaggttctcaaggttcatccatgctgttgcatattgtagaatatccttccttttaaggctgcatagtattccattgtatgtatagaccatgtttttttttgtttttaatccattcatttgttgatgggcatttaggttgcttccatatcttggctatggtgaatagtactgcagtgagcagaggagtgcagatatgtctttgagatcctgatttcaatgctgttgggtatatttccaggagtggggttgctagatcacaaggtagttccattttttaatttgtcaaggaaattctgtactgtttttcgtagcaacagcacctttttgcatttccaccagccatgtgcaaagaaattctccacatccccactaacacttgtctcttgttttttgtttttttaagagcagctgttctgacaggtgtggagtgatctctcattgtgtgtgggtttgagttgcattttcctgatgattggtgatgttgagcatcttttcatgtgcttcttggcatttgtatgtgttcttcggagaaatgtctagtgaagtcctttggccattttttaattgggttatttgtagttttgttattgagtttgggagttcattatatatttgggatatatggttatcagtatatggtttggaaatactttctccccttccataggttgccttttcactccattatttcctttgctgcacagaagcttgttagtttgacgtagtcccacttgtctgtttttgcttctatggcctgaagcctattcacattcttaaaagtatcttttgatgaatagaaatagttgcttcattttaccttttactctttacattttaatttggataattttcttgacctgtcttcaaggtctctgattcttttctttgcccatgacatgaacttcttatttctgatgttacatctattttgttttatagctagcatttctgtttgtttcttcttttgtattttcatcttgccactgaaattccccatctcttaacacatgctgtttgcctttcctgctagattcttttatggatttcctatggatgtcttaaaggatatagatgaaatatctaacatttgcatacctcctgctatttcacatgtcatacgtgcaaacataaatatgcatgcataatagacattgattataaaaaatagtggagaccgagtcagtcatattttcgcctagaaaacatcacacgcttcatctgtgtggccccttggtaagctgccatttcagtgtggttgtgatttgtttggttttaattaggttccgctcacccccttggcttcagatgctttgagaggggatccacactttccctttagcagagcttaggatctgagcattggtgagactcttaagtcatgctctgtttgcagcctgactgctcacttgttgggtttttgaagggtcctctttgttttctgtcttgccctggatttggtcattccaaattcccatcctagctggggaacagggacaggtgtgtggctgcccatggggaagatttggagtgccttggaggggtgcatctgagcttccctgcactgcctcactctgagttttttttgcactgtgtggtgtacgattccccagggggcttcatgaagactgcaggagtgcattgaagggttggctgcaggtgggctgtctggctggacctcatcaggatgctgatctgccgtgccagcctacctacacccagtcgttaaaaactcctttcagggtcagctggattcttcctcttctccctactcctgctaccaggggtgaaagcaactgaaggtttcttctttgtaggaaggttcatcacatcctggattctagttcatttatgttttttctgcatcttcagccttttttttgtcggggggcggggggacagggttttgctgtgttgcccaggctgcagtgcactggtgtgatcatggttcactgcagccttgcaccccggggctcaagagatcctccgacctcagccttctgagtagctgggactacaggcatgtgccaccatgcctggctaatttatttatttatttatttatttgtagagatggggtctttctatgttgcgcaggctggtctcaaactcctggcctcaagcagtcctctcgctttggccccccaaagtgctgggattacagacatgagccaccaccaggtccatcctcagctttttgatggatcttaaaaagccatgattttaattggaagcctcataaatcactgttgggaatgtgaagtggttcaaccactctagaaaacattctggtagttccttcataatttaaacctagaatttccatatgacccagccattccactcctaggtatgtacccaaaagaattgaaaatgggtgtgaatgttcatagcggcattattcatgatttccctaaagtgaaagcaacccagacatgtgtcagctgaggaatggataaataaaatgtggcacagccatgcaatgcaatattatgtgggcattgtattggtccactctcacactgctataaagaaatacctgagactggataatttataaaggaaagaggtttaattgactcacagttccgcatggctgggaaggcctcaggaaacttacaatcatggcagaaggggaagcaggcacatcttacatggtggcagatgagagaagagcaagtgaaggaggaagagccccttacaaaaccatgagatctcatgagagctcactatcacaagaacagcatgggggaaactgcccttatgatccaatcacctcccaccaagtctctccctcaacacctggggattataattcaagatgagatatgggtggggacacaaagcctaaccatattaggcataaaaggaacaaagtacttttggtaacactgtagtatgtttatgccgatattatcaggtgggtgagcctagaaaacatcatgctaagtgacagaagccagatacaaaaggcctgattattttccatatgacccagccattccactcttaggtatgtacccaaaagaattgaaaacaggtgtgaatgctcatagtggcattattcatgattttcctaaagtgaaagcaacccagacatggtgcatgattccattcatatgaaatgtccagaataggcagatccgtagagagaaagctaattagtggttctcaggagctgggagagaggaatgaggagtgaccactgacaggcacagggatctccgtttaggggtgatgaaaatgttctggaatgagatacacctgacagttgtacaacattgttgtacaattaaattgatgtactaaatgccactgagttgtacacttaaagtgctttaaacggtgaagttgatattacgtggttttataataatttaaaaagaaactatgagttcaaggcttcatggcttctttaccttgtcaatgtgtgttcactggtccctttggctttccacgtcttaattagtgtggagtcctaattagggagagaggtcaggctagggggatggagggaaagtagaaagagaaggcaggtaagttataagtctccctttcttcatgctccagaacagatagccctcctgtgcaaataactcacagtctgcctacacccagctatctccagacccttggctgatagaaaattgcaagttatctcactgcaaccttggcattatcggtactgcacaaagccctcttcagcacacagcacaagcaccatcctataaaatccccagcaagtctttgtctctttgcagtcagctcttctctcactgacctgcctgttgcacgcttgcaacgtattttcatactctctctaataaatctgctttttttttttttttttcttaacctacaactgtcttggtaaattctttttattcctgcaccaccgaccgcagatagtcgccactcacccatgacaattagcagttaaagctgactgctcttttcatagcctataactttaaatttgtttttttctgtaaacattttcaactggccacatatgtcttgagtagacagaggctaattgtcagcttttgctttctgggttgttctattagggtgctatggcatagggtcctattaggatcctatggcaaagagcaacagtgagggtaagtggaaatttttaggaaaacttgaccacatctggggtaacaaattaaggcccaggggccaggagtttggtagaagcagcgtgaatcagaagctctgggggaaatggagtcgtccccaaaagcaggcaccagctgcaggtgcatgagtgaggagggagggatggtgcatttatacactgcattagggctagcgaaacctttatacagtgcattagcgttagcaaaaggcacttataggactttatcccctttattttttttaaccaccttgagaaatagagaatgggtttagagaaggcagagtgacatgcattttgttctgttgcaatttgggtattcttatgccttagtttgtctctgatatcttttagccaaggggaagaggctggcaaggtttccattaaaatttattttcacctttacttataccaatttggtagatatagcaggcgagcagtttcctaccttgaacaggggcatgagaagaatgtatctgcttttgctgcagacagcccaggtctggagaccctgcgattgggaaggctggttccactgggtagaagcactattgtgaatagtgatgtagtaaaaaagggagtgcaggtggtatggtttggctgtgtccccaccacaaatctcatcttgaattgtaatccaaattataatccccacatgttgggagagggacctcatgggaggtgaccggatcatgggggtggtccccccatgctgttctcatcgtagtgactgagttctcacaagatctgatggttttataaggggcttccccccacttcgttctgcacttctctctcctgtcgccatgcaaagaaggtctctccttcgccatcaccttccgccatgattgtgactttcctgagacctccccagccatgtggaactgtgagccagttaaacctctttcctttataaagtacttggtctcagatatttctttttttcttttttttttttttttttttgagatggagtctcacttcttcgcccaggctggagtgtaatggcgcgatcttggctcactgcaacctctgcctccagggttcaagcaattctcctgcctcagcctcccaagcagctgggattataggcatgtgccagcatgcctggctagtttttgtatttttagtagagatggggtttcaccatgttggccaggctggtcttgaactcctgacctcaagtgatctgcctgcctcgacctcacaaagatatttcttacagcagtaagaaaatggactaatatagcaggtcttcctttggcacattgatatatttccctttagataaatactcattagtgggcttgctggatcatatggcagttctagttttagttttttgagaagtctccatacggttttttataatggctgtactagtttacatttccacctgcgcaggtcacctgctggtcatctaattaccaaagcaatttttacaaaattcctctacatctttttatttatagataatcacagctgtatgcaccaatttatgatccctgaaaaaagagcagcaattatgagacagcttgttcaggggaaggagctcagtgtacaggttagggcctcccatcgctgtcttcctatgtcagatgcccgggctgattaccatgtctatgaaatacctctttaacacagagggttaactagcttgctgcagtgggaggtaagaataacaacagcctggccatccactgatcctggaaaatgctcatccacagagcagctgagccaagatggtttgagctatctttgtcttgtttcctcatctggttgttaaatcccagaggccctctgatattgacagcgcagatgctgatatatattaaatgtgtggaagcacttcatgccatccccaaatcccttgctttttcttctcctcaaacttgtgtgtattttattttctctccttttacatctgctgcccatggttttgttctgcctgatttcccctgtaacataacccctggttaccaaatgctggaaagtcagataagatgggaatgctctatggcgtttcatccaggggatcctggaaaatgcaaatatacaaaacctatcatgaccaaagcttcctgtgaggtccctggaaaaactctgtgcacagagatgccctcagggggcagaataacactttattattttctccactactggtcctcaaagaactctcacaggagactgaattctgcccagagctcctttcctgcatgtcccagacatccaccatcatttcctcctaagtccagactgactgactgactctgttgccgacatgcaaggaaagggacttctcttggtttaacaggaaaggaaatagagggacagagcaaataaaagggtggtggagctgtagggctgggacagagactatatgggagagtagatgttggacaaggagggaaaattgacactccagtcagaggcagctctggcctcttagctcactgtcattcttaaggcagtctctgggaaccttggcttctttagaacactctacctctgaaatctgtgacctaacccatgacttcaaacttgagcatcctttaggcacttggaggatgtaaagactatcctcatcctcatggagagtttattgttcttgaatctgatccttttacaggagaaagaagaagtcttaggctcaccctctgttaagtacaaaagtttcaatatatgtttctagacgtgttttttttcttacaaaatccttctataattcactattaccaatgaagagatcatttaaacatagccttctcaaccttttcttcaaatcccaccatcatgaaccatttgtccactgttctacagtgccaagaactctccaaatatggtggcctcttaacatgccagagaggaatgttttcagactccccagattgtttaggaccgctatgggacacagtcctctccatcaaatttggtaccttgtaaataaatgaaaatattaggtaagctgtgatgagtggttcatagcaaagcatttggatttggaggttgggtagaggtcttagatctgagcaagagagaaatggctccttccacatggtaactttatggtgagcaccatttatatcttgcctcagggagagcacacatattacacataatgggccttctggatctcattagagaggttaaaaccaaaattgcaacagaggtatcctgcctatgatggcactcaaatgtatcccaagtctgtacatttgctaaactaacagggatgaggagcttacaccaaggtaacattaattccagttgccttggtctgtggtatgcacttgtgtttgaaaccttgaaccttcttcagaaaaactgtttgaaaaatatttagttagccgggtccattggttcacgcctgtaatctcagcactttgaggggctaaagtgggagaatcatgagcccaggagttcaggaccagcctgggcaacatgacaagatcccatctttacaaaaattttttaaaaattggccagacagacacagtggcttgtgcctatggtctcagctacttgggtgggaggattgcttgagtccagaaggttgaggctgcagtgagctgtgatcatgccactgcattctagcctgggaaacactgagaccctgtctcaaataaaaattagtcttctgaaaaacatagggaaattaaaggaaattgaagtcctagcagagatatccaatgttggttattacacacttgtgtatgtgaatgtgctctttttattttctggttccttttaccttgttttatacataacctttagataagctttgaattagacaaaacatgttcactttgtttttaacaagaatgtttttctacaatatatatttattggaaaatacccaaataaagaaatacctattatttaatttaatataactttatattctaaattatgaccaatttaactacaagtatttatcctattacatttatctattttattttgtttacctagattatttatgaaaactgtgatagttatgatttaaagttataaaacccccattgcaaaattataactgagacagtgaaaaaagatttgacctaactgactccatcttgctctgaacctccaggctgtccttgttcattcctgggcataggtcaaactaactttgggaggaacttagtttatagattagctttgaaacagagatgataacagtcctttcccaaaacaaacctccttactgcctgtggactagactgcctaaagccacgagattagaagttatggtaattttactaaataattaaagatgtagctattttcattaaaccaatatcaatgtcttatttattaaaaattacacaagcaaaggtcgttctgttttgggctgggtttttagttttgtaacccctatgccaaaatttgacaccttatagtatttggcagggataagtatgacattgcttaattaataaatgcaaacaatgcatgctgacaattcttaagaaatttctaatattacttaccaataattttaaagctaacttatttattaaaggttttaagttatataaacttgaaaaagcatttgactagtccttttttcctgataaagtatttaagtgtttttatttttctttaagccaattaattagagctcttttatatatttttagtagtgaaacattgtgtacacaacgcataaatacatagatgcattaggtatgcgaatgaaagtacattttgtagatccataaagaccatcctttttttttttctatcttagactttcagattcttgataacctgttttacaaccttaggtggttgtcagctaaatagccttaaaattgcatgttaaaggaaaccactcaagtaaaaatcaaacagcaaatttacatcataaggcagagagagaaaagatctggtgttgctagagggagatccttttatttttctttgagcagatcaaacgtaaaattacacatatctattatgtgattgcataaggacaccaattttgtttagataaggactatctatcttttaactagatttctgaactctggccagaacccccccaaaaaccaaagatttgctcaaaaaaaaaaaaaaagacaagttcttaggagagaaaaacaaaacaacaaaacacgaaggccttttaaatacaaacatgcacacacacacaaacacacactttttgttgttgttgttagtagagacaggatttcaccatgttaaccaggctggtctcgaactcctggcctcaagtgatccacccacctcggcctcacaaagtgctgggattacaggtgtgaagtaccatgcctggcctcaacatagtattttaaagttcatctgtgtattgcatattgcaatatttcttcattttgtaaggttaacaatattgcaagaataatactgtaagaataatattgcattgtatgttgtgatggttaatttcatgcatcaacttgactgagctaaggaatgcccagataactagtaaagcattattactgagtgtgtctgtgagggtgtttgtggaagagattagcagttgcttatttttatttttatggatttaggagtacaagtgtggttgtgttacatgaatattttgtgtcatgaagtctgcacttttagtgtacccattgcccccatcatccaaataatatacattctacccaataagtagtattttctccttcaccccttcccacactcccatcttcaatagtcttcaatgtctgttattccactctgtctgtctgtgtgtactcattgtatatctctcccttataagtgagaacatgagattttttacttttgtttctgaatcatttcactagggaacattttctttgctgtggtaaagttcctgttatgtaagcacattgtttacatgtcttctgcagcaacatggatgaagtgtcctccagtttcatccatgttgctgcaaaagacatgagcccattcttttttatggctgagtagtattccatggtgtgtgtgtgtgtgtgtgtgtgtgtgtgtgtgtgtgtgtacacacaatgcgtggtgtagatagatagatagatagatagatagatagatagatagatagatagcacattgtttttatccagtcatcgttgatggacatttacattgattccatctccttagctccaggtagattcagagaaaaagcatcagattatagaagcataaacatcacagggttttagacatgataggagcctttttattgtacagctgtagaaacagggacctgcaaagactgggtgacatgtccaaatgttgacagctagttagcagcagcaacaggatggcagctaccatctctggatccattgctgattgtcctcccctccatctcatgatgcatcaactggagcaatgacagagaagggggaaaataaggggaaagccaggagtggtggctgacacctgtaatcccagctacataggaggccaaggtgggaggattccatgagtccaagagtttgtgataaacctggactacatagcgagaacccatctctacaaaaatttttttaaaaattagctaggtgtggtggtgcatgcccgtagtcctagctactcaggaggctaaggcaggaggattgcttgagctggggagttcaaggctgcagtgagctgtgatcgtaccactgtgctccaatctgggtgacagagtgagaccttgtctctaaaaattgtgtttttaatttaaaaaattaaaaaatcagcaggaaccaatagaatcttcacacatgcaacacttagtgtgtcttcactaagtgaagacttcagtgtaaagacttcaaatgtaaacaaacaggttaggcaaggcttacttttttaaacataatttttaattagtattttattaatactcaatgtatattataatgaattcaactatactaggtataattgattgtattgagaaatacaaagaccaatgcaccaggtactgttgtatagtcgatagaaacagattcgctaaatcaataaaacatgaacatttattttagaaaaatcacaagtgatttaaataggtatttaaatctatagaaaagtctgtttagacacaatttcagaatgggttttttctgtcctcatgtcagactatttttctttatcgatttaaaacaggacctttgttggataatagcactttgtgaatcaaatttcaccagtgtacataccttggattgaacgaagctgcttttcttctaaaaaatattgtttgtcgtgcaagtttttctctgtttttaataagccttcttccccatcgagcaaatagatcaggaacattttctttgctgtggttaaagtttctgttacgtaagcacattgttaattttcttctaatgaacaaatttaatataattacatctctagttataaaaatgttcctttgtctctctctttcctaatgatgctgttgtaggaatagctgctttctccacaaaaaaagtttttcgtgctcttttgccaaattaagtttgttcagaaaaataatttttaaagggaaaattatgcagtttttcagaagttaatgtgccatgttcttaatattttggagtggagcagctttatttaattttaagtacttttatgttaactgactctgtttcagttttttgaaacctctttatcaataccttcttgtaagccaggcttgtaggaaagaaaaagcaaagtccacttacttctgctggtaataatttatatacagtgggattctaagtggctttttttttttttttttgagaccgagtgtcactcactctgtcacccaggctggagtgttgtgtctcgatctcggctcactgcaacctccgcctcccaggctcaagcgattctcctgcctcagcctcccgagtagctgggactacaggcaagcaccaccacgcccggcagattttttgtacttttagtagagacacggtttcaccatgttgaccaggctggtctcaagtgatccacctgccttgacctcccaaattgctgagattacaggtgtgagccaccctgaccagccttaagtggctcttaacaaacttaaattttcacacattcttaattgggctagatggtatttctcatcctagtcctgataatatctacctccaggcacattttggaggtataatgaatgatatgctgagctaaccaaaatcattttgtgattcagagattaatataggcatgaaaaattattaatgggcttttatcctattgtgttcaatttcaataaaatggtctgcacctgaactaacccttttaccacaaagcatagaaaatggaaatgaatcttctccaaggagcgcgcgcgcacacacacacacacacacagatatgtatgtgtgtgtgtgtgtgtgtgtgtgtgtgtgtgtgtgtgtgtatatatatatatatatataaaatggatcccttctatgatggcatcttggtgtggaacaaattcataatcttaatcctccagtatttttaattgttccctacccagctaatgggaccagtatctttccaaggaacaaggctgaagtcatcattgactgttgcctctttctgacacttcacatccaggcaattaccagctcatgttgattgtgtctcaaatcggctcagttctctccagttctctcccacctgcccctgtgctagtctggaccagcttccttggggggttatggccattgtcgtgcgatccactccagtttctgcccaacccttctgccagggagcaaccagaatgcctgcgggagtgaaacgaaaccatgcctgtcatccctagtgtcctcaatctctgcttcatcacttctggataaagataaatgccccaaacctaaaacaacagaaaggaaaaagataaatgccctccatgtctgatcacgatgatttatcctgacctcttctccacctcacagtcagacttttgcatggaaaaaataaccaaccaaccaatgcgcacagtttgtaggaatactgcaacatcagcaacttatacaataatgataaaaaacaaagaacatggagagaaacacacatattacctgagtggctctctgagtggctggttgatgtttctcttttgtacatttataatagtaaaaatacaacaaaacatttatttaaaaaaatcaatttttgtgtacaaaaatcacaaagcataatagtccaaagtaggtctctaaatagctaggtttttttggtgagattttagttagtcctcatatagagcctgaattttgctctatttaatctcttttttagccatttccctttggtctaccctaaatgcccttttctaattcaggtgctttcaactttcagttataaaacaaaaattcatttttacatggttgctgagcagagacatgtgtccttaaattgcttatataaattctgagactcattactaatgaaacatgttcttaaaataagttcaacatgacatttcagagccgctgtcctggggagcttttttctcgtcctcattgacaaaattgaccttctcacctcaagctattggagttatctactactgtgtaacaaattaccccaaaacttagcagcttaaagcaacttgcgtttgttatctcattgtttctgtaggtcaaaaatctgggcacagcttagctggatcctccttagcttctacgtctctttcaggctacttcaggtgtcatggctgtggtctcatctgtggtccaaaagtagcaggatctctttccaagctcattcagatagttgcaggcaggacttagttccttgcaggatgttcacctgaaagcctcatttttttttgctggctgttggctggacacttctctctttttcttataacatgggtctctccacaatggccacttacttcatccacagccagcaagcgatagagtttgccagcaagatagaggtcatagtcttttacaacccaatcacagaattgacatctcatcactttttccatatcctactcattggaagtaaatcactaggtccagcccatactcaacaggaggcgattgtatcagatgtgaataccagaagggaagtcactggggccacttttagttggctgaccacatttttgttcaaaactctattagtgtacttattatactctacataacattttattattattaatagttgtaattttaataataactttataagttaataataacttaatattattaaataactataatgaacaactatggcctcttactatgattcccttgctgaatcaataagtactaagaacccagaaggagagaccctgtctctataaaaaaaaaaaattaaaaattagctggtcatggtggtgtgcccttgtaatcccggctacttgggaggctgaggtggcaggattgcttgagcccgggaggttgaggctgcagtgagccgtgatcacgccactgcactccagcctgggtgaaacagtgagaccctgtctcaaaataaataaattaattaataaaaataaaaaggtcctaagtgtgtagttttatcttcaaaataatacttgtaaggtattattattcctttcttacagaaaagaaaactaacaggctaaatatatagcttgtggtttcactgctagcaagtgggggagaaagaaagaaaacctcaacagcataaactgcagttctgactccactgcccaccttagtgggtttggtacttgtgcatttcctcatttgacctgtcagagtcttgcagggtgactgtgtgtctcatacaatcatagaaccaccataggactgctataatgtcatctttctgggttttgccctgtatttgtggaattgaaatagattcggttgaattctcagtgaattgctttccactggaaaggtgtagctagactaaaatgctcctaacaagttacatttgtctagcactttattattttggaaacctcttttggggttggatagggcagggtcttactctgtcgcccagagtggagtacagtggcgcaatcatagctcactgcagcctcaaactcctgggctcaggccatccttctgcctcagcctcctgattagctgggactacaggcatgtgccaccacacccagctaatttttacattctttgtagagatgggatcttgctatgttcctgcagctggtcttgaactcctgagctcaagcaatcctcctaccttagcctcccaaactgctgggattgcaggtgtaatctactgcatctggtcgcattttggaaaccttttatcgctagtatcctgagtaactcccccatggtcaaggtgacatcttagggtaatgtgcagaagagtgattcacaaggagaacatgccttctaaagcctcatggctggtggcctgagatgaggccagagctctgactcttatttctcctctcattctgctagttcttgacaagcagagaataaaagccagcaaaaagagaattaaggagagttaggaatgagagggtagctgtaacaaaaacaaacagagactatcacattccctgggttggttatctttcaggaagaatcgtggtgatctgcgtttgctttttatgaaaaggggagaccccgaaaagggagggaggtgagaggactattggaagtaggtcaggggagagagagagaattttatgtttcccaggctgggagctgtgtctcacgcctataatcccagcactttgggaggccgaggcaggtggatcacttgagatcaggagttcgagaccagcctggccaacatggcgaaacaccatttctactaacaacaacaaaaaaagattagccagctgaggtggcaggcacctgtaatcccagctaatcaggaggctaaggcaggataattgcttgaacccgggcggcagaggttgcagtgagtcgagatcacaccactacactccaacctgggcaacagagtgagactctgtctaagaaaaaaagaagaagagtatggctcccaatgactaatgtgtaggagtaaggattctttgactggggttcagacaggcaaggagcatgatgctgttgtgcagagtgtaactcctgataaaaatgtaaggtagcaaaagatttgccacatggacaaatgacaaaataagcaacttagaaggcatgagaagaaggaatgcttgcagcctaatgttttccttgaagagcctttttggagatggttgcctatgtgcattagaatttaagagcttccataatttgcggaagtatgttatacccgagaaacattgtctgttaacaccgaagatgtacttgtgggtgcaaatgagaaatttacacctactcaaatggtttggcatttccaaatcctttggtagatgccgatctgcctacatacaggagcagagggaatgaattgcaattctgttatgttcaggaggtgaaaattctacagatgatagggcgggtaacatgctagcactaagttggtggtttcagctggggacagttgtgttccccagaggacatttggcaatatctggaggacatttgttatttcacaactaggggagaacagagaagttggggacagcatcctgtcggggtttagtgggtagaggccagggatggtgctaagcatcttacaatgcacagaacagccccctccccaccaataaagactcatccagtccacatgtcaatagtgttgaggctgagaaacactattaacaaaatctgaggtccctaagtcaaatatcaactcatgataaaaacatgttctcatgttattttttcacacaggagaaattggttaagaagtaggtaaagcagttacagtgcttggtacatactaagcacccaaaaaactgttattttaaaataagaaaagttatgtatttatttcctgtatcaactgaaacatgaacctagtaatgaagtagagatgcagaacacagcctgctggctctggccttctctgatatgaatgctatatgttgcactcttatggggacaggaggttattaaactcactcttttgcaaattcctggtattagttatggatttgtaagccattaaatctacttagggacccctgatgctccaaccctgagcttttcgtgggcattattaatggtgttttcagttttcttaaaaacctctagtgtgtctcactcttcatatttaaagacggatgctaatttttgaatcttctctgtgccccgtaaaaccttccagccatttaaaaaaatagtgcatggccctgcttaatttcctctctggttgaactggcatgagggccttttaattaaacagaataaacatacatttttgatttaatgtggctttctttgatacttgctcaaccagcccctgctcacatggtgtctacagtctaattaggaaggggaacaatcatctgatctcagatttacaacccttctctgtcattatttattcatttgcctagtccacaaatcttgactatttaatgtgtgcgaagcatgagagaggatgctagggatatagccaggaggcatttagacttcttcctggctgcagaatgcttccagtgcagcagggaagattaaacgcaaaataactcaaactgcacttgcttgtatcatcagtgctgagaaagaaatgcacagtgataagaaaaggggaacttcctcccatgcaaggaatcttagagggtgtccctagataagtcacatgaaagctggggatgggggctgaagattggcctctccaaattatctctgccctcctctcattcttcagcctttccgcacctcactccaatatgaggtccattgttacaatcgtggtgttgaaggtaggagagttcaccttttattacacccacctagctatttaaacacaagcatgtagtacttgtatagatatatttgctcatatttgcaatttctctgtcacggatgtggggctggagcctggatttgccagccaaagagttaacagatgttgaacgcaatgaagaattgtctcaaaacagctgttccaagaaagggatagtgtttcgaataaaaagaacatttgttagagcacacatcatcttgagcctagccgtaaaaaaacccgttcacaagataagccattgttcgctctttgttaccaagtttgtgtttaaggagttaagatttgggagagactttttttttttttttttgagacagagtctcgctctgtcgctcaggctggagtgcagtgagacggagtctcgctctgtcgctcaggctggagtgcagtggcgcgatctcggctcactgcaagctctgcctcccaggttcgcgccattctcctgcctcagcctcccgagtagctgggattacaggtacccgccaccacacccggctaatttttttttttggatttttagtagagatggggtttcaccgtgttagccaggatggtctcgatctcctgacatcgtgatccgcccgcctcggcctcccaaagtgctgggattacaggcgtgagccaccgcgcccggccctgggagagactttcaacttagctgcaggtcctgcccagcacagtgttcacagtctgcaaggaaggtagcagggtattgcatgggattttatgttaatgatgttcaggggatgataattctcacccgggaaggaaatgatccattagttacactctcagtctgtgtcttaggccagcatgaagccattacatatctttagctgcaaaataataattttatgatgagataaggggtagttttatttctggcctattttaaaagagagaagatgcaaggcctacgccagggactaaatcatttcacttcagactttgtatagaattcatgtcaaataaatgtcataaattataaataagacataagtgtgtcacataaaataattctatggtaatagttaatgacagagctaagctgaataaatatagcaaatatgtgtgtgtgtgtatgtgtgtgtgtgtgttttcatgtaaacattttcctctatcatagaaagtgaatgtgaccatcgaacacatccttgaattctaggattagtcccatggatttaagtctcccaaggagataaaagtgaagagacttaaaataaaacaaacaaaaaactcttttgccctatttatttgaataaataagagtaagatagtcaatcactcaatcactttgcaaagcttaggaatctaactgaataacaaaagtaccaactcaatgtagataaggagaattgagtggatcaggagagagagaggtgattgactatgattagtagtgtcatgtgtgaaggaagtacccccggactgccagtcacatagcttcccacatttactctgtcttctttaaaaaatatcatgcttctcaaaatacttcacattctaagagtgcagctgcacgaacatagagttgatgattgcatggaacaactgtataggatgttgtaagaaaatatacttctcttggagctaagagctatgtagttgacagtgacttctctctcattactggatgtctactctctcacaccagcttcctcttttgctgtaatagagtactattcaagcaggagaaatttttgtctccctttctcccagcaatggctggtagagtctggagacatctttggatctcataactgaggggagttatacatgctactggcatgtagtgggtagaggcttgagatgtgctgaatatcctgcaatgcacaggacaggcccctacactaacaaatcatccgtccccaaatgtcaatagtgcagaggttgagaaatcctgatttaatgcaattcatgacctgtaatggaacccattatcctggctaatttgcatttgtgtgtactcctttactaaggctcaattaagtaatttagtgaatatttattcactcgcagggccatgggggagaactgcaaaagaaaattgagggattataaatacctaatgggaaggcaaggtgaacacacatgaaaacaaaccaaaaaaattctacttcaaaatgttattgattttctccagaccctaattatgtatattctatcatttgcagtgcataccctttgtctgtctttgcaaactgtcaattcagataatatagtgtcttagtgaattgttgccacaataatgtcatgtaccaattctcttccaagctcaacagattaacacaacagtgtatattttcattggtttgtctgttggctgaaacaaacaagctccaggctgtctgttgggctgtgtctgctacaatgcatttactctggggctcaggctgaaagggaggtagcacatactagagaaagagcttcttgtggtgatggcaaaagtacaacaggaccaagctaaacatgcaagcataacgtttctgtttccctcacatctgatagcatcccattggctaagacaaatcacatggttgagctccaaatcaaggctgaacaagtatactgtggtctctataaggccaatgcaggatacatggcctcactcaataccggtgggtcagagaaaggattgcgttattttaactaataagttcattttaatatttccatttcaaatttaacattataagaatttttcttgtttttttaagatttattactatttataattgtggcaaaatacacataacataaaattttccatcttaaccatttttaagtggcattaagtatgttcacactgttttgcagccatcaccactatccatctctagaattcttttcatcttgcaaaactgaaactctgtatctattaaataattattcccaattcccctgggattgagtacttatttaaaaaaaataataatctaccacccatttttaatgggagcaaggcttatttttatagagataattggcatatagcatgcatttatagttgtcagcccaacctatgcccaaggtgtattctatccaagatacagacatgtatgtcttcgggacctaaggtaggagccccacagaagtgtgttttactcagataaaaaagccttttgggaaggaattccttccaagttcaggccgagaagcagtatgggccatagccagggagcctgcattagagaaattggttgacattcagacccatgtccatcaatcactcaacagggaagtctacctaattctcaggttccaagcagtagtaggttaatccaagggggaaaaagtgaagtgtgcttttactgaaatctacatggaatattaggagcttagggcatcagcagcatatagctggcagcttcaggagcaaccagtgcaggagccagccagctggcagcagtaggggctttagcagtgttaaaccccagagcccatgagatggagctcagtatccttatcatcagccaccagtggtgggactcagactgggtaggcagtggttgtgaggtcctttagacaggacctgtttctatcagcaggaacaggaggcatcactacagagccctgggaaatgacaggcattattcagtagccaagggaactgctcgagtaattagaaaagcactgaagtctccaccatgtggaatgctgaaaagccctagaaatactgggttccagggacaatctgagagagaagagccatagggagtcctgggtgctagtctagataccacagcttgctatgagtatgactagggcaattcattgaatctctctgggtctttgttttcccttctaaaagtaagagaattgggatacatgatttgcctggtcttttctaaccgatactgtattacctgaatattatatgaatgttgttatatgatctcaagccaggctttatattcatgccacgttttggttgtagaaagtctgtattctttatttatttaattggttaattaattagagagagtctcactctgtcaactaggccagagtacagtggcgccatcagagctcactgtagtctcgaacccctgggctcaagcaattctcctgcctcagcctctcgagtagccggaactacagacgtgcaccaccatgccgagaaaatttttaaatttttttgtagagataggaacttacatatttcccaggctggtctccaactcctgagctcccccagtcctccctgctcggcctcccaaagcactgggattataggtgtgagccaccatgaccagccaatctctctgagtctttgtttctccatctgacaataagagaattgggatacatgatttgcaagacctttttgaactgaaattatattatctgaatgttgtgatttgctctcaagccagcctttaagttcatgccagattttggttgtataaagaccatagtcttaaaccatgctttaaaaaaaaaaaagaaagaaagaaagaaagaaataggcaatttctcatttctttccaagcataaatattagcttaagcattaagatagacaaggtttttgttgtgatggcattgtataactggattatttcatgcagtcttatgtgaggaattcagtaagaagttactttgcatcagctttatctgtatttagcatttagcagattaagccgaattgagggcctttagactaaatggcaaaaatggtttcacgtaataatagcagggtgctttttacattcatgatatctgtttgaacatgttaaattcaagataccagatatatgtctgtatggagaccttaattcagtatttggatatacagtctctctggacataaaacttaggtgtttctaagcattcattcagtatttaatctcaccaagacagcatatgtatttcataaaggtagggaggagatgaggaaagcagaaagtgtcttgaggctcacaacatttaaagtgcagactggacagtggacactcagaagtggcaccaggccaggaaatatgtttagtcgttgtttgattgtttctttgagtattttgcaccaagttagcctacacatttgtttaaattattaaattgatggtcatacaactgcacatgcaaatctgtgtgtctgtcttctctttaaaaattggaagctgctacaagggtgacattctttaggaggggtgcaagctcttggctggcaaagcccctccccatattgatgactaaacccaggccatttcccatcccccatccagcctctgtaattatgtggggttgtgttcctgattctgaggtccatgaatgaggaagaaccagcaaacagagactctgcagaaagagagacacaataggaaactcagagagtatgttcaaagagcagtgcattcctgagcaagggaatggctcactctgacaggtgttgctggaaagccagggaagagactctgccacaccatgtgcactggccttgatgtccagtgtccttagtgactctgggggagctgtctgcatgcaccaaggctggtgtgagtgcaaaaatagatgcagagtgaggtcaagctcacatgccagttcacacgctgaaggactgtcagtgctcccagatacacggcaatgagggtccagtgtcaggagagaacagataggtaaactaaaagcccagactccaccactacacatgcacgtaagacacctgcgctgtaccccctaaatctataaacatttttaaaaattaaaagtaaataaaattggtcctcaccatcatcccagctactcaggagactgacatgggaggatcacttgaacccaaaagttcaagaccagtttgggtaacatagtaagacccttgtctctaaaaaataaaaataaaaatattacccaggcatggcagtgtgcacctgtaattctagctgctcaggaggctgagatgggagaatcgcttgagcccaggagttggaggctgcagtgagttataatcacaccactgcactctaacctgggcaacagagccagaaccctgtctcaaatttttttaaataaaaataaaattacttaatagaacaaagaaattgttcaatttctttcactttacagttaagaaaactaagattcagagaactgatatgattaacacctacccctgactcccccacctagaataaaggtcataaaatttctccccgggccagtgagaaaaataaagtataaaaatttctccccaggcagatgagaaacagaaagagaaagtagtgagttttgtctcctgatgtcagggtcagagccacagagacttggttctggaagtatttgagagtaagaacctggctcaaggctgtgaaccagttgctgggagaggtgttgcctaccactgctggtgggaagactagaaggacatcgatattgagtaagtaagacctcaggctaccacactgcacacctacctgctaccttccggggaaccaagccaggcctctctctggctgggaaacctgttgagcaacctcctcatatttgctgccaacataagctccggttctaaatggagaacctgttgcagggtggggcagcaaaacctcaagagtgagaagagaggcaaacagcaaaatgaagtagaaagcccacgtcctcctcaacaagaaggggtctaactcaaaggaagcaggttgctggaacacgtacacagacctccatacaagaaagacatcatgtgtgtgttcaagccaccatcctccccaaagattccatcacctgttattcttacaaggaatgaaatgcagtgaggtgagagcgtgttgggatggcagacatggacgatggatgaattctcttccctctgtacattttccagcacaaagagctgccccaggctgttgaccccatacactttgagttttgaaaggtttctgtgtttcccttagaaagctactaaaccaggacaggcacagtcgttcaggcctgtaatcagcactttgcaagggtgtggcaggaggattgtttgagcccagaagttcaagaccagcctgggcaacataacaagaccttatctttacaaaatccacaaaaattagctgggtgtggtgacacatgcctatagtcccaggtacttgggaggctgagacaggaggatcgcttaaacccaggacttcaaggttgcagtgagctaagatcctaccacctcaccccagcctgggcaacagagcaaaaccttgtctcaagctgacatccttcagttcctttttgtgtccttgtcctttacaggaagatgaagatccctttcctcctactgttctttctgtgggaagccgagagccacgcagcatcaaggccgaacatcatcctggtgatggctgacgacctcggcattggagatcctgggtgctatgggaacaaaactatcaggttggtaatgcagctcctcagtaaacacatggctgtattcataggcaacagtccccgggatggttattgttgatctacagagcacagaacatgtagaaacgttcaaaaccctccaaaccatgcctggcttcatgtagatacactgagatgtaggtgtcatgaaggcaggtgtgagtttatctgtttgactatgaacagggagctggatgagctcagggagatcactaagaaggtgtgcatcacagttcttctttactaatggctacgatgctgctttccacacattcacatttccatcccttttgttcacctatttcgtcttctccttttggcatctggctttattctggttggttatgggtctgtactactctgtcctggctcatcagtgacttactctcactctcactctcactcatgcccaactctccctcttctagcccaggccctaccctgtcgtcagctatgcaggctgtcttagtctgtaaaggctgctatgacaaaatgccataggctgggtggcttctaaacaatagaaatgtattgctcatagttctggaggctggaagcccaagatcaaggcatagcagattcagcgtctggtggggacgtgcttcctggttcatagacagaaccttctcactgtgtcttcacatggtggaaggggggagggagctctctgggtcccttttataaggtcataaatcccatttacagggcttcatcctcatgacctcatcacctcccaaagaccccacctcctaataaaatcccattgagggtgagcatttcaacatctgaatctgggggggacacaaacatcgagaccatagctgacaatcaggagaggtatcatgttttaggacctcataacttgccagtaattatcaaaacagtggcaacaaggcaatcaaacgagactcgaggtcatttgacccttgggtctgaacatcctcccagaagtgggtgttttgtttctctccctctgcgtaaaatcaacctaacataagacctattttaaggacccttttgtttaaaaaggaaagtaagcccttggggagtagaatactgacattaaaatttcactttctcttcctaataatgtggagatgatggcataaaaatagttctatggagagcttcatcacatgaaagatcaatacaaactgaattaaaggagaggatgaggaaagagattatttgcttctaccagaactttcttttttctttttttcttcttcttttttttttttttttttttttgagaaggagtttcactctgtcgcccagcctggagtgtggtggcacgatctcggggatcactgcaatctctgcctactaggttgaagcaattttcctgcctcagcctcttgagtagctgggactacaggtgtgcgccaccatgcctggctaattttttgtattttttgaagagatggggtttcactatgttggccaggctggtctcaaactcctgacctcgtgatccacctgcctcggcctcccaaagtgctggggttacaggcatgagccactgcgccggcccagaactttcttgtaggatatgtgaatactaaatacctgaagccaggaatggacccattgccaagtgccatggggcgctggttattttccttccattctcttactcctcatcttctttttaacatgagaaatcttggacagtatatttaatcattgcatatcagaccaaacaaaaattaaatagattatgatattaaggaaaatctttcccacaagacatagccaaatatgtctcactttcaatctgaaactttgcatcaaatgttgctttttatttttttaagagtatattgacttatgacattgcttaaattttaaaaagcatatgcaagggtaagatctgcaattttaagagagcactttaaatgtcctcttaaaattgtaattatctttgtatgttttctgccccaccttttgcctacttttgtaaaatgtttacagatcactttatacatttgtgatatagatcttattaatttagtttttcttatcagcatcataattttattcagctttttcattttatctgtttctttaatattatgtattcctaagatatattgagatagtagataactgttcctaccaagatgtcttaattaaaaagttaaaatcaagcctttgaggttaaatctttaccaattatcaaaagaaaaaatgtctataaagccccatggaagaattcatggcaatatataccctaaatctgccttggtctctgtattagagtcccattatttctgaattacatttttcatttttatattttgtaatatcacaccccaaaatagtcacttttttttgtaggccactatagacactaggaagattaattcaaatgtaaaaacagtctctgtcttctaagcatctcaccctttaagaaaaaagcaaattagaaatattggtaattaaacacattcactaaattaataaatggtcactagtttgacattacagatgcaataaaattatttcccccttcaagctatgcatcattgcagcactactctgtgagggcactgatctagggaagccatgggaccaatgaacaagatgtatactcccaccctacaggcagccatcttgaaggggagcacaattagccatgccattgctttacagtgaagaagctgcttgtctggtggagtatggactactgttccaaatataggtcaatccccttgcataaacaaggaagggcactggaggcccatgagaattccatctgtacctggaactgaaggatggcagatgacaagccaggcagggaggaatggacctggattcctggtgaaggacgtggatatatcttgtggggtataacttggtatggtccaaaaactaaaagatattaattcctaaatgacttcccaaaatgttcagccaatccattcatagagaaaggctaaaggtatcactctacaagtgagctcataaataagtatttatgaagcataaaaaatataagccagcaaagggtatgtgggggtcgcagcatctaatttcttcactgtagtgtttgtgccttttccctggagcgtattaacccatttattgatgctcactggttgaggcacatggagtctgattattccctgtccctgggggcatgtagaaattaggcaggggctcattaaagctggttgtgggattccctttggctgtggttggaaagagaggggagtcagattgaccctggagatttctcttttggtgacacagaggtaacttaggagatgtggatcggagaagagtgaagcctcatcctcattcaccccttactttccctccctgcagtatcctatttcaaagacttggtttctctcttctaattcagggctagtgggaccaggagctcagagccctctgtaacatgaatggaccttttggggatgtcccgcctgcatcattcacacatctgcatggttttgttgtagcttgagtcttgattctgtatcacttcttccccacctcccctgcctctcatctcgcctctctttcccacataaccccagacttgcctttgctcattgagaagtttcccagtataaagagccatagacagtttcattttgaaaattatcacagagctgggcacagtggctcacgcctgtaatcccagcaatttgggaggctgaggcgggcagatcacttgaggtcaggagtttgagaccagcctggccaacatggtgaaaccctgcctctaccaaaaaatgcaaaaattagccaggcgtggtagtgtgagccgagattgcgccactgcactccagcctgggtgacagagtgagatcctgtctcaaaactaaatacatgaacaataaatgaaaatgatcacaaatgctatgattcttttgttctaggactcccaatatcgaccggttggccagtgggggagtgaaactcactcagcacctggcagcatcaccgctgtgcacaccaagcagggcagccttcatgactggccggtaccctgtccgatcaggtaacctcctatctgcatcgcaggggctgtggtcaccttcgggacagtctcccacctcgaggtatctcctggttcctaagggttgattttttcctggtccaggaatggcatcttggtcccgcactggagttttcctcttcacagcctcttcgggaggacttcccaccgatgagattacctttgctaagcttctgaaggatcaaggttattcaacagcactgataggtatggacatctatgggatgggaaccatctataggtatgggaatgggagggaggacttggacaaagttagcaaaagagtgggagaggacatcatgacagttatcttagggatgactttgctggtacactttgcataactttaaatggaaacaaaatgatttcaattgtaggttaaaacacaatgagcctatctggactactcaaatgtatagatgtgtgtgtgtgtgtgtgttgtgtgtttgtgtgtgtgtgtgcatgtgtgtatagataaatagatacttaggttatacctaatgatagatggatgaatggatagatggaagaaagcattgatgaatggatggatagatagataataggtagagaaatagctagctagctagatagacagatgcagagagagacaaaggtgagatagatgggatggatggatggatggatggatggatggatggaaggaatagatgatagctagctagctagctagctagatagatagagaaatagaaaaacagacatagatagatagatagatagatagatagatagatagatagatgcagagagggacaaagatgagatagatagatagatagatgcagagagggacaaagatgagatagatggggtagatggatggatggatgaaatagatgatgatagatatgatagatggttggatagatagatagatagatagatagatagatgttatatataaatagatgcagggagagagacaaagattacataggatggatagatagataatgaggcaattggatggatgaaatagatgatagatggaacaaatgaaagatagacatatacatagaaagaatatacaaaactattcacaccatgctattgataaagattttcattttactttccaatataaaattatgtcagaatttgtcttggttgacacacccactgattttatcatgtagatagggttgacaccttcctttttgcatgaagagcttgaatctaagcaggccataaaatgaatcctagcaaatctcagaggagcaaaatgacccttttctttcttccaacatcttgttaaaaaactatcatttttttcttttgtgaggcactcattaatttagtgatctaattaacattttataagaaattttcagaggtgcttaaaataattgctgagttactgagtgtgatttcctcatgcctcaggggtaggttctgaagtaaggattcgtttccacttttaacattcaaggaacaaaattaagttgcttctaaaactttaattttaagggcctgtctcagaaaagcatctgaccaggaaaaagaaaaaaaaaaaaacaaacttgtatttttctgtagagtgtggtttcctgcctattaaagatattagctagttttctttttggatttttatctgattggggttttttgttgttgttttgtgttgttttgttgaaatcactaaattagttcttatttcttggtagagtgagtagaggatttttatctggttgagattttgtttgtttttttgttttgttttgttggaatcgctaaattagttcttattttctggtagagtgagtaggtaataccttagcgtttgtggggaaaaaaaagtgaaaaattctagggtcctatgagcgggaaggctagcttcatgaaatagtcagaaagaacctccttttcagcatgtaggaacagaagcttggattggaatcagggtgtttattgggactgaagtgatcccccatttgtcttctcagggaaatggcaccttgggatgagctgtcacagcaagactgacttctgtcaccaccctttacatcacggcttcaattatttctatgggatctctttgaccaatctgagagactgcaagcccggagagggcagtgtcttcaccacgggcttcaagaggctggtcttcctccccctgcagatcgtcggggtcaccctccttacccttgctgcactcaattgtctggggctactccacgtgcctctaggcgtttttttcagccttctcttcctagcagccctaatcctgacccttttcttgggcttccttcattacttccggcccctgaactgcttcatgatgaggaactacgagatcattcagcagcccatgtcctatgacaatctcacccagaggctaacggtggaggcggcccagttcatacagcggtgggtattgccttgtcctctgatgctgcctgttaaaaaacattctgggttatttctcgtggaggtggaagaaccaacagggttttgttgttgttgttgtttgtggtttgttcgtttttttgagacagagtcttgctctgtcgcccaggctggagtgcagtggcgtgatctcggctcactgcaagctctgcctcccgagttcacgccattctcctgcctcagcctcctgagtagctggaactataggcgcccgccaccacacctggctaattttttgtatttttagtagagacggggtttcaccgtgttagccaggatggtctcgatctcttgacctcgtgatccgcccgcctcggcctcccaaagtgctgggattacaggcgtgagccaccacgcccagccagaactggtagggttattatgctagccacattttcccttccatgcctaacacatttcttcagccagagctcgccatagcacatgtttaatggccttagaaaggtattgcaatgcagtgtgctctccttagagtctctttgccaacattccccacatcctgggctggaaaggcccatggcaaattaatgtctgctgatgacaaaggaggtgtcagatatcccactggttttttgtttgtttgtttgtttgagagggaatctctctgtgtcgcccaggctggagtgcaagtggtgcgatcttggctcactgcaacctccacctcccaggttcaagtgattctcctgccttagccttctgagtagctgggattacaggtgcctgccaccatgcctggctaattttttttctatttttagtagagacagggtttcacaaacttggtcagtctgcattttgaactcctgacctcaggtgatccacccacctcggcctcccaaagtgctgggattacaggtgtgagccacagtacccagccccactggtctttaattttcaaatgtggccatcaagagaggcaagataatggcttatgtttagtttataggttgtccttgtgatataaacaatgtggaaagatccaaaatattttggattaatctctgagcaaacaaaacaaaacaaaaacctctgtgagtaaactgggtgaagtgaatgatgtctcttgggtctgtcaggtcccattgagtttatagttttggggattgcaatctgtaaatggaataaccatcaacagtggagcagacagcattcctgaattacataggtaggtataatatatatctatattataatacataatatagagagcataagtagatataattaagtagatattatatagaggctatgtcaaaaacacttgctattcaaaacaagcaaataaaagtattttgttccacttgtaactgtggagaacaggactctaaagagaaatggaaagttcatctgaaaatcagacgtttggtctttatggtgacttaaactctatgagagatgtaaaagagagttgggagggtgatttaaaaattataaaggagacagaggaaatataggtaatattggtttgtcatccaattaattgcatgacacaaaattgtaaaatcaatctctggattgaacaatgaatgacaatgaaaaggaagttattgtgatgaagggaaactatattagggatttaatttaaaaacaagcaaatatgctcagcctaagaagagaatacatagttaaggtatgtggaagctacataagttagggctggtgagaaaggtaaaaggtaacgtactctatgaaaattatgttgtcatttcctcacatggaagatgttgtgttcctctgtccagatcttgtgtgcctggagttgatgctttactggaggttgggaatgggcagtggttctcctcactctcttcttccagttatgaaacagcataggagcaacccattcacctggaggtacaacagtgtcctgctacccacaacatcacggattatgcaatagataaatcatagggtgtattttagtatatctctctggtatcacaaaagtgtttcatcaactctgacagaagcccacatatggtttgggtgtctgaacagactacgaagtgacttacacaaaagttgcaattgatagtatcacttcctccttctaaaaatgagacacaaatagaatgattagttcttatagttcacaccgcctctcagttttgacagattttgttaaaatctaaattgtcattgaactgtgaaatatataaactggtcattggtcattttaagtattctcagtttcagcctctgggacttggctccagagagtattctatgtactagctgcccaacggctgagggagcaccacacaatttaagtttttattttggttaacatccaacttctgctgccagtttctgtttttgtcagtgaagactgacaaaatctcagtggattaacacttgaagatttgtttcttgcccatgcaaaatctattgctggttgggtgatgctctagggaagctttgctccatgaggagactcagggatccaggttgctaatatcttgtggttctgtcatctcaatagatggccttcccagtagcgtccacaggagaaaagagttgaagggtcccttgggggctttttgttacttcactgacccaggggtcagcatgtagaccaggccccatgtctccaccctgacttgacatggggctaagaggcagtctccccatgtcttcaggaagaagaaaatgaaacggccttgctgaacatatagcagtgattttcctactgcaaacagtgattttcaaatttgttttaaagctgaggaatatttcagatgaaattttatgagaagctaagtatgtcagagggataaaagttgcagtgcttgggtgaacctggaacagaggactgcatttggaaattgctgacatttaataaagccccatggaaatctcatgaacagctggagagaaagggcagactctgcaacaaaagaataaaagaacatgtgagcaaacatctagttagtgcagactctaggcaaattaatatttaacagacatttgtaagtaaaaaaggtaggcacaccaggagaaaaatcaacaccagccttggaattttaaaaaagaattgatattacagctatgtgagtggaggttgaaggaatttgcccaaggttatagataggtgtaaactaaaggggctattttattataaaaatttggattgcagacatgtaccgcataataacattttggtcaacaatggaccacgtatatgacagaagtcccatgagattataatggagctgccttatgcagctgtacgtttgtatcttttttgtttttttgagatagagtctcgctctgttgcccaggctggggtgcagtggtgcgatctcggctcactgcaatctccccctcccgggtttcagtgattctcctgcctcagcctctgaagtagctgggattacaggtgtgtgccaccacgcccagctaatttttgtatttttaatagagacagggtttcaccatgttgaccaggctggtctcgaactcctgacctcaaatgatccacccgcctcggcctctcgaagtactgggattacaggcatgagccaccacgcccggccacgtttgtatcttttatactgtattttttcctgtaccttttctatgtgtacatatgtctagataaatacttgccattgcattgcagttgcctgcagtactcagtacagtcacatgcggtgcaggtttgtagcctaggagtaataggctttaccatatagcctgggtgtgcagtgggctataccatctaggcttgtgtaagtgcactgtacgatgtttgcagaatgatgaaattgcttaatgatacatttctcagaacatatccctgtcactatatgatgcatgtctgtacttgaagcattgatgtgaagtatactgcttattggtattttaatattttcatcagagaaaaatagagtaaagaaaatctatagtttggtgttgtgttgcgtttgtgtgtgtatatatatatgtatgtgtaaatatgtgtgtgtatatatgtgtgtgtgtttgtgtatatatatgtgtgtgtgtgctttacacacatatgtatttaatttacaaagagataaattattgaaattgatttccaagggaagctataggagatatacatgtacagcagcagcaagtattaatgtaaagaataaagaattttctgcccagggttggataatagccactaaaagtcctttaagcaactatttatagatctatcagaattcaggtaagacatgagctatttgtcatgattttcacaggtttgggctgacaggcacttgctggaggggttatgagtcgttcttgggcaatatgcctgttgtctgggtgcctgtccttggtaaacattgggatctgtgagtaaccatagctccatcatgtcatgcccatgctgacagcctgtcttacccaggtgccagagactgcagaaacctctcggattctgctcacagcaaaatggcatggtgaaggatgtcgtgcaattcctaagagaggaaggaagacttcaagctgtcagtcacactcctgaacatttatttccagtattatttgtacagagatactgcagagttagtgcccgtggtcagcccacacagccagatgcaggcattgcagggctgaccacctgcctcctgggcatggcgcttggttcagaactgtacattgtagggtggcctttgctagcctagtgtatggtggcgtataatgtaggatcactatgacttcctgcaggtagacaaagaagggaaaagggagagtccaggactacaggggtagacaagtgatacctcagactttgcataaggaaaaccccagaggtgcttattacagctgaagatggccaagatgaactctagggactgtcacagagtagttccaaatgagactttgcatcagcattttaataagcttctcaagacattctaaactgggtgtttcataggacactctaagaaacactgggtttcatatacatgtatgagctttggctactgtgcagaaacactgcagttatttgtcacctagatttttctagaaggtgatgctgacaggtgatctcatgtaaaagctttggaactttataagatacatcattcagttatatcatcatctagtaaggtgcacatagatatgtgattaaaacaaaagcttatggaaatgatctttctcttactagggtgattgccctaatattttctaccccattttattctgttttttttttttttttggtaataatctggttttggaactaattaatttcatgatgtatcaatgggtcacagtctacatgattgaccatgctcttacctagtgtgtgagctttactgtgtttgataaacaggagcacagccattccaagatggagcggcgctcttgggcctatttaaggcagaaaacaacagtgtgctgtttatcaaatttgctgggaaagctggacatccttatatcagtcttcatctaccacaaatctctcaaaacgagacaaggtggagattaatacagcgtccattatacaatggatagtcagaaatgatacttggcttccagggtgaatcaccttgtatgacatgtattttgacagaaattatttaatctattaggtatataaatattcatatgattacaagtcattttaatgggtatataattttgagaggggaccaaaacaaatttattgatcatgaggatattgaagcctgacaagttaatcttgattatctctaattattagagagctgagattttcttttagaactacagatttaagatgttctggcagcaccaaagttgaagggatggttattgaattacaacaaaaggattttttctttaaaataggtgattctagtgtagatggctattgtccacattggagcactcacagcatggttaatattagtgaaaatgctagcatcttgtacactgtgtacattcacaaacagcttcttacatactttatctgaagatacaaagatttaaagcacattgttacaatcatccttgggtagagctgtctatctgtgttagattagttatctgattcacaaaatataatatccaagggtcctgagagaatggccttgatatgttaccaaagaatcctaacattggtgacaccaccatgttcataaaacattttttcaatgtctgaagacacatttatatgtgttatttcattatccagaatatcctgagcaatttagccaggtcttaccacctttgtgagaaatggaggtagagttattcagcagccgaaaaaggaatgcctgatcaaagcaatggtagtattagtggaatttactcaaatgctttcaaatttaaaaatttccagttacaactggtgccttgtttagatattttaacatatatatatatatttgtacacagctgcttctcagttcatctgtcaaaggtggtgaggaaaatgatttaaaactcctacttctaaaatttatagcctttctctacactgtgttactgatatgatttatactcaagggtttgctcctgagatgctagcttgcaatattagggtatgaatgacaaggaggcataaggcaaagatgcttcattggtttgtgattcttgcaaatgaggtccacttagtcaaacccagtttgtggcctgggattccaagcacatattttcaagttgaggagagcgatgatttagaatgtataaccatccactccacaatccctcaccctaattgactcattcagggataaatttatctgggggagatgcttctattattagagagctggataattagctcaccatatgttatacactgtatagtaattcaggagatgggtcatcctgaatgcactttaattagccagaaatccttgctattcttgcataaaggagtgaattataaatttcttggagatacccaactctctgtatgtgccctgtagggtcatcccattatcacagctttcggttttgccatccctgtcttcattgcaatgcaaaacagatccaacttaggtgcacagcagaaatggtaacacataatgggacatgttcaagtgtaatggacaccgtggaatggttgccaattatacgtcaggtgctgtggatacacacattgttttgtgcacctcccacacccattgcttccttcacaccacataacaacctcatgaggtcggtaaatagatgtctcactgtggagaaactttgaagctgaaatcctttgaatgaacaaagctccacaggtaataaagagtagaggctgaatttaaacagaactaactcaaccttttaaattttggaatgcttcataaacagttgggggaatcttttccatctactctagtgcggtagacttattgagtgaggattagtccgagtgaggattagttggaagaagattagggcattgtatgagtgtctcaacacctttctccagatggaagagtctaggtccaatgctcaaggaaggagaatgcatctctgtaattcttatagataagtttgaagatcagtagttttatcattactatggtaatcgagaagtacctggatgctctgaagagaaaataaagcgtaaggatgatgggtgaatgtagcaagttaattttattcacaaacagcttttttctttagttcaagtcaaggctaatttttaaaaaggtgtcatgctggtgggtagaatgagattcatgttttatgtcttcaatagaaagagatggatgttggtcactctgctttgtgaaaaaacagatatgttggcctcttctctgaattcattgaaacagtgcttcattgctaggaaaaatatttaagtaaatcacttcgtgtttttctctgaagatatatacatgcccacttcgaacagtagatttccaagaatggcaatgactttatacacacctacataatctgtatagtatgttatacagttatgggatttatagatttatctggaatttgccattagtataaggttctccaggctgaagtttattaagttgtttcaatatattaaatatatgtatgtatattttgagatattttaattagaagttcaataaaagctaataagttttagtcaagctcaatgtaggataactcttgttctttatagatgaattttttcagcaaagggtttatggatagcaaatcaaaaatttggaaattatgtagagttctgtttttaatctctgacttcccggagtggtaagatctcctgttctgaaaacagtaaaccctgctccctgacaactctccacagaaaacacaccaagacatcagcatgatggaaagtatcagtaatcaaggggtgggggggaaacacctacatgaaaagattatacatttagtggagagccatggggaagaatctctcctaccatttcctatggtctgtacttttatgataaataaatactcctttctacaagcattgcttgtgtaatcataattccctaaaatctatgacagctgataaatgtattattggaagaagatatgaccttttgtcctggtctatgtactgctatcaccatttggcacagtcacaatcccgaaatgcatttattgggttcctccagcctagcctctcccacttccagctggaccccagtgtaagtggctgtgatgaatagctgtgatttggctcaaagtgtcttttgaataaagggatctttaggaggtttcattagtttcgataagagtgtaagccaggaaggaatggggtgatattgattttaattcatggtaagaaaagtaaatcagattaaacactaagagcaatatacagggacacacacagatgctcattcaaaaatggaaaaagtaaataattaaagaattatcaaagagtcacattattcaataactgcaggtaacacatgatttgtttctaacttttgtgggcctatgggatatgtatttaaaaatgagggcaacgggcacagtggctcatgcctgtaatcctagcactttgggaagcctaggtgggaggatcacttgagctcaggagttcaagaccagcctgggcaatacagcaagaccctgtgtctacaaaaaataaagaaatattagccgggcatggtggtgtgtgcctgtagtcccagctacttgggggactgagatgagaagattacttgatgccaggagttcaagaccagcctgggcaatatagtgagaccctgtctctacaaaaaatcaggaagtattagctcggcatggtcgtgcacacctgtagtcccagctactcaggaagctgaggtgggagaatctcttaagccccggagttgtaggctgcagtgagctatgattgcaccactgcactccagcctgcacaacagagcaagaccctgtctctgaaaaaaaaaaaggaggggagggcttctcttttgaatgaacctctggtttcgggctgagcatattgtaacaatacaggtactgagggatgttcgtcttttgccatactagatctagtgggtccatggcattcccaactcactggggcatagataaagaatacttacacctgaccctggaaatgcctctccagccatacatttctgtatctctgaatatcatgcctgtgaatagctcgaaagcctacatgtttatggaaatcattcacaaacactgtcatgctatgtgaaccattgaaagctacctctttctgggagcaaattctgacccctgccaggttgagataagttctcctctgaattcattctctgcagcactgagtggggcatttaagacagcttagactagctgtcaatgctcttgtctgaactgtgggttgctgatggcagggtccggtccagtctctctttatatttctggtgcctggtattgtgtgtcagcagaacatttgcttaataactgcaaaacttatagatggaagacatgaacagctgggtgtataaatccacctgctgcacgcagaggtggtcacatgaactttgtgggggttgggggtggcggttgttgataccgctatctgatttatgccatactctaattaccagcagcagaaggtagccagaaggaattcacagacatccctatttgcattcctgttattccctatgcccactgtagttggaacaatactacaataataaaggtcagacactcagatgaagattattattccgaagatcctcaaaagtatactttatggcagacagaaaaaaaatgccttagccatcttcttgtgtgaattttcactcctgcctctatagaatgtaaatcttttgattctgagattggaatgattacatgttgctggaaaggctcagggctgtcttctgtatttttaacaaatggagcgcaggcatgtagcagctgaaagttctatcttttcgcacagtgtgcaagacagtggcaataaattttcagaagagttgtttactgaagtactccagctaataaaaaaggaattaagctgttattgagaaatctttcttccaccaacttgctgatgtgtcattcagctttcaaggtcgtagagaggaagagaaacccagatctccttcctgagcctgggtttgaagcaaatggtctttcctggtctctcaaaggatatcacaaagcaagaattccttcacctgggcacaggctgtcagttacaccccaggtgtgtgcaggaaagccagtgatttatgtctgtctagccaacattcccatgcaccgttgatttcacttctgttcctgaatggtaaatcttggaacagtgtttttgcaagccaagtatgcttttctctgttttctgggtttgtttttgtatgtcaaacctaatcaactctactcgatgcacagagtatacataaagatgctggtatctctgatgtcacccctatagaataaaaaaccactgctttatagagagatgatagaaaacaagttccataaatatgtgaattttgataataaacacattaattcccttctccccttctaaggaggattcccctgcattccaagacaaaggtcatgttccgtagccttgattgaaccctgaagctcaggtctttgactcaactgttctttcagtcctcatgaaccagcttttatttcaggctttattatttgccggttgtgtcatctttatcatttatttctttatttccacctcacattttaatatgccacaattttatgatcctgccaatcatgttgatggatgtctctttcttcttcttcttcttctttttttttttttaacttttgagcaagaggactgctatccaaaattggagaatccaagtcgaaactggactggagcccagtgctgggcatttcaatccatgcaatagctcctcgttctcagcaaattctgtcactcacatcctgtatgaccatgtactatgcttgggagattgactttttaagctttcttatctattttccttaactttaaatctaaaaataaatgggagaacagatgagagtgaaattgcagtgagattgttctcatacataatgtaactctctatttaggaacacaaagactgtaatttcatgttcgttttgaggaatctaagccagtttaggggaacacaatctgcttctggggaaggaggtgcaatttgcccaggtgtgagtaaactttccccataataagtaggatggaggcttcacagtctgctctgtgtggccaagctctctaacatactgtggctccatttcagctcctccaggttcctcaagggcatcttctcttagaaggagccaaacacatggcttggtagagatgctcatatgtaagtcatcagctaggatgacaattacagtgcttccatctaagcagtagtatgtcctcttttctttctgagatctaacagtgaatgttatagaccaggtccagtgggctctcattgcatgccttcttattccagttcctgtgagaggtgagacaagccactcaggattttttttttttttaactttcttggctgtgagatattaacaacatttccttgtttcatattcttgtaaaaaaaaaaaaaggttggggggtacctaatttgccaccaagtactggaataataaaacatggtactgatgattaccaataacttgttagatttgatctgcctgttttcagagaactggggatgcctggcttagctctaacccaaagtgtgctgttttgtgctaattttctctttcaaaggagtagggggttaataaatgtaagaactgaaaagggaagtgttacagccataggtgtgagcagttcgaggagcccaaggtatattaacattagcaaaatacaaaatgcatttagaaaagcatatatccatttattgtttccagaaaaacttattagtatttgtgacacccagtccaaaatttggaatgtttttggctatcatgagaagttaaggaagccaggaatacatagaagaaaaattaatttaattacatatatatatatatatatgtagtcttctgaacttttactggctggtaaagatgtggaccataggagatgaccccttcaaagtaagaagagacttaggagagaagttctgcagagtagtccctgctctagagcaactgttacataaaccatgtcccgtcaaagtaacaaaagactgaggacagaagttctgcagaggaatctctgctctagagcaactgttacataagccacattccttcaaagtaacgagatttaggacagaagttctgcagaggaatccttgctctagagcaaccgttacataaaccacatcccttctaagtaacaagagacttaggcagaagtctaaaccatatgcaacataaaccattcacaatgcaattcacattgcattcccaaggccctgtcgttcacttgactgctgggcggggctgccaatgctcagaaagcaaatgcagtatttcatccaatagcagagatttgctgaattcatgccacctgccaatcactttgcgggtgtcaggaacaccatgatataaatgacacctcctgcctggtggtctggtgggagaagagagcacataaagagctctggtgtcgtggaacacatactttattagcatttgctaataaaaattgaatctccgggctgggtgcagtggctcatacctgtaatcccagcactttgggaggctgaggcaggaggatcacctgaggtcaggagtttcagaccagccaggccaacatggcaaaaccccatctctactaaaacaattacagaaattagctgggcatggtggtgtgcacctttaatgccagctactccagaggctgagacaagacaattgcttgaacccaggaggtagaggttgcagtgagctgagatcatgccactgcactctagcttgagcaacacagcaagactctatctcaaatataaaataataacaaaaaaataagctccagaccctacaaccatgcctggcctgtaggggatgcttaacaatattgttttagggttcccttttctgagccccaacagggaaactagagaatactgaagagaaagaggaaatgaccagcagagaatcatctcagtctcccctgaggctagccatacaaactagaatccctcttccccaaggcaagttatagagaccagaaccccttctccctcaatcaagtcataggactgaaaaataggaccaatttttcctcatcctttctatgtaaaaactggccataaagaaattccccaacctaccttgactgtgggtcctagcactcccattccagagaaggtcctaccccacacttagaaagaaggaacgctgctcagagaggccaagaacaatctagacagacaggccttgccggctttccccactcagttcattagcattagatcaggccctttttgtccaatcctatttctacatggctgtacatactttgttgaacctaagcataaaaatagtcaatttcccctttatctttgggtcttcattctcaaggctcctatgtgtacacattaaatgaatttgtatgccctttctcctattaaaaaaaaaagaaattgaattcctgcccccatccatgcattcattctctcatttgtttggcaatattattaagtatcttctacaggtcaggcatggcactagggcctggagattcagtggaaggttaatgctccatggtgctcagccctgatgggacttcctggaaaaggggaacaggctctcagaggaggtggcattggagatggcttctgaacaatgactgcttgccagggagagggggaagtaagttttaggttgagaggtgatgatgtgcagagcattgagctgtgaatgtgcaagctgtgtttgggactggttaccatattggggtagaagctgggctgtgtgagagtattggcatcaacataaggcttcgtcaggactgttcatgttttgataataaatctgaagtgtagttatttaaggaacccacccaagttcacagaagtagttaaaggaagagcttgaatcacagtaagaagaagccattggggagtgggcagtgaggcaggggctgtcattaaggtgtgtctgtcccctctaagcattgcagcttcttgcacaaatctctcagagctctcaccaaccctggggaagtggacacttgtcctgttccctgatagccttcaaaaaggcctctcacccagtattctctttcagcagaaaggaattgctaattatttcccagacgagaggtaaagattgagcctacgaggtgaaactgagacacagcactaaatgcatttctcagagggcaacccgatgtgaagaagcacccatgggacttattgatccctatcagcagactcagttgtgaaacctcataccttcgtatagcaacatcgctcacagcccattgtagcaaaggccacgcattgacagtgacttataactcttgagtatctgtgcattctaatcaattcaaatgaaggaggtttaggtgctctctgaattaaggaatatgtttgcattatcattcccctctctcgagaggtttaggccaattgaatgaatgttctatttaactttgaaaatttcagtattgaccatttagtgttcattctaggagacttgttgtattatagaagagggtagaacacaaaattgagttggagttcaaacagcattgatgaaagtaattgacaactgaaggtacacaatggaatactattcacctttaaaaagaacgtaatgctgtcatttttgacaacatggatgaacctggaggacattctgctaagttgtataagccagacacagaaagacaaatactgcaagatctcacttctatgtggaatctaagaagaaagttgaactcctagaagcagagagtagaatggcagttaccagggactggggttaggggagtggatggggaatggggacatgttggtcaaaggataaaaagttttagttagacaggaggaatagtttggggatgtattgcattacatggtgactgtagtgacttacaatgtattatatatttcaaaattgctgagagagtagattttaaatgttctcacctcaaagaaatgacaactatatgagaaaatgaatattttgattagctttatttaatcattccacatggtaaacatatattattgcactgtccccaacaagtctatacaagaattatttgtatatatcaaatgatacctatatatacaaaatttgtatatatatttgtataattgtttgcatatatcaattaaaaattttaaaaggtagtcttctctagcagtgtgtgtatgtgtatttgtgtataaatttttttcccaaagaaatactattttcaaggtgcttgaattcatattaatcaccatatagagaaggaagaacagaattaaacaacaacaacaaaaaacaaatataggcaattttctattaaatctcttcctgagttgggtctttgggggatgtctcaataacataattcttcacttactgatccatagagggtaacaataagtcacttcatagagacacaacagagacttacctttctctgacagaagataccatattaggcaattaacttgtaatattttgtgaattttcaaatagcctgctatgataataggtggatcttaatcagaatggtggcagacatacttaacattatctgtggtcttttttttcctccctttttttttttttttttgcaggaacactgagactccgttcctgcttgtcttgtcctacctccacgtgcacacagccctgttctccagcaaagactttgctggcaaaagtcaacacggagtctacggggatgctgttgaggaaatggactggagtgtgggtacgtttctcctcagtgagtgcttagaaagctgctaagtctttgcctccttgtgttttctttcctgtgtatttctatctttgttcctgatgcctttagagacagcaaatgtatggggttttttgaaagtaaccaaaaatgcattgatcctgaaaggtaaatagaatacaaaaagcaccttcaccagcctcggcaacatagggagaccccatctctacaaaaaataaaaaaaaatcagccaggtgtggtggtacatgcctgtggtcccagctaattgggaggctgaggtgggaggacgtcttgaacccaggaggttgaggctgcactgagctatgattgcaccactgcactccagcctgggtgagactgagaccttgtctcttaaaaaaaatatatatatctttaccctcttttgcatgtctgcagttcctagtggatacatttcaggggaagtctagtctgtgggctgcagatggaagagattcatggacgaaaagagacaaaactttagtccttattatcccttattctatcaacaatgaaatatgaacaatgccttgtcattagcagttaaatgtgtgatggattttggatccagaatacctgcagctggctacagccttggcgaggctctcagggcaacagtgacgagatcctcgtgttcttcttgctgcatctaacgatggcaaagctttgcttgttctccaaactccttctctcccttcctgagcaaataaccctatttctgagaaacatggcatttttcactgacattgggaagacttccttactgaagctttgtttaagttaaaatgcatgtcttccatatctacatcatcatccctatgcttttattttgtcttgcagagctcagagatcccaggatgggggattacacctggggtctcttagctgtacacagctaaggggttggctggcatgcaatctcatgctgaatgaggtagggaaggccttagtgtgtgagttacgcaaaggagtgaaaaatcagcattccagtccactcggaacttctcacaacttccagtcttttctagcagcattgcctcttacttttacattgctgggctcatctggacagtatcagagtgacagaagagatcattttgtccatattccagtactcgcccaggttcctgaagattttcatatatttgtttccttttactttttctctctctcattcttccttccatttcttttggtgaaataactcaatagtttctaatctttggatccagatgttttggaaatccatgaaagttgcttcctagttctgtttgtttgtttgtttaaagcagaaaattgatggcagtggtggtcacctactgtggtgattgtcagaacaaattttgttctgttttgttttaaatcatgaaaggagcaccttcttaagaaacaagactgggctcttcttccagcttctagatgcttctttaattatctctgtgaacttgggagatgttttacatcttcaggcctctcctctatcatcttgataggaggattcaaattaggcgagttctgaggttctttttttctctaatagtctgtgattctataaagtaatgagagtgagtaccatttgtaatactaactaggaaaaacaaaaccagaacattctctctaacaagatttataagaagaatgcattacgcttagggctcgtacatataccaatacaagcctgcctccttttattttttcctttctaaaatgttgcacataaatcaatttatatttttcgcatcttagtgtaaatcagtagaatattttctctttttaatgagtgttctattttaatgtgtcaggctgcttatgcaactctaagatttctgttggctagcaagcaacctcacgctgatctcatcacacctgttgattaaattttatttaattagcatggcatacatgcctgactcattagaaagtctaacttccagtgttgtctcactactagttcctctaaagtatttggagagtattttcaatcttcaagacctgccttagcccctgatttatagatgtttgtgttgtttttttgtttttggcggaaagataaaatccttcccctaagcattccatgaatttttaagaaagtttttgttttttaaatccaatacatatgagtgttctaaagaatatttcttctttccaagaagggcttttccttattacacaggacgggactgttggattctgaataattatgtaataaaataaaagggggatatttgcttcataagaaacactccctgcacaaaggaaaactgagatggaagcggttaactagtgagggtgcatctcagtcactcagagcatgttctctccacatgtttgagggctgtataattctgtggatcatcactttctccactgcaggtttctctaagcctggaaaggcatattcagtgaccaagaacctttattatgtaactgtacaccagttctactgcccgtgattgtggcttactgccttattcttagctgagtgagtgctgtgtctcatattgttatagtaactagagaaagactgacttcatacagatgttgtgagagctgcagaaggggcttctcagtacaaccacacaagggcagttgaaatccaggagatacaattctgctctgcaaattcacggggtggtcgacatgattttaatcatcagagtgactaacattgagagctggccgtatactgggccctgatagcacatgtatttgtgggagccataggcttttggtcccataaaggttgtcaagaaatcactggcatgaggcagattgattcataggagaaaagacatactaatttattgaatgtgcatacacaagagccttcataatgaagacccaacctcccaatggggtccagaagcttatacaccatcctgaggttacagaaaggttgggggcttgggccaggcatgggggctcacacctgtaatcccagcactttgggaggccgaagcgggcagatcacctgaggtcaggagttcgagaccagcctggccaacatggtaaaaccccatctctactaaaaatacaaaaattagccgggcatggtggtgtgcacctgtaatcccacctactggggaggctgaggcaggagaatcatttgaacctgggaggcggaggttgcagtgagccgagatcgcaccactgtactccaggaagaaaaaaaaaaaaaatatatatatatatatatatgtgtgtgtgtgtgtgtgtgtgtgtgtatgtgtgtgtgtgtgtgtgtatatgtgtgtgtgtgtgtgtatatatatgtgtgtgtatatatatgtgtgtgtgtctgtgtgtgtgtgtgtgtgtgtgtgtgtatgatgggggcttggatcctggtaaaacaggttatgcgggtcagggagaagaggagttctgttgaggggcaataaatgattgctagggagaattattggatacaggaacagagattatcttgtaatttaaatgatccttggagttagtcattgtacttggaaaagggtctcctcaggggtagtcatatcttggtcttcttttctgcaacagacaatgaaattacagggaggggaagggaaaaaaatgttctccttgtgggggtctggatcttaggtagataaaagaacttcaccttctatgggagaaactgtgtgtgggatgagggggaggttagagagacttgaggcttcttcggtttagcatgtcaaaatgcaatctttggggatatcagtttctgagtcccagcatcttacctcattttgtgctgccagtggtccctgtgcagcaggtgatgttctcatcattcgcattccacaggtaaggcaagtgaggcttgcaggttaggtacacccacctcaggttacagaattcataatgggtgagcatgagttccaatgcaggtgtcccacctagaacatgaaatctacaccactttgtttcttttctttccatgtaataagaaagcgtgcatcatgtcagtgcacaaccaacaacatatctccgggacagatctagttcattcattagtcatgttgactggatgctaactgtgtgcttaaatgttttttggcagtgtagggtgggagtggggtgcaatgatgataagactataggtttaggggagaatgttcagcctacaggatagtaagaaatttaagattctttcaggagatcctataacaactcagggcagaaagtgaggaatgtcatgagggaggtgcagataaagtgcttgaacagtttggaagcaggaagggcagtggtgctgtgcatgttggatacagcagccacatcatttcagcagggcacacccacagtggaattctttgggcaatcatggtgctattgcaaagtctgattttcaatcccagttaattctgaagcagcccaagcatcagggaagaacaaacgtgtaaaatctcattgttctccagtatacaacaagcattttggaggcgtgtcattctggctgtttctcttcctttggaaatagactgacatttttcatagacctgttcatggttgggggtcaggtggaaggatggatgtagttctcaccgggggtttcttatctacagcttacaccattatagtgatcacagctagtctgtgaagtggaatttgcatgcaatcagcattcactcagagccctgtgctattaatagaacaacatgaaggaatcataaatcagcctttgctcaggattagactagcaagttctgtactattacaaagaaaaattcaagtggagaacaagaaggtgaatgctaaaacaaatctctggcttccaatcaaagcttcctggccaggtgtggtggctcatgcctgtaatcccaggtggatcacctaaggttatcagttcaagaccagcctggccaacatggcaaaaccgcgtctctaatcaaagtacaaaacttagccaggcatggtgtcacatgcttgtaatcccagctacttgggaggctgagatggaagaatcacttgaacccgggaggcggagattggcatgagccaagattgcgcccctgcactccagcctgggcaacagagtgagattccatcaaaaaaaaaaaaaaagccttgctatggaaaaaaaaaaaagaaaaaacacccttccactgctgagagttggaatcaactgattttatgagattctttcaaacaagaatggcaagtcttcatctttagatggagttccagaagtctttgtgcatttgtcgttcagttgctcaggattggtagcttggcatcccctgttggctgagcatgacagggcaaccctcagtttgatttctctcactctcctctgccttccctgcaggaggacctggacattgctatcgtaccctctgggcacagagaaccaacctggaggaaaaataagtggtgaattcatgagatgagcttgggggatgttacagaatgaatgcgtgtttgccatgcctgacatttagtcagtcatgtgcaactcaatgtagcagcaagggccatgcacccaactcgtcttgagggatggagaataaattggaaggcctcattcgtaagagctcaggattgtgtcaagaacctcaagaaacacaagaaaactctggcaatggggaaccataggtattggtctaagcccttcaaatttgcagtgtaattttaagtagggcctggattatcagacatggttgtaatggattatccattttaaaatagactcttttaggaggtttggattaaaatgattgtgaaagtatggactgtagcatgcaatgaataacccctctgtatataggttcatttacatggacaaaagtcctctgattcaatatacgtagaagacatctacttttagaatctgtaggggccatggggaaaacttccccttcaccctctgaagtttctctaaagctcaactcacaaaacgcagattaattggagaaaagtcataaaaactatattaacctgcacacagggagcatcacagagtggctacccaaaccccctatgggataccaaagcttgtataccatattgaggttacagaaagaatgggagcttgcatcatggcagccctccgataaaataagtggtaaatggtttgtttgtttgtttgtttgtttgttcgttttgagacaggatcttgctctgtcacccaggctggagtgtagtagctcaatcttggctgactgcaacctcgacttcctgggctcaagcaatccttccactttagcctcctgagtagctgggactgcagatgcttgcccccaagcccagctaataattttattttttgtagagacaaggtctcactatgttgcccaggctggtcttgaactcctgggctcaagcgatcctcccatcttggcctcccaaggtgctaggattacaggcgtgagcctccatgcttggccagttaatgtttctttaagatctttaaagtgtaggactctcatttcgtatttcctagatctggacgagggaagtcctggttacatgaatacagagtttctgcagatgcaaatctcccccacaaaaacagctctccttgcatgctgtctgagagccatctcgcatatatgaaataaatatattttgtggtaaaatattttgatttccttcaagttctatagaccaggtacacattaggtgctcaataaggaagttttaaaagtgaaagtatggcggtcaggtgcctgatatttgcaaagcctgatccaaggtgccaggaattactaggaacacagatatgaataaggttgacttggctttctcctatatatcaaaatagtagtccaaccatgggcatggatgagattgttctgcaagaatatttcaggcagttgggcaacctgtgacccacaatttatctccatctaatccaggataagagtttagaaatcaaccttcatgtctttacttctcaaaactgtaagacccaaaaaaacaaaagcccatgttctatttgacattctttgccctatacagagtctagcctggatcttaaggctttgtatttcccttggggtgtaatgcatcacttttctatcttgaatttcttaaacattcttatttttgatcaatgcaaccctctttaaaaagtgacaataatgtgctcacttctggtgcacagtgaggatggaaggtccagtccagcatccaaaggaaggtcacggcagaaagaacctctaaaagaaaaccaaaagaacagccaaaaactgggaagacagactcagagaagtgtgatcagggaattcaggagcaaagagcatttcaacggataatgatcaataccaacgagtacttcagagacatcaagaagggctgaaaagggacaagtgaatgtaactcctgtaaattgtagaattatagtgtattacagagaatgatatttgaggagctgaggtcaatgaggttggatatttctttcaagaggaatggaagaatttgtgccaagggatgacttaccaggctttgtctgagctcatctctgcttggagaccatgaattgggtgttggcacataggtatgtggattttcagttcaatgcagggccagaaagtaggatcaccaaacttattgatgattgaagttttgctagcagggagtgtcacaaaaggcaactgggcagtggaatttgagtgattagcaacagaaggactgaagtggcagatggtggtgggggatgaggaaggaagagagctggtggcttgtgatgatgaactggagattcaaacaagattgcagcaaaggtgttggaaggctggggcagagtggaagtgtttatattccagaggttgaatcattccaggtattcccaggtgcatggcatgcctgctggatgatgaatggaaggcaagttcctggcgttggagaggtcatggaattgggaagccagagtgttcagctggtgccttcatatgactgtgcaccagcaaagatgccatgcacggctgtcctgtgattcctagggctgattatctttattcactttcatggtggaggtttatagccaggcagagagaggggatgcataatggtttacttgcataatggtttactttgtaaggaggaatgtagaaccattatggactgctcattcattaactgagcttccaatattatcaaacactcaaaattgaggcttgaaaattatttcaatcgttggttacctgccaacgtttcaggtttttaacaggtttcagggagtcagggaggtggtccatgcacactaagaaagctggcttccctctgtccagcacagacccatctgttagctcaatggcattaaggcagtattaagagctaactgctgagactatacaactagttatctcttcatagctgtggcacacatcccagtgggatgtgatgtgcagggggatgcacttggagcaataagaaatagaacgtggaagcattttgtcttaaaactcttaagaaaagcaaatgtatcccctagtctctctctcatctgcttccgcagcaatggttggatgtggtatgaattcttaaatgtgtttttaattttcattttgttttaaacatgcgcttcatagagttcaaataaagataaataaatagagcatagagccatgtgacactggctccagactagacagcatgatggaacagagcaggaagcccagaaaaagaatttcatgtaaaatgtaaatgtaaaggtgacccttcaaggcagatggctaagaatggattatacaataattgtgatggtatgattaaacttttaggagagcgattgtagttaattcactactgtctggcattgtggtgctttgcatgtgcttaaatggtataataatggtgttgtgttgatggtgatggtgatggtggtgatgctgatgatggtgatgatgatgatgatggtcatgatagtgataatgttgatgatgatatgatgggtatgatgatggcgatgctgatgatggtggtaattatgatgatagtgatgatggtggtgaagatggtgataatgatgaaaataatgaagatgaagaggaggaagcagggggacgttgtgatgctcaaaataaagaagtcaattttacaagaagtatagaagattaaagtaagttgcccaaagtcatggagatggcatatgatggctaggattttaatcttgtctgtcttacatactatgctattcttgctgttcctcatatatttaaataaattccccatgcagattgtgtttggaaaatggaagtactgaagaattccaaaaaatatattgagatatatttatctgatatacaggataattgagaaaggtctttctgagcacaaaagccaagaaataactaactcaaagagaaagattgcagaattttacttcatgaaatctaaaatctcctgatgtcaggtaaaaatataacataaactgaacaaaaagaccaatgacaaaagacttaaaaagcatgtgcatcatcaacataaaaagaaaactcctgagatataggaagagctcatacaaagcaaatgatagaaagataaatatcagaaaaagacattgattataccaatttattgtatcagttcattacacatgttctagcattgggcattatgattttaaaaaattaaatgtttgctaaaataactgaaagagatcagctctttttaaaaattacacataccacattatactgattcctgaataggtcagacttttttcttgtatttttaaaaaaataattaaactacaaaaaaaatctgttgccatttatccagtggagtcagaatctttccttaatccccaatgcttataggaggacctgatgaaatctatggccactgaatcccttatgagtctgccgctgataccatattactgttgtttcagcttacgaggcatattttaaatattcagccaacacctctcatttatgaatcccaaggcatctatgacacaatgattaaaactcaagtgaagcaacaaattgggctttattttcacactgatgtttttcttcattggaaatcccctttaggaaatgtctttcaaaaggctttaggttatctgtgtgtgtgtgtatgtatgtgtgtgtttacacatgatattttacattaaatttatctcccactcatcctaaatcacactttttaaaaaatgagtctgtgaaatctacttattttaataatgctaatgtaatgttaattccccaaagtggaaactgcagttaaaaaaaaaggaaatccattggtttattcagactgtcaactcttggtatatgcttgcagtcatagctgagctctggatcagatgaaatatgacctctgatcgtgtcattgcacacccgtattgctgagattgctgtgataatcatgaaattgcagatagacagtatcttctcagggacttttgacaggggctggtattaagcctctgctgcctaatgaaccaattttttattcaagcagatctagacaggagagaaatgaaatcatttccattacagaccactgtttacctgaatgcaacatgcataatgaggttttgaaacttcaggaaaacatctaggaggtgatgacaacctctacattgcaaaggaatgactaatacaaacccacttatgcgtgattctctttccacgattgccaaacgtatttaataaagagacagtttaaaaaccgccagttacatgcttgactgtaaagatatatagtacactttaggatatgtgctgttttgctgtttgggagtgttttgtatatactttttaaaatacaaggctttctcaaataggatagaccatttgttactggaatataattttatctagggttcttactccttttcattactgcaggaagaaaatgaatttttggtaaattgaaataaaatcacatatgtcaacattttctattgattgtcactttcagaattgtgtgtttgggaagcctttgtgagtgacaaggcgtggaatggaggagacagtagctatgagatgctcgctgactgtcccagagtttatgcttttcttgtgccttcctacgatgtctggacagctttctcttcatgcagaggcttaggatgaagtcactgagagctaaggtctatgatttaatgtagttcaagagcagagttctgggggtgagtgtgagatagcatgtcacataccactttgcaacagaaaaaaaaatttaaattgttgcctcagtcttctgtgtttttttagtgttttccacactttgtataaatgtttttctgattaccaaagtaatccgcagtatgcaaaaccgaagaatatagacacaaacagtacagaaagggaatgacccatgaaatctcacccctaaataggcagcatcattaatagtttgctggatagatttatttcttatatgttgccagtatgacatattaatatcaagatttgactattaagaatattttacacaaactctatatgctattctgcagttttttcttttcgctcaactatctatttggtcatttttccatttcaccatttcgattttcattttacctttcttagactacaatttgtttaatcattcctctgtgagggacatctgagttccttttttaaaatttttttattttttattttatttatttatttatttatttgtatttcaggtagtgctataagtgaatattctgtaaagctgtgtgaactggtgggaataattttgaaataaaaattcagccgagatcaaatttgctggatcaaagagcataaaaaatttgctttcatttgatattgcctaaaataggtatactctttttttcaccatgatagtaggatacccattgataatcaatgagaacgctaatttcctcatactcttagcaaccctggatattatcagtctctttttcatctatcgggtgaaaaatgctagttcactatttttttttctattgtgtgtagggttagtacagtgttgtatttcttctcccaaggattctttggtcacttttctattggattgtagatctttttcttattgatttgtttgcactatctatatgataagaacattaatattttacttattgtacactgcaaatatttttcctgccttttttttttgtcttttcattctatttaaagagtcttttgcaataaatttttgtagttaaaccttcatgatgtctggggcttgtaattggaagattttttttttttaaagcttttcttactcccctacaaattacaggttgagtatccaaaatactcaaatattcatccaaaatactcaggaccagaagtgtttcagatttggaatgctttcagatttgggaatatttatattatactcaccagctcagcatccctaatccaaaaatctgaaactcaaaatgctccaatgagcatttcctttgtgtgagcatcatgttgacactcaaaaagttcaggacttaggagcatctcagatttcagattttcagatgtagaatactcaacctatatgtatacaccctttcccttgtattttcacccaatatgtatatggcttcatgctttacagttagatatttcatctgtggaggaaattctgtacgtgtgtgtgtgtgtgtgtgtgtgtgtgtgtgtgtgtgtgtgtgtctgtgatggaccatgtgttatttgcctattcttgtgaatttgggtcttgattgatcagtactcttggctggtgtgggacctcttaaaacttgggtaggacaagtgttggtggcccagtgttatactttgtcttcaggtggtaggaatccagttaggatcttttctgcaagggctatgcagagggtcaccataatgaaaccactggaagccaggtggctgtagcccagtagtctcttcccatgaggtccagcattggctgattcatctagctagatccacccttgagtgggcagcaataattagttcaaacctacactgtcactgcaggagattgggagtgaagccaagctccccttgcaagtacatgaggtcctcatggtggtcgtggcatccaccagccaaatgagttaggaccacaaggagggcttcaactgctagagctgtcaagagcaacctatggtttctgggagctgctgatggcttctaacagcctcacttttggactggcttctgtagccaccatttctgggtggggttttaggaggaggtgagggtcatcaggtggttgggcttcccttggtcccatggggcagcaacagtgatttgcaacccatgtgagcaggcaggggcaaggttagggctgggaaagtagtttgcacacaggggagggtgggatggtttggtgactgtaccctccaagagctattttcctcaggtgctaccattcccacttggatgaggagcacaaagccttgaaatcaagtgaaggaggggcttttctcaattgcctccaaagggagcctcctgctttgctcccacatgtcttccccaagcagtgaggagggagcagctggctggtgctactgtgcatccttccctgacctgtgggtccttacctgtggaatctcatctgtatccaggtgtacagccatgtcccccactcagattcctatgatggtcatgaatccaggaatatgtcttttttttccttaagagatgaggtctcgttttgtcacctaggctggagtgcagtggcgtgatctcggctcactgcagcttcaagcaatcttcctgcctcagccccccaagtagcagggactataagcatgtgccaccatgcccagctaatttttgtatgtgtgtatgtattttgtagagacagggttttactatgttgcccgggctggtcttgaactcctgagctcagtcagttcacccacctcagcctcccaaaatgttgggattacagacagaatatgtttcttctagagtagttatgtcacttttgcaaagggagctaggaaaaagaaggaggcagaaattggtctatgttctccttgtttctggaatcttatgaaaccagtgctcaagctgtttagatttctgcatttagaaaagagggaagagaaatacaactcatgagatcatttgaagagaagacatttctatcccatgaatgaatgcatacttaattgaaagcagacagttcttgatctgagccctttctttggcatcatgggaccattttcaaaaaccaaaaggcccttaatggtactggcagcattaaattgggggttcagtgctgtgttgccatctcttctccttgctcttcttgtgttcactgtcacattagactgtgtcctgttgtcacgctgccgctgtcatctgctccactgataatattaatactactactaataaagttactcgttcttctctcactatatacttactgtctgccaggtgttatgcattcatagtagttctcatggcagccttctgcgaatggaactgtattatcccattttaaagatgtgtaaaccaaggtgcattggaaggcagtaactagtctcagcaagctcacaaaatcagcagattgcagaggcaacattcagagccatgtgtatatggttccgccccacacagtgtatactgggacgatgatatcataccacttctggcttcagcatattgatggcagcagcggtgccaagaaaggacagactttgtgaccagattgcatgtgattctatcccccactgaccaacctctggcggttaaatgtgggcaggtgacctctctcactgagcccccacttctttctctgtaaaatgagatcatttcattgcctttcttgctggggatgttttgaagagtgccttcggtgtattaagcactgggcaaacattcactattgttaggaagccttcacacagagcttttgttgcatcacagcgtcagttgattctcttttctgtgcatcttgactttgccgtctctcctccaagtatattttattttgctttttggtaggaaaggggagcaaatggccatagctctcttagggcacaatttcgtgtgttcgagtcttgtgacctttcgttggtttggtatctcaccatgagaaaaatggagtaaatgaaatatttccataactttgtcatctgagatcatgtgagcacgcctctctgcctgcaatctgaagagtcacttctccaacaagcctcgtggagtagaaattcaggattgctcacagagtctgctgggagctaactgtctgtcttagggtgatttctgggctcacccacttggactgcatctctcaacatggcatgcagcgcccgtggtttgggggcaacagtggcttaatgctttcttggggaggtaaacacttaggaaggaaagtttctttacaacaggattctgtaagtcattttatttgctctcaagaagtagaaaaaagagaaggttataacatagcatatactttcgtatattactccttctcagtgcaaaatggatcttgttcattgggtaccccagataccactgaagcaaaaaaattaaaacagaacaaacctctgctgtttctggcgttaccttagtgcctgccatacttaacacaaaatttcatttatttaaggtcactcacagtgagtgtaccctgactaatttagctcatcaattacttaaattttaaaacaaatactgatgctcacctaaatgaactccatttagtcagtcacggcaaaatctaactgttgcacctattcacacttccagtttgtagaaaattgttagtgaaagaacattgttgtcataattttttttttattctaaggtaagacaatagccagaacaaaacaaaaatgacaaaattacagcattttaagtcttttaactttaatcacttgaaggtggaattacctgtcaaatacctgtgccgacaatagctatttcttgtctgccaagtttcatcagtaacaaccatctataaatgcttttatgcatccgatttgttgcaagtaaatataccatactttaggaagaaaaaaacctagagaaaacaagcttctttgacaatctttgaagctttgagcgctgactttgagaaaaacgattttgttttgtttacacaacttgacattttggttttgcgtagtgctgccttgcaattaagcataggaaggagagacgtgaaatgacattacaatttatttggaaacagagagaattgccatacttacagatagagtagatgcttctgtgttactatttctttgtaactttatccttgcagaacttcccgagagggtgtcccagcatggggatgcatctgtacaaaacacagctcttgtagacaggagtgggtcttgctcagatatcgttggccaagaagggcttcagtctattcagtttgggagatggaaagggagtctttgtacagaacagtatacactgagttataacatccacaagtggtgttactgcctggatccacatcatagaatatacatccacattcatatggatttgcataaaagcatgcagcgaactacacataatatgtagcatatttccttccaccatgtctcacccaaagccagtaaatcctttagctactcatggctctgcagatggcttctgcttggtttggtccatagtcttgtcgttccttaccatgttctgcattgcatgccatgtgctttgatccactgcatgccatatgccaagttgaccattcacagaatagtcatttcctggaggaaggtctttattctaatgaaattgctcagtccctctgcttgcaattgcatcagagtcctgcttgaagcatttcttaatttaagagtattccaaagaatacttttctcactttgccactgaaccagtctagttaggactgaagatggaggtcactgggcaaggtcatcctttcagtgcatgcttcctgacttcaaactatattacaaggctacagtaaccaaaacagcatggtactggtaccacactgtctcaatgccagttgcctgatatttggcattggcttctctttgtgcttttaaagcaagagtgggtagggtggcagggcttgcctctgttttgggagggagaagaatgactttctaggtgactgctgtctaaacactagttcaatgcaacaagcctcattggctctcagttgccatctctacttccgggttagacttctgtgcccttgggcagcctcctggagtgtgatagttgaactattcatgcccctgaacatgagccccacaaaaatgtttattggacttctttacttggtactttttaaagagttgaggaatggaacttctacataaagccagtatcaactgaagtatgattaaagacaaggccggaacactagggacataaagatgagaaactcttcattgcctctcctcgactatctggtatgagtggcagtgctggagttattttccactgaattcctcaatgattctttttgtgacccatttgcccactaatttgatattccccatatgtgctgtagtcagaatatagcatgctttcaatggcattaatgttaaatcctttgctcttgcaggtgaatccacatcttcgaaaatggcatttttttttcttccatcatcctattcttgattttaaatgtatgcctcagttacacccatatggaaagctcaaagtaaaccagggtatcagaaaacccagtgataacagtgcagcaagaatgaaggatatgtagatattgtgtatgtttttcttctctctccactttctatttgagtttccagtaaatctgcatttgtgacaaaatagtaaactttgcagaaagaggtttttgcaacctcagattacagatggaaacagtacatagcaggaaaaatagcagaagggttagcttgagaccaggtgtttgaggctacaatgagctatgattgcaccactgcactccagcctgggcaacaaagtaagaccccatctctaaaataaatttaaaaaaaataaaatttgagagagatggggtaagggcattatggccagaccaaggtaggcctggagagccaaaaaaaacttttaactgtaatacatagttgaaaatccattgtatagagtattgattttggtcctctacattaatttagcttataaatcattaatctctgagtcttatcaagtctataatgatgttaccatgtttaaacatctgcaaacctaatttcaggttcttgagcctgaaactaatattatcttacctggaatttgtatctcaaattaaaattaatagtgtttaatgttgtcttataaattatttctatcgtttccatggtatcttccatttattatggtatcttccaagaagataccataagaaattatcaaagaatcaagttatcaattatcatgaccacgctaaaatggtcatgatggaatgaccattaaaagaccatttggctagttaattcagatgggattaataaaagtacatgagagcatctgaatactatcaataattagcagcaacacaattgcaccacaataataataaacatttaagacttacaatagctaaaatgcaaaagcatttagtctattttagtcacatctctaagcacaatcttagtcatgcgtctaaacatggattacttaatgtaatccctacaactatgctacaagatacttttatcatcacctctggtttaaaggcaacaaagcaaaatttggttaggttgagcaacttgtgtcaggattgcccaacagccactacactatagagcttcttggctgcatgagaagagttctggattgtgaattgaattcagacagtagacctacctggttgctggggagagtctcctgctctggagctgcaggttgtgtataagacaagtctgtttggaccaatggcctctgacagttttcttctcactcctgtattctagtattccatcaagtcctgagttcttgagtttgcctcagatactataaagatatctgggttcaaagttaaacaagggatgtggaggacagtagaagctatgggtactacaagggtgttttgggtaatgctttttctgccatctaaccattccaagcacatttaattttgctaattaagtctttcaaggcatagaaaggaacgacattagaatccatgagtttgagttaaagctgtgttctaaataatactccactgaataccaatgtgtatatttgaaaagtgaggtcaaaattaggggtcagaactagagttgaatacctgttgctttaaagtcatggcccaattatagctcagtcaaaaaaatctagtggaacattcctcctccatgaatttattcagcctgcttgaaataattgaattaattaattggattaaatgaagtaatatatttagagtagtgagcatagtgcctggcttgcaagacaggctcaataaatggtaactgctatcattattattatcattattgttatgattactcttctttccacagatgtgtaaagcatctttgcttaaaatgtgcctatacctccattacattgagtagaaaaatcatagatgagaaaacgtctataatggaaaactaagcagatatttgcatcatcttatcttttttattactagctcaccttatatttaaggtatctctggtaggacccacggtccctagaagggcccaccaatagcattggtattaaggatcttggggaaagatctgcttctctcgactaacactgcaagtccccacataaagcaaacagatcatcctggagttaggaggatattgcaaagaagctgtgactggcaaactgaaggttgcatggattaaggaggttgcaaaacataaaagatgagtttaccaaggcattaatcaatctgtccatgttttaattcaagtggaaagaaaggcttggacctgtgactgatgtacaaggtgtcagcaaaggaaaacatcattttcaattttgtatcttcagctttagagatggtaaaatccaatgcaaagacctagttgtagcatgaacgtgagtctcgatggtgtggtagagcatcataaatatgaagaattctgaagggctttgtttcccagtccattgttcatagcctctggccattctcgactcacagtcctccctcccttgtggctcagtctggaggtttaaggttgcacctccagttggatattgctggagaagttctggctgatctgtgtccagagctttgcattgacttctgtcatagaaatgatgcaatgagcatctgtgcaacctcctactccatggcacaggctgggttacctcccagggcaagttcagctgatggccataccaaacagcaaatggctgtacccgattacccaatctctatctttgcaagaagagaaagtccaggaaatacaatggcattgctggatcaagaattgaaagacagtgtgctcactttgaactctgctctttcaaaacatgtcctgctagtctgaatgcccatggctcagggaaaccactctattgtgatgtcgataaccctatggaaacgatgtccaaagtggcttcccttgagctacaggcatgctgactttgggtcttctcccagacaccggaaggagtatagttccacagaacaggtacaatgactttgttcttccccgcaccttttcccatctatgcaggaaaacactggtgtgccccatgaacgtgagaacaagttggagttatttaaattatttccagcaaatgcaacaccctggaaaacacacaagttattgttaatccaagaaaatagtggagtagatccgtgaaggcatcccagatggtgagagcagatgcaagtgcaggagggtaaatcacacattacgactgccattagggcaaagatgggtttaatggaggaaatcacaacattatcacaacaaccaggtacaacacaatataagaattaattaccaggggacaatatgaactcaggaacaaaccaaagagggaaacccagtcaagtgaagacagggttatctgtagaatggcgacattgcactcttacagttttccatgttttaagtaccctaataattccgattatatgcatagtatgattatttactatgtttgaaagttatgtgtcaaattgtctgaaactagccaagtctcattatgagcattgttactgagaactgtgaaattccagccatctctttttatatgtcaacattgattaagcatttagtcgcaggtaacctttcctctcaaagtgtggttcttgggcaggtaccatcagcattatgtaagagcttttttttttttttttagaaattctcagatccccactctaggtttactgaatcagaaccttcattttagcatggtcatgaattagccaattgaaattcaagaaacattggtatataaggtgactatactatgaaacctatatgctaagtacaaggtcttgtgtgttagtttggttcagccagcagaattctttaaaaaattgtttaagttaatctaatcagtttccgaatatcacatttgcttacttttccatagttatttaaaaaacgattagggatgtcttcttaacatgttttgaatgaaatttttatgttaacttatgacatgtgaaagtgagtaaattaataaaaagcatgatgatacacaaattaatgcatgtagtgactagttgaatgggaagatcttgcattgggtacgtccacccatcaccgtcgaagagaaatttatcctctaatccaagaacttcagagaggatgattctccatcatctatttgaggcagacaaatttgcatttattaacataaactgcccatggcagaagtttgagccccttgtctcttgctcagtcattaggggagataggagccactcttctcttgttattcaggaagtagatacagtatgtgctggagttcaccatctgcctcccagttccttagttcctgcaactctcctgcaagagtttcatttccagtgccctccttagaccttgctgtccacttggcatttgactgattgaatcccagatgaccttttatgcaggagttgcattagatccatgttgagtacagcaaagcacaacttctcctatttaactattatgccattttgcattcttctcttgaaaaaaaagggaaaagccatacaaacaccaatattccctgcagttacattgagtaggtaggaaagacttccttaataaaccccccaaaagacagcacatcacttttgtatctcaaccaacatacaaaatgcagattatcaactttatgcctttttattttggtcctatactatttttcttttatgtgtaaacttttagatttgattttatactgtagataaatcatatgctttccaatgtctgatctgaagggtcccttgagctccatatggatggaggagatcaggactaaagttttggaaatcttgaccatttatttcaggaagaagtactagattgaattcacctatatgaaatggacattgtatcaaactggagatgatacacctatttgtgcagtgacagatataccctgatgtatgggacattggtgttacttctaatcctaacaaagaattccctttctgggactagtgacagcagaatatctctgtgccactccacaatggttcaggagagcatgagaataacgctccaaaggccacatccctgaagtaacacctagcattttatatggccagcagagagtcgtagccacccccaggtggtacaattattgcaactcttatctatcttaaaattctagctttagctgaaatactggagtctcgccatctctgttggtcagatgtaggagtaacttgctcaccagcatagcttcagggagactttagggtaccattgtgccctggagttacactgagtaagtgaagaggctttcttaattattaacagtgggtgcctgtttaaggggatatctacctatctatctagcatatgtgatataaaaataaaacacctatgttttatattatatattaatattatataaaataattatatatttatatatatataaatatattttatttatatatttatatataaataaatatatttatttatatataaattattttataataattatgttatatgtatataacatatataagtatatatttatataattataatttctatataaattgtataattaaaatttatatataaagtatataaatatataaatatataattatataaaatatataaattttatataattatatataattataaaatttataattataaattatatgtaagtatataaatataaataacatgataataaatatataattatattaattaaatttagaaatattataaaacataatttacatgtatacttacaaaattataacattctatataaatttatataatatacgtataaaatatataattttatatatgtgtatataaaaatatatacacatatataatataaaacatatatacatatatgtgtgtgtgttatatataatataaaacatatctatgttatatttaatgagcctaatgcttccaaaagtataactttcatatatatatagtgacttcatagcactttgctccagtattctgtctgagtgtacctaccttgtagaagaaaaggcaaagcgaaatgaactaaaatgacaaggatttggtgaggcaagctgaggttctaactccattgtaaagttaaggaacagtgagcactccctgtacggccagtccaggatgaagtgttttgggtggaattcctcattcttccacagcaaccccctactattatccattatcacctctgacttagtggcagaggatcccagtgagaagccagagacttgggtttcaaaccaactcgcttaagtcaggacctagaagcaagaactttagcacttagtcctatgctgtggcacctcactcacctaagacctcgaattctgctttcatgtttgaaacccttctctctctgcactttgtagctcagtgcctgactcttaatagtagcttagtgcttgtttgtgggctaaataaatggaatgacagaactttctagaatttaggcttcctctgcaacccacatccacacttgacagaggaaggagccagatttttgcatttccaaggtttcttctttgggactgcaaaaggtctggttaggaagccctcacattgataagcttgttcttgttatctccagttaaataacaaagtgctcttgaaatggcttattttctatatttgtttccttcagaaaacaaaggcagaaagctttggagatagaacatttcatttacaagctataatgcagctcaccatcggcaattcaaaactatcactctatataaatcagtgtcattatatcttgagaaccttcctgagaaataatatttgcagacctctaatttataatagattgctctgaaagcaaaaataatacagcagcatttgttctcatgggagatttctgttcacagtgtttaggagggaaacatgttagacctttgtaggatcaatgttataaaaaattaaatgtcgaatgggctctgggatttacaaatgagattctggcttaagacctgagtagtatgggatccagactgtatcttttgggaaagaatgggctaaaaggaaattagaaatctgaccatttctcaggaagttgagctaaatattctaccatgcatacgtgcatggcagcctcagctactttctcttgtactaatcccagcccagttgtatagggcactttaatgaaagtgatcactctaggcaatgaagaagaaacttgatgaggacatgttaaatatcatggtcatttgaaatattggaatttggaggagatatccagggataagcattaagatggggaaggatgcaggatatttcagttgagagaatctgcataataaatgcagctgtaaatttgtctggagttaaaaataggcaagaggagaagctgtaagtaggatgtagctggccttggctttggggataagagctgtccctgaaaaactctgtgacaccccagcctttagcacacagcccgtgtaaggtgggcacttcataaacccatgttgaatgaatgcatgaggaagtctaggagtcaaaactgcatttgaaaggcatttaaaaaattaacagaaggaggctgaggcaaggggattgcctgagcccaagagtttgagaccagcccgggcaacaaactgagacccaatctctacaacgaatacaaaaaaaaaatagccaggcatggtgatactcacctgtagtcccagctacttaggaggctgaggtgggaggatcacttcagcccaagaagtagaggttgcagtgagccatgattgtgacactgcacttcagcctgggagacagagtaagaccctgtctcaaaaacaacaaaaataatagactatttttgagcagttttacatttacataaaaactgaacagaaagtaaagagtgttcatacactctcccctgcacatagtttccttattatatatattatgtattcatgtggtatatttgttacaattgagccaacattgataagctgtgattaactgaagtccatagtttccattagggttcactcttcgtgttgtatgttctgtgggtttggacaaaggtataatggcatggatccacaattacaggatcatacacagtagtttcactgcccccaaaatcctctgtgttccgcctcctcatccctcctttctcccaagcccacggtaatgactgatctgtttaaggtctctatagctttgcctttcccagaatgtcccatagctgggatcatacagtatgtagccttttcagattgactcctttcacttagaaatatcttaagatccttccatgcttttcatggctttatagctcatttctttttagctctgaaataatctttcattgtctggatgtaccacagtttatttatccattcaactgctgaagggcagtttcattgcatccaaggttttgacgattataaatagacatggtataaatatttgtgtgtgggtttttgtgtgcacatgaattattatgggagacacatttttataggaaatttctttgcagcattttctttgtgcagatacttctacatatagaaagatgaattttgtttcaaaggagggtgtatggtcatatgccctttactaaatactaactacaatacacggaagcaaattcctaagtcctctgctacctgcctaatctgtgttattttacacagaggttgttgtatgagcaaaagggggcatttttctttcaaagtataaacgggggttatagcgccttattgtttccttctatttcaactcattaagctaattaccattttcaaagtaattaggcttaaattagtgtctcagccaaacaaccccaagcccgagagcacaggtggtttgcttagctgcaccagataacaccataataaatgtctgcctgatcatgatttatcatgggagacaaattgctaaaatggccctcgggtgtcttattttttggttctgagtatgacatttacatatatggtgtgggttctgggaatgtttatcatttgagttaaaaattgagaaacattgaacatactctagcccgtggcacttgcaatcaaatagcaaaaatatgccttgccacaaatgacttggttgttgcttttgcatcagaaatcatctctgccacctccatgggcatctcactctgcagtccttctccttccccttttcgggaccaagtgggtgtgagtgcaacctggagcgaagggtctggcactgcagggtgtgatctacctgctggataggatgtattccaaatcctatatttaattatttcgactgcagaggatgcctgcggccattgtagaatatcagttgttgtggacatcctagtgtgactaagagcccacccaaaatttgattcccatgtctagaccagtgacagcatgcacacactaagaggatatgaaaaggcttattactcatataatgtggctttctgaggagagcaggtgatatggtttggctgtgtccccacccaaatctcatcttgaattgtagcacccataattcccacgtgttgtgggagggacccggtgggagataatggaatcatgggggagattttcccccatactgttctcatggtaataaataggtttcgcgagatctgatggttttatgcggggtttctgctttcgcttggctggctctctctcctgcctgctgccatgattgtgaggccttcccagccatgtgatactgtaagtcaattaaacctctttttataagttacccagtctcgggtgtgtctttattagcaacgtgagagcagactaatacagcaggttactaaaccagtacaaaaaatagcttgagagagctcggaaaagaaacggattctgctgttatggtgattagtacttggggctgggataagggtctcttgcatgcagacaggggcttgcatagttccaacctcccaccggcggtgaaggagggagcgcccaggatttcttatcagcctgcgtggcacgagcagaagagggagagatgaggcttaaaaactcttagcactcaaacattaagaaatggagtcaggctctaatataccagtcaaagcctagcagtatgcactgacttattaaattaaatcagcagcatatgactatgtagagccctgtggaaattgtacattgtctacctctagtttgcccatcattgtcttctgatttgagagctgagtgatagcttcctaatcagaaagtccatgtttcagctccttcttcaaacttcaactttcctctgtttttttcttgcagaaaattataagcatatgcagaaatgaaatagtacagttaaacctccatatgcccttcactcatatttaacagttattaactcctggctaatcttgttgaatctatatcccatactcatttattctcgccctgcattcttttgaataagacagcagctatcatgttcctcaccacctccatttcatctacgggtatttcaggatatatctctacaagattttttttctctggtgtactttttactcctctgattctcactgagtctatctattcacctgttcaggatttgagcattttgagttttcaatcagatttaattcttactttctgattcttccacttcttaagtatctgaacttgaacaaatcggccttttacagcattgttgctctacccataaaatgaagctagtgccatttactcatagggttcagtgtggtctaaacaagataatatgtaataaaattctctacatgtagacagtgctcaacagagggtagcaattattgttattattattgttgttgctattattttttgaggggttatctggaggtggtatacaatgttagttctggggaaagaaggtgaggtcaggaggaatgttgatatttgtgatggacggtttagacttggagaataactcccggttattcctctatcaatgaggaatattgatattcatgtgagggatagtttagatttgggtatctactgtaagtattaaaagagaatattctcataaaatatctatatacatatttgttcacataagaggaacatcactggtttagttttcccatccaataaagaaaaatgatagacttctttatagccttagagccaacaccagctggtgagaacaacctttcagcttctttcttctggcacctgcctccaagtggctctccatcaatgaacctggtacttttagaatactttctcaggtctccctgcagaatcacttcatgatacccagaggttcaaatggtgcttctaaatggcactcaagtcaatgaatcttggtgtctattctaagaagccagccacagccagtcttgattgcatcacgtctcatgctgggataaactccaatatgtaagaacgtttacttccaccttgagaaattagccacccactgagtagggcaaccatctccatttgctttatgaatatgcattatttttaaatggagtctttttcccctccagggcagatcttgaaccttctggatgagctgagattggctaatgataccctcatctacttcacatcggaccagggagcacatgtagaagaagtgtcttccaaaggagaaattcatggcggaagtaatgggatctataaaggtgagaaatgctgggatggagaagctctggcctctcagctcatccgctggtcacttttttcttgattttcgagcttttccatagttcttctgctactttgcaataggtaggacttccttgtgtcatggagacagtcagaaggccaaagtgaccatttctgttctggttcccacagaatttaaaagcccacatcttgtgtcaagacattagaatgagagtatgtatctccaaatgtaaatgcagcctcatataatgtaactgattaaaacaagaattcctctacacctatgtgtagatttcctgtcactactgtaacaaattgacacaaacttatgggcttaaaacaaatttatgaacttacagttctagaagtcagaagttcaagatggatatctcactggtctgaaattgagatgtctgtagggccttctacaagctcttggggggaatctgtttccttggctttttcagcttctggggacttcccactttccttggctcatggccccttcttccatgtggaaagctaacaattcactgtcttcaaacctccgtgtctgtgtccgacctgtgcttccataatctcatctccttcacttactctgacacccctgcctccctcttatgaggacacttgagattacgttcggcccacttggataatcccacatcatcttcccatctcaagatcatgaacttaatctgcaaagtgtcttttgccatggggtgtaacatattcacaggttacagggattaggacgagggcatctttgggagaccgttattctgcctacgtgaacccacaatagtattttgagctaacacttttcaaaaattttttttgcagcattagctgagccactttcatggtggattgggcatcatgctagtcattggagatatttgatgagacccagctactggcttgtatagtgtatgctctgccaatataagatagacatatatattgtctaatatatacatttagacatatcttatgtacttatacatagctaatatttaatgtctatatacattagacatatctaatgtctatcttatatgacagacattacatgacacacaacgtggcccatttcataaagtgatatgatacctaaaagggtgtatttgtgctaagggttaggactccccagccaaatctgcagtggatatgggttgaaggtacaagaagagatgacgccttaaccaaaaggggagggtgaatcacagtttacctgcaaagatatgaaaggatgatatagggaatgcttttatctatcaatttgtttagaaatattgattatcttctgtgtgtcttgcattgggccagacacaacagtaaatatataacatggtgtcttccctgaaggaagtcatgttgaactggtaggtgggtgggtagatgatgacgtgaagcctgggaagacccagtacaatttgacaagggcgctaacacttgcatgcacaagatactaatggcacaaggggaaagagagcctcacttggctgaggggttcccaggaatgtttgcaaaggagacacggctagaaaggaggtcaccagtgggtctgtgcctctgctttctttccccttctgtctctttctgctcttccaaccccttgctctcttttgtcatgctggaaagaaggagaagcagcaaatagcttgttctgcaaactgcaaggagctcagtaaggccagattacaccatacctgaggcaaagagaaatagtcctctgtagtctatccctgcagcataaggctgcaggtagcttatgaagccttatgcttctagttacgtctctgtgtgcacatctggagccctatgaccggctgagcacccatgggcaggaaccgtctcctacaccttttgttacctggcacctagcacaaaaagatgcctgttaggtgcatctggacaaccttcataggctgctcagacctcctcccagccccttcctttaggtctcattgttaccttgctcaatgcaggacacataatcaatatgtaatgtgggtttgattaatgaaccggtgtgtttaatctgaacaggattaaccccagtaggctatcactctttcagcccttctctgtgtgccatgttactttaaaagtagtaaaaagtggaaacatgtattcctaatatatgaagacttggtattaccgggctgaactggggtccactcacccagcgcagtaaggccaaacatccacaccgaggttttgcagtgggagaaaggagggtgtttatttgcagggttccaagcaagtagaatgaggcctctctcacttaagattccacttccccaatggtttgcaagcaaaggtttttaaagcctgggaggcagaggctacaggcaaagtcataagtctatacatggagattatacattggtttgacctaaaaaggcaggacatcccaaagaagggcgcccacaggttataggtggcttcaaagattccctgatttgcgattggtttaggaagtgaagctttgtctgaaaatttggggtcagcaaaaacaaacatgatatctggcctgtgggcgtggcttcctccaggccccttgggaagaaatttggaacaaagaatgtcagtcagagttcagtcctcagttcctctttacctggagcctaggtgccagcagatggcattttccatttggaaggggtccactttctgaaaaacaactatgggacatatgttaaagtgttatctgtagttattacagggaaccaaacattttatggctctaacttccttgtctattattttactctatgattaccttcttgcttatcagttgctcatttacttttcaaagctagctaggtgcctggaattttctttgaaggaactcaagatttttccttatttccctgcctgggggagtccagcaggcccctaagaggggtccctgctccatctcattggtgtttcagtcttattttcacaaggctataacctgtgtggatagagttgtttttatttcattttgtagatgccagtgtccctaaagactggagttccaggctgcattccacgctctagttcatccattcattcattctctctcttagtgcctgttcagttccaaaatagcttagcagctgccgaggaggagacgtgtacatcaatcacaattctagaagtggttggagagtaatagttacttaagaaagttacctatggaaggctatagagccccagggcagggagaggggacccctgactgacaatcccggggaagtttcatgggacagagaaggagctgcatcacgttttgcacagatagttcaccagggttcagagacacgagaggtatagatcagaaagggagcctcaatggtcttgaataatggttgggaaccccagttttatcatacaaccctgcaagcatgtcaggagctactccataaatttcttttttttttaaagaaatgtatttgatgtattagaaatgttttgcttgcatgctggagagaccatgaatgtgtaacatgattaatgtctcagccaccgctctattgcaaagtattatccttttgtcaacttatttgaaatcaagttcacagtgaaacactgttaaaatacaatgccctaaaaggaagatggggtttccttctagttatgggaagtaggcttctgagtgtcaagtgtcaagatatcttgttctctagagctgcaaactcgaacacatacctgtggtttacgcagacacagagaaatcataggatttaacaccctgtttaaaatagcatcctttctaaacaatgatgacttctactgtccatcaaaacccttcaaaggactttgctatttgaacttttttttttccttttgagagaatctcgctctgccacccaggctacagtgcagcggagccatctcggtatttgaacttaatgattctactgtattcccaagtcaaatctgtttccctggtgaaatctatgggcttcatcaatgacagagtggataaagaaaatgtggtatatatacaccatggaatactgtgaagccataaaaaagaatgagatcatgtcttttgtaacttggatggagctggaggctattatccttcgcaaactaataatgcaggaacagaaaatcaaataccacatgttctcacttataagtgagagctaaatgatgagaacttatgaacacataaaaggaaacaacagagactggggtctatttgagaggggagggtgggaggagggaaaggagcaggaaagatcactattgggtactaggcttaatacctgtgtgattaaataatttgtacaccaaacccccatgacatgagtttacctatgtaacaaaccaaccttcacgtgaatcctcaaacctaaaataagttaaacataaataaataaataaaataaaatataccagacttcttgttaaaaaaaaaatctatgggctaaatttggtagaatggctaggattaaatcatccttccattaaattcaataggttattccttttaataagaggtacattacatgtctgctgcagtctacatttaaaaaacaattatctaatattccaggggtgagggagtaataataggactgtttcatttctttaaggaaatgactttgcagtatgattattctgtttaggtttggatatgggtaaattttgtctttgtcaaaatgttctagcataaagggaaattgggaaataagggtagggtcaaatgtatactttggatataattctggtcaaagtttagaaatcttggcagtaagtcctttatacagtagttcctaaaatatttccctctgagacccttctaaaataaattttcttctattgtccacatgctttgaatgattgtgtcaacctaataaaaccaattttctaaggaataatttatcttcccatttaataattaagaaatcattatctccattagggcttccacttaatttgactgtgttccataccatgtgattatgattttcatagacagcaagataaataagtaaaccactgaacatcccatagcctgtgaccctttgtagctgttaaatgtaaaattttccatcagggctgttgacatttgaaaatgttcacattgcttctttgggaccttaggagtagaaaccattgcttgaaactaatagaggatttaagatttctatgcaatccttaactctttctaggaaatttagtttatggctctcaatttatgttcctacaccctggacaggtattggatctatttggatcagcctggtgggtgagtcttgagaagacgcttcattctgcacttgtatctgtgtcaaggcagtagaacagaaaggagttcaagctgagagtcctgcaaattgcagttctcttattgaaggagcaagtggccccacccctagcttcacttttctaaatcagggttcaaagcctttgagcctctctttgcatgaggagttgcaaacaaattcatggaagtttcttctcaaccttcactgcagctgcttctcacctgatccacctctcaatgttgaagacctccagggctctgtcctgggcccccttccctttatcttcacacttgccctatctgatgtcatccaaatccaggacgtcatatgacatccaactgcagggcatcccacatacagagccgggaccctgctgtggaggtccacattgctatgttcagctgcccacttgccacatgacctggaagctcagtaggcatgtcatctcggaaagatgcaagctagacatcaaatgcaagctagcccaagcccacacatgcccaaatctgcatgatcttattgaatgctttaccccgtgactgaacctcagtgctacgatatttgctggttgatgggcttgttttattttgcctctctttaacccctatgtatcccatattttggaatcacatcctattcactttattttctaagtttatctgacattggtcatcttttgtcagctgtatcaattttccatcttgtccaggccactgtggtctgccctttggacttctccagtgtgcttcttggtggtctccctaattctttgttctcacactccgttctctacccagacactggagtgagctttcgtaaacatagtgtcaatgtactctattgaatttctgaggactgacataactgttagcaccacaaactgggtgacttaaaaacagcagaaagttgttttctctcagttctgggggccaggagtctgaaagcaagctgctggaagtggtgggctccctacgaaacctctaggggagaatcctttgttgttctgccattaattcttaaccttccttgacttgtagatgtgtcactccaatctctgcctccaccttcacatggcttttttcctttcttcaaacactctaatatcaaccagccatggtggctcacacctgtaatcccagcactttgggaggctgagatgggaggatcacttgagctcaggagtcggagcccagcctgggcaacatagtgagaccttgtctctacaaaaaacatgtaaaaattagctggctgttgtgttgcacacctgtagtccaagctactgaggaggctagggtgggaggatcacttgagcccaggagtttgaatctgcagtgagctatgattgcaccactgcactccaggctggtcaacagagggagaccactgtctctacaaaaaaacagtttaaaaaacaaaattaaccaggggtggtggtacacatctggagtcctagctactcaggaggctgaggtaagaggatcgcttgagcccaggaagtcgaggctgcagtgagctatgattgcaccactacactccagcctgggcaacagagcaagaccctgtctcaaacaaacaaacaaacaaacagaacaaaaaaccactccaatatcttctcatccactgaaaatacaatgtgaagtctgcaccccagctgtacagttttctcctcctctcttcctggcttttcctgggtcccccaaccccttcatcttgttcccacctcagagtctttgtgttagaaactcatccttccatctcatctttggatggattttatctttcactcatatgttgcctttgtaaggtctccctggaccaccaaatcaaaagtccttgtctctcccaccactttattctaattgctcgcatctctgataacttacctgtttattattttatttgctcatagtccttctcccatggaagctggaatctgggctgcctcatttaccactgtgtcctagtgccttgagtaaccatggagtaggcattcaataagaacttactgaatgagtagggatatggtttggctgtgtccccatcaaaatctcatcttgaattgtagctcccataatccccacatgtcatgggaggcacctggtcagaggtaattgaatcatgggggcgggtctttcctgtgctgttctcgtgataatgaataagtctcatgagatctgatggttttataaagggcagttccccttcacacactctcttgcctgatgccatgtaagacatgcctttgcttctccctcacctcccgccatgattttgaggccccctagccatgtggaactgtgagtccattaaaacttgttctttataaattacctagtctcagatatttcttcatagaagtatgaaaatggactaatacaaatagtgaacacttctcagatttctcttccttctgtctccttctctccctatttcttccctttctcctaaaatatcccttagatgggaccagaataacttccttaagattttcttttagttgagtttagagttgtttgccttttcctcatactacaagatttccttattctcagaacagaacagttaaactcatatgtctggcttcatttccatccctctcccaagtcaaggtcaccctgaaggaggctcttcctccctccctttttctctgcctacaggcaagtaataaatgtcaatggaatggataaattaactctatagatggcttctgcagaagtgtgggggtgggggatcatattttccagagtgttcaagaatatatacttttttttcatgtgcagagaaatgcttttaaaattccctgatggctgcatggaaggcactgctcttcaggcattttttccttaccttaaggccaaattccaaacacgtggcttgagtccatgtcacttatgagttgcttcttacagtcactgattttgacatctcttcctgtcattcaataacacagctttctgagagcaattgatacttttattgtgagagaaaaatagtagcaactgactctggtagattattacaaggtagttatgttcaaatgatgttggcaaacattgtcattggcttcccaagagtaggcaaagctgcctcttcatgctagtgtcagtatttagtcctccagcaggtatccacagccttttaacctttgaaagatcacatcagtctcatttatgtgttcatgcatttggtttaattttactggcatgcatttatatattgattctatagaacatgccaggcacagggctagctgatagggtataaaggcaaagaataaagggtctccgactgctactaatttacattctactagaagctagtagcttaaattctactaaaagacagaatgcctctaaattctactagtttttaggatagatatataagagaccacttcagtgtaatgtactggtaagggaactgttaaagaatggtaaaggcagttagcccaacttgggaattcagagaaccttccaggaggagctgacattttgcaggttgacgttttgcattgttggctaggagaggacaggtgggaagtacacagtaggcaggtgtgaaatacttatggggagcgaaaaagcagctcagtatttctagggatgaaaatgtagctgggcgcagtggcttatacctgtaatttcatcactttgggaggccaaggcagaaggatcgcttgagcccaggagttcgagaccagtctgggcagcatagttagaccccatctctaaaaaacagatttaaaaattagtcagatgtgatggcatgtgcttgcagtccagctactccagaggcttgagatgggaggatcagtggagcctgggaggtggaggctgcagtgagacttgattgcaccactgcactccagcctgggtaacaaagtgagatcctgtctcaaaaaaaaagtgtgagcaaggactgacagtgtcaggtgatggagacttggtatcatgtccgggcattgagctctgccttgtgggttatctgagctgggagtagggaccagacagatgggttaacattagtgaacaccctgaaaatggaagggccatttggaatgattgggactgtccactttagcagaaaatgcaactgctggatcaccactgtctcaggcattgccgtaggcagagtgatttgattgcattggcttcagttgacaaaatgtatgaccttaatactacacagttaaatgtggcagagcttgcacctgttgttgaaaaagtcacatggacaggcaggagattgtgatcccgtaatgggaggcttgaatttctcacttttgagatgggcaagattgaagttgtgtggtcaagcgtgctctgcaggagagaaaggttgggattccgggacagcaaagaggtgggaaagtgagaaggatgtggccacggtgggtaactgggctctgtgagggcagggagtgggcatagctcatgcttatgggctcattttctttgatgacatgcagggagagtttctcttttgatagtcaaaggtcaagctgtttagtatatgactggtggagaaaattttaggaatgcaatgtattagggaaatgaaacatttagcaaaatagagaccagaagaggttagacataggaatttgtaatcacattcacctataggcttctgtttttttcccacagtaatacgcttcattgattaattcattatttcatttatttcacaaaatatattgagtaccatctatttggaagggatttcactattactttagttgatttaacagtgcattagacagtttgttctcaaatactgttgatactgttggaatgagacatgcatagaattggttgtcatatgtcccataaacttgaacttgaaaaatactgtggaaattgaaagttgaaaaataatatgtgatcatagaaggcttaatgaaatcggagaggcttgttatctaggcttttaaggagctttgtaaatgatttgggtgtgggggctgtattagtcagggttctctggaggaacaggactaataggatagatgtctatatgaaagggagtttattaggagaattgactcacacaatcacaaggtgaagtcccacaatgggctgtctgcaagctgaggagccagaaagccagtccgagttccaaaacctcaaaagtagggaagctgatgatagtgcagcctttggtctgtggtcgaaggtccgagagcccctggcaaatcactggtgtaagcccaggaatccaaaacctgaagaacttggagtctgatattcaaggacaggaagcatccagcatgggagaaagatgtaggctggaagactcagccagtctagtccttccacgttcttctgcctgctttatcctagctacatgggcagctgatgagatggtgcccacccagattgagggtgggtctgcctctcccagcccactgactcaaatgttaatctcttttggcaacaccttcacagacacagccaggaacaatactttacatccttcaatccaatcaagttgacactcaatattaaccatcccagggtcaaatcctagcagagcaaccatcaagagggagcagcagaactttccggagagcagaggatgagctgttgaccaggacattttcgtgggactcagctcaaccaaggtgtgatgttggaaaggtggaccccagtcaggacatggttagcttcgcattccagagtaagatgtattttttagtttttcattcttgcagacaatattaagtatgagttcaattaagtgacaagaaaaatgttagtagaagttgctgtgacacttccccccgatgctgaaggatttaatattatggagtaaggtccaagttggtgtgctcaccccaccccaaaaaatcaaaatttagtaaattagaacaggactggcctagctgtagcatgtgggcctaatgcaaaccagcccttgattttctaaataaagttttattgaaacccagctgtgctcatttgtggatgtctcattcctggctgcttcttaattacaacagcagagttgagtagttgagaaagccacccaaagagcctgaaatatttactacctggctctttagagaaaaagtttgccaacccttgacttagattccttagcagttggatgtattgcttgatgagtcattcttaatcatttgacctgtgtcaattaattttaaggatattcttcaattcttgacatgttatttaggaactgatatcaccaggttccttatttttgccttcataatagatgggtaatacgttggtggaacctgaaaaatattgttatatttcccatctgcaattcatgggttttagtctttggcatgaataaatcaaggagagtataaaatgtagcatcttgggtgagaaaacatttcccgtgaattatcatcacacacttcaacggggtttgcctcaattcagagaattagtgttatctcagatgggaagatttgaggagaaaaatgaaaaacaatatttcataaaactctgcccagatcaagcataagaatgactagcatatgctcttgccattaaaagtgatttgacctgctgtgtggtagcattcagaaggacaaaaatagaagcctggtttgcaaacagctgtttctaacaagagtctttgagtaaattgtagaagaatcctcgctacgcttgcctagagagattgagtaactcagccatcatccttctgtgatgagaacatcatcacaacatgccatcaagatgttaaaactgtgaattggacaattactctacaaaaagttaaacttagaccatggctttttctctgctcataaattttcagaaaaaatagttcatactccttcacctgtttttttttttctttcccccatatcccattctccaactttcctaagtttatttctccttcaaaacccaagtcaaaatctattggcacagggcaggtttgcccaggtaaaagacatttctttttattttggttggtgtttaatcagagttatctgtgggcatatcttttggtttgtttgtttgtttgtttgtttgtttgtttaaggcagcgtttcactttgtcacccaggctagggtgcagtggcgtgatcacagctcactatggcctcaacctcccaggcttacccaatcctcctgcctcagcctcccatgtagctgggactagaggcatgcaccaccatgcttggcttttttatttcttattttttgtagactgggtctcactgtgttgcccagcctggtctcaaaccccgacctcaagtgatcctcctacctcagtctcccaaagtgttgggattacaggtgtgagccactgtgcctggcctgtggatatatctgagctgtcttttgagacctttaatttctgtagggcaaggtccctcttcactgtgttctctctgggattctgttggcatacaatcagagttctcagtgggtattatctgagctatcttttgaggctgtgagtttctgtagggcgtaatctccattgtatatctttgtgtcccatttggggatgtgaaaatcagtaaagcctagcatttggcaggacaggttctagaactatacctaataccatcaattactggctgtgtaacctttgccaaagttttcttggctgtgaaatgggttacttgccttgcagagtcatggtgagaatcaagagttaataaagtcacgagtttgaatggtttggggaacatgtgaaactccatcattagtcctgatcatagcaagtcattgcttattaaatgtctgctgaatgaatgaagcatcccgtgtccaccctctgagttcctctaaactctgctcgatgataatgtgagtggtgcccgggagagcagatttcggtgctttttcagcctgacagacacatttggcgcatctcgctttccacacaatatcgcaggaggaaggagactcaaagctacaccatctgacaagcaagggcacttgctcatcaacacatgcctgcaaatgtgtgatcatgcttcctccaacatgtttttccataggcagtgtgtgctcggatgtgtttatcatctgttaaaaaaattttaaaacatttttttgccatgactgttgtaaaaactctccctttatagctttagaaaattgcacaagattatgtttatggatacatttctttaggacctgaatatagactcagaactattaatacaagatgggaatctcgtgatgttccacatagtgggttcagagcttccaacagagcgtttctcgggtgtgacaatttgttaacactagctgcagatgaaaccatgcctggtgctaccattcaggtggtcagtaggtggctagatctaggggctacaggcacagctgcccccatagtccagtgcctgcaatagaggtgctctgtgcatcttacctgagcaggggtaagctacttctttgcacccaagcagaagtattgccaccaggtggccatttgtggcttggagctcctttgggaatctggaatctctggcaggctgtgatatttccagggcctctgcaggagatttgttttattttgctttgttttcaaagtggttatacatcaagccatgttctcataagatgtctcttccatcacctggagttctgggatattagcaaattcctcagaggggaatagatcactggcacttgggttgtaaaatacacagacattggatgtgcctgtggatttttgtgaaactatgtgctttgttttctgttttttaagacatgacgtctctctctgtcacccaggctggagtgcagggacacaatcatagctcactgcagcctcaaactcccagtttcaagcagtcctcccccctgagtagctgggactacaggtgtgtgccaccacacctggctatttttttaattattattaatatttttttgtagagatggcatctcaccatggtgccaagactggtcttgaactcctggtctcaagcatctcacctgcctaggcctctcaaagtgctggaattacagacatgagccactgcacccagccactatctgctgtttaagggccatgtttttcagccactctgtcaagtggctctacagccaggtgcatcccttggcttcccctggtgagcccctagtaaaccatcctcagacattgcctttcaccctaaagatgatgtacagatcaactcctgggagggtacgaaattcgctcggtgcctcagtccttaattctactgttcacatgtatctttctgagtttctacatagggtgtagaaactaaatgtggtttacaaatatggtgtgatcctcttctttcaggacatagacaacttggcaccagtgctcttgctgcaaagataaagtgatattggagaactgtttaaattcacaggctttggagtcagtcagacaaacctggatttctatctgtaactctaccgcttactaaataagtgacagtcagcacataactgaagttctctcagcctcagattgtgcaactattttatatatatatatttttatatgtatatttatatatatattttatatatatgtatatatatttatatatatatttttatatatatatttatatatatttatatatatatttatatattatatatatttatatatatattttatatatattttatatatagttatatatattttttgtattttatataagtattattttatatatatttttattatatatttatatattttttattatatatattttattttatatatatataaaatattaaaatgttatgaatgagtttagattgatggagaattacaaaggtagtacagaggtatatttttcacccagctatctgcaatcttaccatcctacacaactatggtgtatttgtcaaaattaaccttcacatgttaccagctttcccattaatgccctttctctgtttcagaatcaatacacaatgccacgttacatctagaagattaacttttagagggtgctttttcctgatttaatagtttggtttttgttcctgtttatttatgctgttttatttaaaacaagggggcaatatgtgtatatctaaaccattaatgaaatcagcccttttttgttgtatagcgatcacttattttgttgttaaatttaaagtgaagatggtgtgagtttgatcgagtagcaggataagcaggtgaaaattttatgagtttgatggaacagaaggaaaactagacagtaattcacacgttgagattcctcccaaagatctgctttcaactgcttgaatgaactacggcaaagtagttaaacttcccatttgttggctgtgatgtctgtgaagcaggaatcacagtatctgtcagagaattaccttcaagtgatgttgaaaggataaaataaggggaagagttttaactttcttaggaggccatcacagaaactacaaagtatgatgtgaacttccataggaatctcccctaagtgactgtgcatatagaatgtctgaatatctgcaaaggtcagagcctgctgaggagactacagtcttcagctgtaagaaatgagcttttaactattcacaatagcaaagacatggagtcaaccaaaatacccatcaacagtggactagataaagaaaatgtggtacatacacaccatggaatactatgcagccataaaaaagaatgagatcctgtcctttgcagcaacatagatggagctggaggccactatcctaaaagaattaatgcacgaacctaaaaccaaattctgcatgttctcacttataagtgggagctaaacattgagtaaacatggacacaatgaagggaacaacagactctggggcctacttgagagtggagggaaagaggaggagggagaggattgaaaaactaaatatcaggtactatgctgattagctgtgtgatgagataatctgcacaccaaactcccaagccatgcagattacctatataacaaacctgcacatgtacccctgaacctaaaataaataaaagtaaatacataaacaaatacatacatagataaataatgtaacatctgaaaaacacactagagcagagtgcaataaaaggaggcattcctgtaaaggttagaaaaacaaagagaaagagatgagcttttaacaatggaaatttgcttcaggacccctgaaacctctgtttctagtaatttacttcctaaatataagtggcatttatttccagttgactcacacatgatattcctgcaaggaatgagcattttttcattggcttcgttctcacttaactgtctatttaatgcttcacaccaattgtttaaaacagcctcttttttgagtagctgaacttcaactccactccctttgtccccagcctaaattcctgacggctacttcagtgccccttagccctatgctgtctttgtcatgaagggtgaggaagcagtgtttattcccccagcgatgggtcacctgcccagctggagtgacctcagccctggcctgtctgagccctatactggagcacttggtctccatccctcaacgggaggtgttggtcatataggggccacaggaaaactgcccctttgccctctgaaggtttgctaaaaatcagctgacaaaggcaactgagaaaaggcacacaaatttattcacgtgcgtggagccttacaaaatagatctcaaagaaatggctggatggttgatgcttttacaccatcttgaggttacagaaagaatggggccttgcctcctggcaacacaggttaggagaggggagaagaggacgcctggctagcagaggtggtcttgttatgcagatgagacctcctgtgtagcagtccacagagagaagagatggtgaatgtttcttgcagacctttaaaggtatgtgtctctcagttcatctttcctggatcggacaacggaggccttcagagaaagcctggctgcctcaatgcagattctctctctctctctctttttcttttctgagacagatgctcactctgttacacaggctagagtgcactggtgagatcttggctcactgcaacctccacctcccgggttcaagcaattctcgtgcctcatcctcccaagtagctgggattataggcgtgcgccaccacgcctggctaatttttgtatttttagtagagacatgatttcaccatgttggccaggttggtcttcaactgctgacctcaggtgatccacccgtcttggcctcctaaagtgctgggattacaggtgtgagccattatgcccagccagattttctctatagattcaaacctcctctacaaaagacagttttgcagggctgcttctgtttgcagaccctgtgaacatccatctcaaaatatgtcaaagaagagtattttggggtgaaatattttggttccttcagtgaccatcttctgagattatctgctgacattctgatccactctgaactcacccttcctgcctctgccggtaccctttcgatgctgtatttaattatattctaattgcttcataggcaccaagcctgtttcctcaactctcctggttaagagccatcctggtaataaaataataccaacgaagataatagccattttttgtgcctctcttgcaggcactgagcttggcagttgggataatcattccatgtaataatcacgtggaaacatagtgggaatatgagatacagaaagctgaagctattttctcaagtgcaaagggctggtgtatctgtttcctatgtccgttgtaatcattgaccacaaatttagtggctcaaaacaacatgttttttttttttaatttttagattcagtgggtacgtgtgctggtgtgttacatgggtatattgcattatgctgaggtttggggttctaatgatcctgtcatccaagtagtgaacatagtacctgatagtttttcactccttgacctcctccctctttcccccctagtagttcccagtgtctactgttgccaactttatgtttatgagtactgaatgtttagctcccacttataagtaagaacatgcagtgtttgattttctgttcctgcattaattcacttaggataatggcctctagctataccatgttgctacaaaggacaatattttgttcttttttatggctgtgtagtattccatgatgtatatgtgccacattttctttatccaatccctgtcgatgggcacctggattaatttcatgtctgctattgtgaatagtgcagcaatgaacatacaggtaaaggtatctttttggtagaataatttattttcctttgggaataaccatgaattaaatgggtcctcaaggtgttggcagggctatgtttcttgctgaaagctctaggggagaatcttattccttgccttatccaacttctagagcctgcctgcattcctgggcttggggtgcccttctctgcctttaaagtcagcagcatagcatcttccagcctctctctgtgattacacccctccacttctctgactccctctttcccttgaaagaaccctgtctacaaaaagagtcagactctgtaaaacgtttgaagagattcattctgagccaagttgacacagccccgggagatcctaagaatatgtacctaagttgttctggctacagcttgatttatacattttagggagacatacagcattagtcaatatatgtaagatgtacattgttcagtctggaaaggtagcatgagtcaaaatcggggggtggggggtgaggaggcttcaggtcataggtggactcaaagaatttctgattggcagttggttgaaagagttgatttaaagacctgcagtcaatagaagggagtgtctgggttaaaataagggggttgtggaggccaaggttcttatgatgcagatgaaacctccacgtagcaggcttcagagagaacagattgtacgtgtttcttatcagactttaaaagataccagactcttggtcagttctctcccggatcagggagaagaccccaaaagagaaggagattgtctacagaatgtagattttctgcacaagagacagctttgtggggctattttgaaatatgtcaaataaatatattttggggtaaactacttcaatttctatcagggcctgctatctgtcgtgttggtatcttatggctacaaacagtctgttttgtcagtcttaaggtctgtgttttaatgctaatgctggtcagttgtacctgaattccaaaagaaggagggtaaaatgaggcatgtccaatcccctgtttccatcatggactgaactagtgtttcaggttaaacctttagaatgccctttgctgagaggaggtgtctattctgttagtcgaggggcttagaattttatttttggtttacaaccctatgattatattagatccactcagacaatgcagggtaatctcctcatctcaaaatccttagtcacatgtttaaagtcccttttgccatataaggcaaaatacccatttccccaggctccaggctccaggaatttggatgcggacacttgggggcaccattattttgcctgccacagctggtgtaaagtagaaatggaacttgaattccctgactccagagtcattgatttgaatctttggtgactcaaatctttgttgcgttgagtccctctgattacaaagtttttgttcaagatgccatacagtgctgaccatgtcacatatggtggtgactgtatcatatatattccttttttcaatacaacatatactatattgctcatggaatactcatagatggaatctatgtaattagagcagttggttcttctacattgagcacgaaagagtccattgaagtgagcattgaaaggattgaaatctccctgttgcctcttacctcttttttgatcttttaggaggaaaagcaaacaactgggaaggaggtatccgggttccaggcatccttcgttggcccagggtgatacaggctggccagaagattgatgagcccactagcaacatggacatatttcctacagtagccaagctggctggagctcccttgcctgaggacaggtactctgatgccagggtggttggtattgttgagctctgatttcacagcccagtatgctctggtttgcctgcataatggtgtggggaccaaggcctttggccccctggagttttcctgaaaatcacaggtttgaggcaggtcaattaataggataaaaggcatatacatttacttaatgtgtacacagcaggcttccaaaggaagacccaaagatacaggggaaattgttcatttttttgctgtggttcagcaaagtatgggcagtgtgtagaagtaggattggagggaaaggtctgacctcatgctaacggactgagtggggaaacccagccaggcctgtctatctagatgcttcttggcctctctgagcagttttccttccttctgggcatggggcagggccctctctggaacgggggtcttatgacctacagtcaaacaaagtaggtcagaggatttatttatgggcagtttttacacagaaaggcagggggaaagttggagtcatatttttaggtttgatgctggctttggggatcaggggttttggttcttacgacctgcattggggaagagggattctagtttctctggcgccttggggtagagtgggactgagagacaggagggcaggagaaagtcagaggaaaactgcactgaggccactgctgaggccctcggtttggagtgtcacgatgcctccagctgtacttgttatctctgtccggtctggggccttactggtgggtttgccaatgtaaaaacccctctgccaatctctttatccagagggaaataaactcagaggcactgaaggtttttagtgaccaggaatgtggacgggtggtgtttaattcagccttggtctttcggcatcgtgctgacgctcttctcgtctgttcaccccaccgtagcttgccattgtgcagcttggccacaacctctttgacctccaactttgggatcccacaccttttcctttgtccacactcagcagccctttgctgtaacagggagaaatgcagccgggtccccagctaaggccccatttcccagcacgtcttcactgagaagttctaaatgaaatgtctttctcttaaatttaaatacgacttcatatgacattgccagtggtttcttcctaagtgttattaccaatctgaagagttttaagtgaagcacactgattaattgttttcattagtttggtgacagaccaggcgaatgtcacgcaggcggctgcaaatcttgtttaaattcagctgtaatgagaaggaagaggaaaggggaaaggaaagacaaaaacagccacgctgccaaagcaagtccagagatgggtttcctcccctcccgctgtattcgaccttgtttccttactggtttcaactctgctttaggtatacacccttcctcaacacacacacagacacacacaccaatgagaaatgcagcgttgacagttcaactattctcaaactttgaggtctcaaaaccccttttcattcttccatgatcgaggaccccagtgatcttttcctgatgtggattgtattgagcgacgcttattatattagtaataaaaaatgaaattttttaaggcaccaaagtactccaagctcacattccattggctaatacatcgatgatgtcatcatttaccctgtggccacaaggaatgtccattgtacactcctaaaaaggtgatagtgagaaagacaaagagtgccttcctattgttataaaaataacattggcctcgcagacctcctgaaagggtcccagagagtctctggatcacgctttgagactagtgggtgctatggctaagagtggagattctagacctttctagacctgcactggttgaattcatattctttttttttttcttttttttttttgagatgggggtttcactctgtcacccaggctggagtgcagtggcgcgatctcagctcactgcaacctgcgactcccaagctcaagcgatcctcccaccccagcctcccgagtagttgggaccacaagcatgcaccaccacgcccagttaattttttgtatttttggtagtgacagggtttcaccatgttgccaaagctggtcttgaagtcttgagctcaagaaatcctcctgcctcgacctcccaaagtgctgggattacaggcttgagccactgagcccagctgagttcatattcttgtcatcactgcagggtaagcgttgaactttcctgggccttcactccttctctggaaaataagttcaataataacactgactttacaggatcaataggaggattaaaaacctccttgcctgtaatgttcagtacaaagaaggcatgaatgtttgccatttcttgttttgcctatcattttgaggtagtagtcagatgtacattattagtacagttctttcctcttccacatttaatattcatccgaggtcataaaatcatagagtatgaggccaaaaggggaattgtaagatctcctactccagtcaaactattcttttttaacactctagtgatggaaaacatggcagcagtgtctcagaaagtttttcctatataaagccaaaaatcccattctctatttcacctcctccttggctgtagttcttacctttggaataaaggttaatacttcctcaagtagctagaacagagtgttcagccaatctcatttattacgtttgtctctcatcacccataatgttaaaaccatcactgctcttcactttcataatatcttggaatggttttctacccagtgggggaaaagcaaggtaaggaaaaagttcagaggcaaagaggaagattcataaagggaaatcttactgcttctaccttctagccactctagtctgaggctgatggaggccaatctgtgtttcttctatgtgctcaatgaagaagataacagcctccctcttagaagacccaaggattttgtgtgtgggtttgtgtcatcagtagaaccaactctcaatattgaagattcccctctgtttctgattcctttcatggacctcagaggtgcttgctgacctcatttttttttttttttttgagcagagtcttgctcatttgcccaggctagagtgcagtggtgcaatctcggctcactgcaacctctgcctccacctcccaggctcaagcgattctcctgccttagcctcctgagtagctgggactacaggcgtgcaccaccatgcttggctaattttttgcattgttaatagagacggggtttcactatgttggccaggctggtctcaaactcctgacctcagctgatccgcctgcctcagcctctcaaagtgctgggaatacaggtgcgcaccatcacgcccagctaatttttgtatttttagtagagatggggtttcaccatgttggccaggctggtcttgaactcctgacctcaggtgatccacccacctcggcctcccagagtgttgggattacaggcatgagccacgacgcccggccagttgacctggttttaaaccacagatgttgcttctgtgttgaggtcctagctcctggtactagtccagctgtaaaatgcctttgtcatcctagagacagcacaggttagaaaacagaaatgtgcttccaagtgccttatgggaatagaattatcacacagtaccttatttaaagcatattgccaaccaggtacagtaatattcttatgtatttgtccagaagactttgaatatctaaagtagtgttttcccccaggggtcacttatcaatgcctggagacattttttattgtcttggctcagggtgctactaaacatcctgcaacacacagcacagagccctactgcaatgattatcttacccattatgtcagcggtgctgacgtcgagaaatcctaccctgaaatttattattgctcttttatggaaaatgttgttataatggaaaatcccatcaaaacttttcaataaaagcatctagacaataccctcacatctatatccatctataaatgtgatacacagatgtctgccctttagaaaatagtcttaactccttcctgctcagagtggtgcaaataagctttctcagctccctgctagagagatattaaatttgcatttctcaggagaagaaactcattcagacggttggacccaagctgtttgatgagcacttaacaaagtgcctttgcttctttctgcgttttgtttgaagaagataacttctgttcagcagacctccattcttcacgcactgtcctgtaattctcaggaagcattttggatctagtgggagtccttcatggccaatcaaagcatggtgggagatcagaagcccgtggatccaaggtttctacttaagccaaaagaaaggtagtccggaggaacacaggaaagattgttgttgttgttgttgttgttctgtttttgttttgcagcatcttaacactgcagtgagaataattctctaattcaaccctatgatgtgcttacgtgagatttctctctggcagtgaatttttccttcatatgcacgttagtgattcattttcattcagtggcatgacttatcagaagaaatttcagtgtccatcaccctgggcatattcagaaaaattatttccctccaggtctccaaataagctgattttggaaataaatggaggacaaccttttgtgttacaaaaggcagcaacaaggacttacaaaaaagaagaatcgaatatctaaatgtattaattcattaacatgaaaattctttctgtgggtctcatctttgcaagcagatacaatattgccatagtatgagtatgaccatgccccttcctaacaaggtattaacatcagtaatagagaatggcaacaagccatagttggttacaccttttggaaaacatcaacattttaaccatagacccttcagctgggatgcaaggaaacagagtgctggcaacctcaagaatcaaattttagaggtgaaatatttagagcttgtggtccataattaaaacaaaatttgacttcattttttaaagttacaaaaacaaattaatgctttaatgcttaacacacttttgtctaatggagacaaggaatggatttagctgacttctcccagtaacttttgctgacttacagttgagccactagagaagaccttttcaatagagtgatacagatgaaaaagtcagtgagctgtatctgctttacattagttttgcagaactaaaggtgactctcttcatgggaacaatcccaagtttgtgtgtgtaaccacttatactgatcttgctttctgttcaactatggcagagggtttaatgtttacaaatggaaacatatttttctgaattgtgataataactttctgaatacttaagattccctttaatttattacagatatatgtactttctcctaaagatgtttccttaactatgactgtctacattgaaatcattgccatttgtatatcaaataagctgctcaccaacattgtgccccaaataagcttctctgttagtctccaagaccttaccttctgtatcaccccaaaccttttctttctcttatgatccttcagtccttggcctggcaatttggccaggcaaagggcgcgtgggaaggacatcccacgtggagggacgaggatgttgaaagcctcagagctgagagagagcacagcacattcttggaggaatgacgtcaatagggttcagggaaggtttccagaacatgccctttttaattatgtaaaaattgtctgtatggtatttaacttgacctgaaattttgacacaagggtaccttgcaaacaacctgttaatagcgctaccatcattgtcagtcaggaacccaaggagaataatttcaccttccaaattaaaaacactcccaaacactcccttttccaccaagagccatgagggcactagggcagaaaacacattcagttttttttagcattggctgttatgcaaacatgctacaaaaacttgaattagtttgcaagaaaaatcccgttagactgtttccagagaaaacagcaatgctttgagtcactttgaaagtggattggcccatctcccccagaacacgacattctaaaagcatttttgtactagcagcgttaatggaaatgtgctgttctctgggttattgccatagttaactgcgaatcccacaagtggtttaagacaatcccaaatatttcgatagcttagacaccacttaaaagtttagctcaacagggtcactttccatttttcatggcagaaatgaggcttcctttgacagaccatatttctgcagcactgttaaatggtggctttccatagcagcgtgatttatggcctgcctctaggaaggaccacgttaggtgtgggatattaaaaaaaaaaaaaaaaaaaagtctatctccactttggaagaaaaatagaaaaataagtttgcagaataaactttgtgcccctcctttaaaaaaacctcaaatatttcatttttaagtaagaaaaaataattataagacttggagtcttattttgttttagttaaatccccctttcctataatcatgatcaatttcagttatcaaatactgatcttggccaaggccggaggagagcttgaagccagaagttcaaggccagtctgggcaaatcgctccaaaaaaaaaaaatgaaaaatagctgggcatggtggcatgtacctgtagtcccatgtacttgggaggatgaggcaggaggatcgcttgagcccaggaggtcaaggctgcagtgagctatggtcgcgccaccacactccagcctggatgtcagagcaagaccttgtctctaaaaaaaaaaaaaaatcgaaaaatactgatcttaagacagcaattccatctctcatgttcttatatcacaatatcacatgatgaattttgttggcagatggaaaaaaaaaaaaaagccagattcaaaaagtaaaattctagcttgtgtcccagaaaatggggatttcatcttgcttttggggagtcattgaaagacattctccctgcttggggaaggatagaaatcctctgtccctcgtctctccccttcaggtcacttttcaccactgggggcttttcctggtctaattctcatgcctgcccacttcctctcttacttcttccttcctttcagctttatttgggatctcataaaggcctgagtctttcttgaaaggaatttgaaaagaaccacgcacaatgactgccatttcgggatggaaacagtatttcagggcacacgctgtgtctcaatagaactctctctacggtgtttctttttcttcccctcgtggttcacaggaaccttggtttgagaagtgagccaagccagtcttttgttcttatttttacttatgataatagaatattttcagtctgcagacttctgcagagtgcatgattaataacaagggttgagaccggagaagtgctaacaacaaggctataattacattataggtttttagtgacaacaaaataaaccatgggagaaagctcaagggacataggacctcttaagcacacttaccaaaattgtacagccacgccaaacttccagtttctaaacgccttgtaacaagagatggcagggatgtagtgtttttaatcagagaaagaaaatcctcaagttaaacactcaccctttcaaaataattatctgcctctcattttgatggcaatggcctaatggtatcatggcttcaatttctcatgtagctgttaatttatgtttaatgcaaaacacaattttataccttattcctttcttcaaactataagtaatcttattttgctcatcaccaactgcatatgtcttattttcttggcctagttagatacccagtagtagaggagatatattttcatttgggaataatccgttccctggttatttaatggtatcattattattatatatacattaattcattctaaggagaaatttgcattcattgcagtctacgaatccaagttgcctcatgcaatatagtatctttttattttaatcccaaattgtcaggtgcccatcttttcagcaggcctgtatgtcatgaataaagctttccctttgatcaggcaatagacagaaaattgtgttttggagaagcaagaggaagaataagggtatgaatgccagatcagctggatttcaatcccatcagttcttactcgtcccatgaccttgggcaaattacttaacctttctgtgcctctgttttctcatctgtgcagtggggatgacagtagttccagctcatggtgctctttgcagatgtaatgagataatgcacggacagagctgggatcagtgtgttgcacagggcacccaggtggggtcagtcttctttgtattaattacgactggagctccctcatgctcttattggttcagaaggacatttgagaacacaggactgattcacgtcttgatgcctggctgtttatcccacaggatcattgatggacgtgatctgatgcccctgcttgaaggaaaaagccaacgctccgatcatgagtttctcttccattactgcaacgcctacttaaatgctgtgcgctggcaccctcagaacagtgagtaaacagacctttccacgctcctcatgctccgtgcaacctatgccatgggaatagataaaactaaagggtaaaaaggtggctctgctcaatggaggccaacaggtgcctcaatgtgcgcccatgctttgctttgtcctcttttccctcctcctcctctcttttcgttctggtcacatagttgtccaggtaggaggacatcagaaggccatgtcattcacccacctgaacaccacccacagcttctctatcccagcagagaaagctccctgttctcaacagggcgctgtggccggttgctttattgcatgcacagctgcccagcttcacttcctagcactcctctcacactgaagaaagcagcccctgtgctctgtgcattgctgtgcttacacttgcaggctcttctcctggaaggatgtcttgcctcatccttcttggagggtactcctcaatgccccccaggccctgctgaaatgccacctcctctgcatgtcctcaaaacattcccctcactcttctagcaagccactaaaggctagagaaggaatgaagagcatttaaatgtttatctgacttactttcccagcctaaagatgatggatcgtgactcactgcatctgtattttgtgcgtcatgcatatttgctacatttagatatttaaagcaaagttaaaatgttcttcagttctatctcattttctgaactgggggttcttttaattgtgcaattgaacaggatatcttgtgggttttctaatacttgttttatagtggcatttccaattagcatacaggaacaaatggtttataatcttaggtgtggttgttgatttttatggctgcatagtattccatggtgtatatgtgccacattttcttaatccagtctatcattgttggacaattgggttggttccaagtctttgctagtgtgaatagtgccacaataaacatacttgtgcatgtgtctttatagcagcatggtttatattcctttgggtatatacccagtaatggtatggctggatcaaatggtatttctagttctagatccctgaggaatcgccacactgtcttccacaatggttgaactagtttacactcccaccaacagtgtaaaagtgttcctatttctccacatcctctccagcacctgttgtttcctgactttttaatgattgccattctaactgatgtgagatggtatctcattgtggttttgatttgcatttctctgatggccagtgataatgaacatttttttatgtgtctgttggctgcataaatgtcttcttttgagaagtgtctgttcatgtcctttgcccactttttgatggggttgtttgtttttttcttgtaaatgtgtttgagttctttgtagattctggatattagccctttgtcagatgagtagattgcaaaaattttctcccattctgtaggttgcctgttcactctgatggtagtttcttttgttgtgcagaagctctttagtttaattagatcccatttgtcaattttgtcttttgttgccattgcttttggtgttttagacgtgaagtccctgcccatgcctgtgtcctgaatggtattgcctaggttttcttctagggtttttatggttttaggtctaccatttaagtctttaatccatcttgaattgatttttgtataaggtgtaaggaagggatccagtttcagctttctccatatggctagccagttttcccagcaccatttgttaaatagggaatcctttccccatttcttgtttttgtcagatttgtcaaagatgagatagttatagttgtgtggtcttatttctgaggactctgttctgttccattggtctatgtctctgttttggtaccagtaccatgctgttttggttactgtagccttgtagtatagtttgaagtcaggtagcgtgaaacttagaattacagtaatattcctatcactaagatacctggcagtcaatggtaagtggtgagcaatttacacaattattgtatgttctagaggtacctgttgaggctggactttcagttccttctttggaggtaaaatgaaattccccttttctctaaggggctttggagctctgcttctagaacctaggactgccccccccacccgccccaaaggaggggtgtgtaataacctcctaggtgctaacttcttcttaaacttagggtgattccattccattttccaacaaatctttgtctcttccccactcacctagccaatttacccaagacttatcatttaaagaaaagcctctcttttatttttacaacttttccataaaattacaacctttctattagccacagaaatcacaccaggtttatgcttcagagtttctcctttaagtctggcagttttctcatgatatgttctagaagacaaaaaaacaacagaaacatgggcttgcgattttacttctggaagcattttattcacatatctcatccatgtggccacaattcctagtttccataagaatactccttcttttttagatcagtttatagcatcaacttctgagctttgtaataaatgagagctcaaggactcttaatttcttttcatatggagccggcaagaaatgtgaagaacaaagtttctgtgactactgcatgttcgaataagtctgtatcatgtcctgaaccttgcaaaattgtattttaatagagccaaatccccagttagagaagcgggaaggaacatattggatcagaggctggaggaacacattatgtggaggagtaaagagaaaggggacaggaagagacagaaaataggagtgagaaaaacaagacccagtttctgataggcaactggccccgggataaaatttgcttcttagactctgaatgcaattccttcaactcttctgccttgaactggtaacaaaaaaaggagaaatcacagtatctgaaggctagaatcatttatcgagataaaggacctcaggaaaacaagacgtttatgaatcatttatgatttatttttcagatgctatctgaaactcagcaaccatatttgctgtcttggcttttgtgtatggcttcatgtttagtcattttgtattttatgtgttcatttttcctagaaatatgtattgagcacctactgtgtggaacatatcgtcttagcgctggcatctgtcagtgagcaaaacagacaaagttccctgctgaagagtagcttacattttagagcatgaggcactgctagctgtacaatgtgctgggaatacagggatgcgtaaggaaaacgtgactctcatccatatggagctttctgtcacctggggaagacagatcttaaactagtaatagttgagtgtgactgcataggtcatctcagatagactttggtaggagcttgccaataatcactagactgtggaacatattccatgaatcttagggataagagggttgtcgcctgacctcagaatactttattagaaaatagaaaaaaagaaatgtagtattagggtttagtagcaggcagtggtatgctggaatcagctcctgatcgttcagaaatcttgccagcttgttattaaaccattgtctgttttcatttggctgtgttgtgggtgtttacaccacggcaattggcaaacacaacaaatacaggttgcctttctccctcagagccctagattaacaacagtttgttggtatcagtagaactgactgcagatgtttttaagatgcagtttaccatttgtcttgattacttagaggattaaatgttataattccaaactcatgaaatactgattttcaaaaaacttaatgctaggatttcatttccacccttttaaaacatgaatctcttttaaaatttatatataatgtcttcgctataatttagttgtctcagtaaattgaatgacataatttaattatgacctgatatcattattcctattacattttataagaactcatgaaagcatgattataacatggataacttttcttgcactaaaataagaattttgagttaaaatttaacattcaatgggtatgaaaaattttggctttaatgtttgacatatgaattaatgttattaaaaattcaccacaatgacaacttgattttatggatggaattgatcttagagggtaggtggatacttggctccaggatttttaagctgatgactgtagtctgtgagataaatattcacattaatggagagtccccaaaccagctggtcataccaaaatccatgggatagctgtagatatattctagaatgcaatgcaatatagtacatagttaacagcttaaagcgttttgtacagacatatatggaatcttagcatcatgtagacaagaaagtcacatatatttaaaatgtcacactttagtcagaaacgggatctccatgaagctataaaaattacttaggggaacggggcaccaataccattatttccctaggagaaggatgtagacatcctcacattggactagcagagtttcataaatcctggctccatattctattcaagtttgttggaaactttttcccaacaacaaaaaataaataaataaagctttattttaaaaatgacaatactaggaacatttgaatgattctcttctagctattgtgaaatatacaatcaattaatgttaactggtgatggatatcccaatttccctgatttggttatatgagtgtttcaaatgatcacaggtaccctgaaaatacatacattgaatatgcatcaataaaaagtaaataattaaataaaattacagcaaacagccatagggtaatggaattcattccaaaggaatgtgttcctttccggctttctgaaagataccttcatttcaagctcagtaaatggtttaaaatcaaaaccagcttaccgtggtaacataaagaaaagtgctcgcatggctcactgtctagcattttcatttaattaaaaaattaattttgcctctaaaacacacctaataaaagagaagaaattctcataacagccacttatgagttaacagcatcagaaaggcagcacttggctttcatcatcactagtaattttggtgagtacttgtcagatgcccttcctcatctaatcctcagaattaggatctaaagtgtcagaaatgaaatatcgaaggctgaagctgacctaatgtgagatgcagcatttccaaatttaagctcaccaggatctatcctgtgtttcagctgaccttatgaaaggacatattttcatcctactctgtaactgttgtagcaattaagaaaaagcacatatatgtaaaccatttcaaggataacttttaagtcttaggatttattttctctgtgaacacttcaaatgctgcattgccacaagcttttaatagttcaggcatgcagctattatttcactcatgtgcctgtgaagcccagtacaaggtacaacatttgtacttgtaattgtagcaacacaggatgatggtgtcctgggatgaacagaatttgctttggagatctaggaaaaggagtgatttatgaggttagaaaagatttcatagaacttttaattttttattaaatttattttatatcattatcatctagacacatcagtaacagcttaacttcccctaacagtcatttccaacagtggaaaaaaatcaccacataaatagattttgtgttttccaacatagcctattaaacatatattttcttatggaacttcatattaccttatagacagtatcagacaatatttgagataaacgttcacttttcaaccaaagttgtagtatgtctgatctaagattacactaatactgtggaagaaaaattcctggtcattacttttgataatttgctacaatgcaaacttacttccttatagaaacaaagtaaatcaaaattgaattttctttcttgaatacaaaaaaaaaaaaaaaagcgccaaaaaacttggtgtggctgaatgatcaaatgccctcttccatctaagcttggcacccagcttattctgatctttttgccaggggtcacttctgatcttttccccttgcattctccgtcctaccgtttcattgattttctacagtattttacacatctcttttccctgacttcaacacggggtgtctctcagttctcccgaaatgtctgcttatgtctctaaccccccgccagatttgctttcatatgctctcagacctggtgttttctaaatagacattttagttctaaccagggcatgcaatatttagcaattttttgtgtcttccttactttcgtatcttctgtacaaaaatgttttgtaggtggttatagacgtttccgtttgttaatctcatgttcttgaaatttgtcatctctttttgtgatcattatgtatcttttgaagacgtgcttgatgacagtaaacactgatgtttgttgcatatttactgtctgcccgacagtttgtcaagaacattgtatttgatatctcattagaagagattatgattatattagtttcagatttggctgtaacaaaaaacaataaaaaaaaacagtagtttacattagagagaagtttatatctccatctcatgggtgacatccagaggcgaatggtctacaaaatctctggggtgcagaatctttcaagcggcttttccacctcctgtagaatgtgacagcttcatcttcatggtgaatgatggttgtgtctaccctaaacgcatacaatggcgggacggatgggaaagatgagaagaaaaaagtgcatggctactacttcccaaggaagatagtcagactcttctcagaggccagaagttggtcacctgttcacacctagcttcacaggaggctgcaaaggagagttttgttatgggtgttcatgtacccagaggaacactcaatgactgtgggaggctggcggatcagctagctatctctcctcccagtgttattttttcccaattatagatggggagacagagaggtagaaggtcgcattactggcatacagttgcaaagttgatggccaagttgggatttgcaaccaacaccatttgcttttgagtctgtctcccattaatcgaaatgtcttcccctaagacaatatgttcttttactcacaattataaatcatgattcctccacctaaccgtgtatctggacatctctgtgcccccatgcactgagtccacgattcatccacatcctcttattccccaaatgtggacatccttggcatcatcaggtctcatactccttccactggctccatgcctggtcctcgtcctctcagctgccctcctccctctccatgaatgttctttcctgggggccaaatgacttatgccccctgcacaattcctgatgactgcccatttttgacaccaagcaatcccaaagcaaatgtacttccaagctctctgccttcctcactccgttatctgccatgatcagacagtaatctccagtgcctcacagtagtctgttggtccttcaggctggagatggtgcagagccattgtgtgatttcaggcaggatgctccgggtaggtcccgaggggactgtggagtgtatttggcttcttgtctgctcaccctggatttcataatgacagctggttcctcccctctctttccatcccttcctcctaataaccatcatctctttttttttttaaatttatccaacaatttttttttttgagatggagttttgctcttgttgcccaggctgacatgcaatggcacgatctcggctcactgcaaactccacctccaggttcaagcgattctcctgtgccagcctcccgagtagctgggattacgggcgcccaccaccacgcccagctagtttttatatttttagtagagacggggtttcaccatgttggccaggctggtcttgaactcctgacctcaggtgatccaccccgcctcggcctcccaaagtgctgggattacaggtgagggccactgtgcctggccccaacaatttttattgggcctctattctatctaagatactaggcactacacatttaggagatgtgggagatatagtccctgccttcagagaggaaataatccagccagagaattggagacctcaagtgttgactgagtgatgaaaagtggtgagaggaacagaggaagactggtgacttccagctgggaattcagatgggtgcatggaggagaacacagcagggctttgaaggacagctagaatatcaatatggaggcaaggaagggaaagtgagggaagagtctcatatacatcctacacccactttgttccaggttatatatttctgtcccttaatatgcaaaacccaaggcttggtaaaagggagtattttgtcctcaaatactcaggcatcagttgggaaagcttgtgttgctctcaaattggctggctgtgaaacagatgcacccagccaccagagctgcttcctcatccttctcactgttgttgtatcgtgagctctggtactgccagctgcaggaagcaggcagaacttatctactgtcatcgattatatatcagccaagggctgaatagttagggggtttgtgctatggtaaacagatggcagtgaacctcaggggtcagaaacagagcttggggccaagatgcttttggtgagtgtgcatgtattaagttagaagacacatgatctatggaggctcaggtatggacacactgtaaaatctttgggtgtaagaaaagatttgaggcattagtgtggggtatctggatgagactagggtaatgtatggaacaattttttaggtggatcgcaggagtaggagggcaccatgagatgggttttcagacatcagttcagtggatgacattaacttttctgtaaacttactgagggggcaggcctagggttctttgtgtgggggttcctcacaatggaaaaatggaacagtatgtgaaatggttcttgaagaacttcaagatggcaacagaggtacatgctgccaagactgaaaacccaaaatatctgtgtataccttctatgatatatacatgcagtcttccaagcacccaaaataaatctcgccaaaactaccagttgaacatcattcatcaagggaagtttaaatctgagtgatacattaagagccactgtgttgaaaccatgtagatttattaatagttttccatatactttaagaatccttagcagaaaaaaaaatgtcttacgacatgtattacagtagcaacagattgaagggcagatggaaactgaattgtttcttgcgtaaattggctgcagctttctgttcacagctaactcatgtatagtctctactatagacccagcctccttctgacagcatcacatataggaaccaatttttaatcctcaaagcaatgctaccagggaagaactattattatgaacatttaacagaggagcagactgggacacagagaggtgagagcagctatgcccagcatcacgtatgtaagaaactgcagagctcggggttgaacctaaactattgatgctcagagctatgcccttaatcaagtcagtggcaggaaaaaccttggccgaagcacctgccctctagctagtgcgttctctctctctcttccccgcctaccgccagcaccccccgcccctcccgggactcctctgtctatgcaagtctcacatagcatcaggctaagaaaggcaaatgctcttttctaaagacattgctatcatcctagaacaagagagtcttcgggcccctggcaccaccccttctccatcatatttgtcctggaagagcacagcaactctacctgtctctgctttttctatactgcctatggatctttggtgcctttcctgtcctttagagctgttcattcattcatgcagtttatcaccacgccttgggacttgtgaggattgtctgtctcagtccagcttctggctcattttatcaaaaataaagtttgtcttattttatagcttagctctcagagggttcatgtgtagggagtggcgaatttgtgctatgataactattagccctgacatttcaggggctcagcccagcaaacatttattctcactcttgctgtagaacagagcttgtcaacctgggtactagtactattgacatctggggccagatcattctctgtgctggaggctgccctgtggattctagactgtggagcagcatccgtggcctctccctaccaggtatcagtagcaagtctgccccactgcagctatgaccacaaaatgtgtcttccgacacggccagaggttcaggagataactgtgttcagtgcctgtcatggtgggaaggtgggggtctaggaggagaaggttctgccatccatttgtcagggaccaccctgacagaggccccatcatctcgagtgtcaccagcagaagagacagctcctctgtgctgtggctgggaaaagacataccacatactgctcacgtttggccagaatgggccatgcggcctttctgacttcaaggaagctggaaggtgttctggagcgcttgaattactcagggtttattatccccaaaaaggaggtgtagtcttgtttttgtggcctcagagttccaggttgggggcaccttgctttagccgctgtgggttagaagcaggggccgtaagggcacactcacgttgtgtgatgcctctgagtgtctatcatgcgcgcagtgtctttacttgtgccgaacaggctttccagacctggttttgttttgtctcacgtgatggctctgagacttctgcaagacagcagtttaaacattcagagaggcctggaaatgagtgtcctggggtctggactgtgccgagctgtgttatggactgttgtgactgctctaagtagagaattcagaatgcaagatgtgagaggcttgcgtcactatgagaagccagaagcacttggggcccttgggataaagacagaatgaggccttcgaggacgttgttaaaatttgtaggcgatgtagcatgaccctgttcccggaccaaaccgagggtaggactgctatttctcgcagcccaacaaaaagatgcagatgaactggggagaaagagagtttttatttctgtaaccggttacagggagaaggcctggaaaatattgcccagaccaactcaaaattgcagttttccggagcttatatatcttctaagctattagtctatgtgtaagtgtgcattcatctaaagatataagtgatgaacttcttttaatctataaccaagatctgagtcctgaagaccttcctctggagccccagtaaattggcttaatctaaatgggtccaggtgctggggtgattacccttatcttgtctcctgctaaatcatggaggtttggggagttccttcagatctccagtaaacttgtttgtggaggtctggggagtttcttcagacccccagtaaaacttgtttaatcctaaacgagtcctgttaagaatccttcgttatcatgtcatgcttcaaggcccaggagaggcctgggcaaaactcctgatgggcttttgttccattccagcctttgtatgaggacactggctctttcagcttttaatagtaacttcaccactcggtcagtgccgaaacagatgtcatggaggcctgcgttagtgagacctggcctgccacaacccgactccaagacgttaagagggagcttgtgctagatactaatattgattttaaaaaatattttagtacataacgaaagttctggtttgcgccctctctatttttgttcttggggagcacatatgctcattttcggggcttccttgccagggctcccacttcctgtggctgagtcgctgtaatacgaagtaatagaaatcacaacgtctcttctgttccagggtcagaagcccctgtggtccccaggcaatcccagggaacccagatacctctttatttctctttgttcacagcttagtttatttttaataagatagctgttttaggatcctatgtggaggatgttgaatcagtttctggcttaggcatcaactttttctcacttcaattctatttgcctttttgtcaaatgacaataaactttcttctctcatgagttgagtcacattgtttagtggtgattttatataaaaatatgtttcaccagatgggtgatgatttcctaagcattttgttctagcacagtgacataacagtgctatatcatatgtcattgatatctttgaccatcacttgtgacaattcgttttcttaatttgggggaggatttttaaaatctcagtagaattattgtcctcaccactacttagactacttaaacaagtaaaaaaaaaaaaaaaaaaaaaactgtccactttaatttccctgcattctttataccaaatttaatcattccttttccaggtcattggatctcagttataaatgagtctaagttcccagtttggtcaaaatacttatcgttttcagtggtgagggagaaacagtcttttatcagagcagttgatgataatttttaaaatacagtagtgaataaacattttttaaaaatttaacatttttctagtatatgaggatactcaggatgaagtatgttatcaagataattttggaatacaggactaaatatacctatgaaaaatataagatgatgctgggcatggtggctcacacctgtaatcccagtgctttgggaggccaaggcaggaggattgcttgagcccaggagttcgagaccagcctgggcaacatggagacaccccatttctacaaaaaaatttaaaatatagctgggcctggtggcatacacctgtggtcccagctacttaggaggctgaggcaggaggattgcttgagcccaggagttcaagactatagtgagctatgatcataccactgcactccagcctgagtgataatgcaagaccctgtctctagaaaatacaaatcgaaaatataaattaaacaaaagaagatgactctgccaggtgccttctgttttatctagtgactgagctgtgctatttatctttgaaatgacacctttggagatgtcagttgctgggttcctggtgaataatagaacaagcttccaaagtcggggttgttaccttgtgagccactgtacaataaaaagtgcagttctagttctctcttttcagtaaatctaaagtggtccagagaaacagcacagagactaagcaatctacctttttatgaaaagtttttaaaaatccaaatgaaaggataaaaaggcaagcaaccccagagcatgctaaataattctttagaataattaattcttagttctacacttgtctgaactacccagcaacaccactgccattcccaggccggggtgcctgcatctcttgactgggcctgatgtcaatctgatcttccagctcacacctgaggaggattgtgctctagtagtaatgacaggatcatttgagtggctttcaaaagcaagtggaaaatacaggctctttacatgaatttattccaggagcctgtattctcctggggttttaaacacaaagaggcttgactcgaatgtcaagttcaaaacgccctctagatttgcatcattgggagcatgagcaagagaggcttcctggctcgcttctctgtgtacccactttctctctcggctgaccctgatgaaggattctaagtggctgcaaatggcaggctctgtcagcctgtctccaaaaaggcttctgaaggaaatttctcataccctggaagaaagtgtgggatgagacgagtggatgggaagcatcttaaggttacttgctgcctttttaaaccctgctggagatggtaaccaagtcctggaattcttcctgcagcctggcgtgtctgtgtgtcagcttgaccttatctttctgaagcaggtgcactgagcccatgtaaagtgcacagatgtcatgtcctgctctcgcagaatcagctatgccacagactgcagtcgtctcattatgaatcttctttaatatattaatctaaacgtattcacctcgctttccctgtctttctcagctttaaaaaaaacccacatacacaaagaggctgacttttaccatcactaaccttgtccaaggttaggggcgatttggggacaacacatgccctagtgactgttggtttaaaccgattgcattaatcagttttgcattttgatcagttgatcatgaaatgcctataattacaaaagtcacacatgccattatatgcacaaatgatcgggatgacttacacaggggtggagggcttcctaggaggaatgcctctttggttttatgtaaaagctgtaagggcattcacgttctgcacctgattctagtcggttcatgcattttaattctctgtttttatctgctacattttgcctacccatgaaacatgtttaggcctctcttagaaggtgtttgagagcagtcagctcctcagaaaatgataacattgtccgataagtaggaaatgaatcaattatttcataattattcatttgtttgtgaattagtttttcctagcaatttcaatattttggagtttattgaaatacagaacttacattttaaaaactaaccatcctattctggtgttgatgaattcccctaatttggaattcctagcagcttttaaaggtatacgttgcatgccattatattctaatttaaagatttttagaaaatgtatagagttgagcagtctactttcagaacatctccttcatcgccaaaagatcatttccattccccatttgtaatccctcctcaccatcacttctagcctcatttaattcttttttatttttgtttatttttgtgggtttgttttttgttttgttttgtttttttgagacggggtcttgctctgccacccaggctggagtgcagtggcatgatcatagctcactgcggtttcaactgcctaggttcacacaatcctcctgccttagcctctggagtagctgggactacagacacgtgccaccacacccagcttttttttttttttttttttaatttcttatagagatgggctttaactgtgttgcccaggctggtctcaaacccctacctaggctcaaggctcaagtgattcttccacctcggcctcccaaagtgctgatattacaagcatgagccgctgcactcggccctcatttaattcctttttttttttttttttttttttttttttttttttttgagacagagtctcattctgtcgcccaggctggagtgcagtggcacaatctcagctcactgcaaccaccacctcccaggttcaagtgattcttttgcctcagcttcctgagtagctgggattacagggacctgccacaacacctggctaatttttgtattttttagcagagacggggtttcgccatgttggccaggctggtctcgaactcctgacctcaagtggtctatctgtctcggcctcccaaagttcatttaattcttgattcgacattttttggactttctggaaactgagaaaataaactgttaactatggtcctaccaagtttgacgctgttcctgctggctgtgtgtgtgggcgtctatgtgtggcttcataatctttcctgtacatattaacattgtgtctgcagccttatgatatcttcaccttcttaaagcacatggcagcataatttccgcatcactttttcatttgtggtacatacaaggatgcttcatacctaatgccgtttccatccttttaaaccacaggcacatccatctggaaggcctttttcttcacccccaacttcaaccccgtgggttccaacggatgctttgccacacacgtgtgcttctgtttcgggagttatgtcacccatcacgacccacctttactctttgatatttccaaagatcccagagagagaaacccactaactccagcatccgagccccggttttatgaaatcctcaaagtcatgcaggaagctgcggacagacacacccagaccctgccagaggtgcccgatcagttttcatggaacaactttctttggaagccctggcttcagctgtgctgtccttccaccggcctgtcttgccagtgtgatagagaaaaacaggataagagactgagccgctagcagcgcctggggaccagacagacgcatgtggcaaagctcaccatcttcactacaaacacgcctgagagtggcactggggaaacataactccatctacaccttggatttggactgattctccattttatcacctgaaggcttgggccagagctcaacagctactcaactggaggggtgagggggataaggtctgtagtatacagacaggaagatggtaggtttatgccttctgtggccagagtcttggactcatggaaatagaatgaatagaggggcattcacaaggcacaccagtgcaagcagatgacaaaaaggtgcagaaggcaatcttaaaacagaaaggtgcaggaggtaccttaactcacccctcagcaaatacctatgtcaacagtataagttaccatttactctataatctgcagtgatgcaataaccagcataataaaaaggcaatcacataaaaaagagtttagtcgtctaaacataagtaactttaaggtgaatgaaagatcttctttaggaataatagatgatggtaagttccactttggttattggaaggcaagtcattattactggtattagttaaaacacatatcaaatgcttgctcttcatcatatatatagttatgcatacatacacacacacacatacagtatattctttcctcaaaagggttaagatgtctaaaatagggacctagaagcttaacactatttaagtaaatacagtagaagctcacaaatagatttctttgcacaatgattttttgcaaaattttacagtaataataatcccaaggcaaatctctcctgaactgctttccattccataatttgtagtataattcttggattccactgttttctttggggaatggaagttctgaattaaaagcccactgtggagatgctgtggttcatggaatctcttccagtgtaattcagaatcattggcctagaaagtctctgatatttggaggggaacaaaaatcactcacaagcaatccatgatctatacacataagcataatttcctttagttctagttagtcatcagagaacagtcatgtatgcaagttttgtgactgagaaatttctgtgcttccaatccacaatgagatgcatgattttgttttcatcccatttcccccaagcccctgtaaatcagggaaaatgcgcaactgatcgcctaggagagggcctcgtagtggcacagctggagatagtttcaaagtctaaaccaccagcccatcctgaggaaagcctcctatggaatgtaaagtgcaatcatttcttcagatataagactttccccaacaatgtgattggattcctttatggcaaaatcgagagaagctgccatccacctgcttatgcatttatctcttttgtggacttgtctgaccaccttctatttgcccagagtttgctcaattccaagacagtgcccatgaatgggacacctgtaatgtaacccacacagcggtttgcagagaatgttagccatgacttgggctttctgaaagttggctataatttctctatccctacccacaaccctgggaagttggagcaagaggggcatactattgggctgggaggatttgacagcatttccccagttgccctttaagttcttctatttcaaacgttaattttgcttctctttctaaaaaaaaaaaaaaaaaagaaagagaagaaagaagtgattcctaccccctacctccagagttgttgaaagctgaaaagcatacaagattcttccttttaacttggatttctcgttccagaaattgtgggataatctgtattcttgctttagaaaacattcttagagagggtactagcttactgatgatgtgttaggattgctactgatgctgtcatgtggaaactatttaaaggcactattataaatttatcctataagatgacaatgtttactcaaagtctaacatattcaatgcaagtaagactttctgaaaacacttgatgatgtggaaatgctgcaggattaaataacttgaagagcctttatagattatatgaatgcctatttgtgtctagaaccagttatttaacctgtaaaatgtcaatagcaaatgaaggatgaagtatatctctagatgcaaatacattgagtttaaaagtgcctcaaaataattgagatcacatttcaggacatttggaaatcaggtcgatttgtggtaactgtagtcatcttaaatttcaaaccatttaccatctgaaagttttgatttgaatgtaaaacaggaaattggaattcctttgtccaggagaaacctcacaaaccttctttaaggcatagttttgttgtttgtttgcttgtttgttgcaggctgtaaggcatggctgcttgtttacaaagcatctcattcatattacctgtggagttgcatatccaaaccttagtgagttttgaagctttaagcaaattcttttaaaaaattcttgtatttctagcattactagatattaaaagttaagcaaatagattaatgacgtatacataggcatcatttcacaaggtcagtaatgctgcaggaaaagcaaaattgcaatctacgtatctatggtactaaggaagtcctgtttttcaaaaatggaagcccacttctcagatttttctgaagggcatacaatgaaaagtgaaggggaaacacacacacacaaaaaaacaagtatttggcttgtcacaggaatctgattgcattaagtgaaaggattatttagaatatgttaatgcaaagctaaaataaaattttccttggcaattaaaaatgctgtgcgctaataccctgctttctatcgtgactcaattcaacaatgtggggaatgtttactacatttccaacttgatgtcaagcaatggggaatacaagttccagttctgcaaagattcgtcaactttcttagctcaagagagaggctgagaaatgcagagaagaataagacataaaatagctccgacctccatgatccgagagtgggaaaaggcccgattattacccataaggcacactctctaaggccttttaaggggcctacaaaaatgttttattttataatcagaagaaaaggaaatgaacattggggattgaaaatcatattggtatttgcaccaacatagtcataaaatagtatgttaatatgtttttactttatatatttatatattaaaatatatttaatatgttttgcctttgtggcccatgaaagtcttactgggccctggggaaggtatcctaccctggtgaagcagctgctttgctctacaaatacctggggcagaaatttgatttgaaaagtattattctctcttctctttgtttcaactggattcctttggaaaaccaaactagtatcagaacaaaccccgaaacagtaagaaattggagtgagaagggcatggtattgggactaggatcggctctcattcgatcgagctattctcttaaaatgacaaaaagtgtccataaagaggctgctggagagtgcgtggccatagggagccgacatgcccgggaggaaaggtgttgattacatggatacttctaaaagctaaagccttgttgccttctctttaatgcctagagaatgggatgtgtgatgcaaatgctcaaaacctcttaaatcatagctgtctgacctctacggacctcacatccatctgaggcttcatggacaaagattctccacttggccaaactttagccaagctcctcaaccttctcccaggcccaatctgggcacttccttgtaaaatctagttttggcaagaagtctattaggtcagtttagcaagaacacctaacccccccatatctgttcaacctcagtatctgatcaggctcctcagcctccaccatcccccaggtgatgtctggtcaactggcctgccttcagctagaatcctgttaggtcggtttagatgaatgctccctgatatttcctcttggtaatcttccatccactgcccctgaccctgttccctgtctataaatccccagttttccatggtgtattcagagctgagtccagtctctctcccctactacaagtccccattgctgtggtccccgtacctgtcatgatggtcctaaataaagtcttactgtgctttaataggtagcattgaaaaatttttttctttgacatcattcatgacaacatgaaacctattgggacagcatgactgtgcagggtctttagagctcagctttctgaggccctgagcattcttggttttccgacatcgtgaacctgttctgtgttgcaagatatcactcaagccagtgttgcttaataccatctctttgtgtaatagatctgaataaagtaattgtaatacaccaatattttactttgttgagtattattttaatgggagcctttccaatgaaggaaacatcagctttccttgttagaatgcaagcagcttaaaaactacccatgtctttctggaaaggaaacattgccatgtaactatgtatcagttttctaagaacttcatgggccttccata

SEQ ID NO: 5452 - DNA, 162987 bp, human; identical to SEQ ID NO: 2960

SEQ ID NO: 5453 - DNA, 80676 bp, human; identical to SEQ ID NO: 2986

SEQ ID NO: 5454 - DNA, 75249 bp, human; identical to SEQ ID NO: 2985

SEQ ID NO: 5455 - DNA, 75220 bp, human; identical to SEQ ID NO: 2984

SEQ ID NO: 5456 - DNA, 48187 bp, human
gcgcgatgcggcactgcaggtaaggggcgcgcggcgcctggatgccctccccggcgcccccggcagcgcggacgctgcaggtggagcccggcccgcgggcctgcagcccggctgcgcccccagaaacccaaagtggggcctctggctgctgcggcgcctgctgcccacagctgcctgctgcagctgcatgcacccggccggggatggcccgtggcaggcccacgcgtgacttgggtcttggcgtgcccgccccgagaaagcgggcaggggccagacagaaagacgggggagggaaaaaaccgctccggcgggggaacaaaatctgaagtgaccacactgcatgcattctaagtagacagaggggcttttaagaggtaactatcaagtgttttcctagtgtcattctgcttcttaaataacgacatgtttactaattacaggcctttgtcctcagtaattagcctcatttctttcaaagcaaaagcgggctggggagtggaaacttcttggttagcaatttaagagccagatgtgcaatctaaattgctttgcattattttgcaaggttccagcatttacagggcatacgtcagaaacgtattttttttttccttccaggtgttttaagtagattaaaaaagaacggtatccaatacaataaaaataaattgcagcttccaaagataacatgtgagcgtaagagacagctacatctctaagaaccaaatgatctttagcagagagtgggggtggagataacaccaaaacctaagaattcccagagttcttgttaattctctcgctgataattcgcttgctgaatggagaggcttgatgacagcgccagatggaggggtcaggtgacttcagttctagcatgacagtgggtgggggattttaatggactgtttctagagcgtttacatgcctttctcggggtcaggaagaaactacagccaggacgtgtgggggcacccttagggggagaatgtggcattattttcccctctaaaacctgacccttctggaagctttgttgtcactaaactgtattggaactcacatcatgaataatttgaccaaccagcaacgttggggggcctgtaaagcaatgctatttccatcaataattgaaggaggcatttctttcagaatttgggacacccagatgtgttgctgcagtaatttagtaacttgtttattgcaattttcttcctttggttcagtttggttacacaaattaagatccccgggtccccgccctcccttctcctccagcccaaccctagatagagcaaagcagatgatagaggtggatctaatacagacctagattccacttttggctttgtgactgtgcagccttggatatgtcatttagtgtctttgggcctcgactatctcgtcctcaaagtaacaaagggatttaggtcagggtgtctcaaccttggcactactggcatttggggccagataactccttgtggtgaggctgtcctgtgcattgtaggatgtttagcagaatctccgacctccacctactagatgctagtagcacttccccctcccagcccccagttgtgacaatcaaaaatgttgccagacattgccaaatgtcccctgagggctcccttgccccctgttgagaaccactgattgagatgatctcgaaatattcttcttcgggctccaagaattcattttcttatgattggtttgatgccaagcccttgatcagaaatctgattccctttcttaatatcacatatattggaaaacacaatgtgaaggcgtttttatgctgtgaatttccagaaatagcttctgtgaaaaggggaggagctgtttgtatgccatttgtagctgggaggcgagcttggcagaaaggagagtgttagggaaagaggaaaaaaacagagcactagatgaacgtgtgtggaaacctgccggggcttcgtgctcagcagacctggagcacgtccctggacgtagtctaaccctgggttagacctaacagctgagagtccatttccttgtctgcaaaaatgagaataacagtgtccactcggaggtgttgtgaggatgaaacgacacgacatctggtgctggtgggggacgtggtgaggacgagagggtggtaatgtctatgcagctaggaggaggcaaacacaaatggcccgcaccaccagcgacacggacactcgcttgggcagacatggtcgcatgctttaagcttcagtccaggactaaagatctggctttgacacctaggagggtgaccgtggctgcatcacttcaccctgcagagctgctgtcggatctgtaaagtggggccaaccgtgcttgctgactctgcttccttggctgttggggagggacggatggaagtgagagggtctgcaggctgggaaactcccaagagacaggaagcgggggtggcagcagcatagcaagggggggacatgtttactatgtgtgtgtatgtggtggtggtggggtgcttagaatggccagaaaacatttccttgtgccccaggctttggactttgatgtgtccctcccctgggttccctttccgttgccatcagcttgctctctctctctctctctctctctctctctctctctctgtctgtctcatctttcctggcaccatgaaaatggtctcctggggggagataggaaagccctggtgggggaggttggccttcggtgaggaagacccactgtgcagagggctagggtgagagcagctggctccatccactccccacgccactgtcctcacaggcttcagtccacggacatcccagggcaggcctgtcacgctcctgtgtgcctccagtgggcttggtgctctgtatgagccatctggccttgtctcttcaacaaggtaatatcatgaaagaaatttttaaaaagggaggtggggtattctccatcaaacgagacttaagagacggaatagccaaatatcacttgtggccctcgattggattcggcccaaacaaacgtgtaacaggcattttggggatgcctggagatgctttgatgtgactggctattaggtgacactaggagactgctgctgctttgattagatgtgacagtctgtgatgtgttcggcagcccctcggacagatgcagtgatccccacccctggcagctgcaacttggcatcaccctctcccctggggtttggtctggaccaagtaatgaacttccaatgaatacgtctagcaaggggtgggggagaggcacttccaccatgagggtgtaaaggggcttctgcctggggtgtgttttctctcttgggttgcttacactgaagctgccatgtcgtgatcagccctacaaaagggtccatctgccgtggtgaggacccgaggtccattccaacagcctgagaagaactgagacccgctgacggtgtgagggtgtgagcgggctcggaggcagacccttcaggcccagttgagtcttttttttttttttttttttttgagacagagtctcggtctgtcacccaggctgcagtgcagtggtagcgatctcagctcactgcaacctccgcctcctgggttcaagcgattgtcatgcttcagcctccctagtagctaggaatacagggacacgccaccacggctggctaatttttgtatttttagtagagatgggattttgccatgttggacaggctggtctcgaactcctgacctcaggtgatccgcccaccttggcctcccaaagtgctgggattacaggcatgagccaccacgcctggccgcagttgagtcttgagatgcttgcagccctgtgagacaccttgagctgaggcaccagctaagccactccagggttcctgacacagaaacagtgacatgatagatgtttgtgtcctgctgctatgctttggggtaagttgttaggcagcaatagatagctaatacatgtgtttatgtagaaaagtcttcttgtttagagatgtatactaaagtgtttagagatgaagtgtcatggtagcagtcatttactttttttctttttttgatgttttcttgagatctctttaatgtatgacttaataggagacagatgaattctcatacttggttctacattcaatctgtttcaatatcgcatgtcatgtagcctctggaaaattccattgtatgctcatgagagaatgaacttagaaaaaggcaaataacaatgtcagaatattgtgaaatgtttttgacatcatggactcccttaaagggacttggggagcccaaggagtccccagatgacactttgaagatcaggcttcaagatcaataatttacttttaaatggttcagttaaatgaagagagagaaagagataaagcagatagagccaaatgtgaacaactgttcagtctgattggtgttattcactggattcttctggatgatgttctgtgtaattgaaaatgttcataataaaaaattaagaaaaaaagaaaagaaatgtaaacccttagacacactggggattctgactgaataggtctgggggtgaagcccagggcttaacctgtgctccaggtgcccccatcacatgggccagaggccccagccactttgccccagaggtcctcgccttacctgcctcctctccacctgtcagccttgcagtagcagaccaaaggggtttagtgtgatgacgcatctcttctaccaacctgggggaagaggtgtgtggggacagtcccccctcctatcccttcccccatacacactttcccttggtaacaagacctttgtttaaccacattttcagtgggtggcttttttatgtgcaggaatttttttttttttgtgataagtatttttttaaatgactttcatttcttttctttttttttttgagatggaatctctctttgttgcccaggccggagtgcagtggcttgatctcggctcactgcaaccttcatctcccaggttcaagtgattctcctgcctcagcctccttgtagctgggattacaggcacgcaccaccacgcctggctaatttttgtatttttagtagagacgagtttcaccatgttatccaggctggtctcgaactcctgacctcaggggatgtgcccgcctcggcctcccaaagtgctgggattataggcttgagccactgctcccggccccttaattacttcttcattcagcaaatattccttgggtctgtgcgtctaggccagggtttctcaaccttgacactgtggacgttagggtccagatgattcatttttatggggggctgttctgggcaatgtagggtattgagccgcatccctggccaccatccactagatgccagtggcaccccatctcccagttgtaataacaaaaaatgtctctagacatggccaaatgtcccctgggggtcagtattgcccccagttggttgagtcctacaagtctaggcagtgggatacatgttaggaccaaatggacaaggttcctgccctcacgggactgatttgagctgagggaagaggaagtagctgttggataggctgtgtgttgagtgaaaggatggacagcaaaggatgcacagcactggactccaaacgctggtcagggagggcaagaaggcctctctgaggggtcgcacttgagcagagatccgaatggagagagagccacttgagcacggtgggctgagtgctcagggctgagggaacagccagtgcaaaggccctgaggcagggcaggacaggaagcgtttgcggaaagcagggagatcggcgtgtgcaaagtagagctacccagagagtaggggtggggacaggtgctcagaggggcgcagggggcaggccatcctggaactggcagttgtggtgtcaaccctggattgtcctcagtgtgatggaaagccactggatgctcctgtgtcggggagtgacatgttgagactgggttaaaaggactggctgctgtcaggagcagagtcagaggtgggtgagaaagaaagcagggcagccagcaaggaggctaggaggcgaggctggaggccagatggggagtggccagggtgaccaggtgagttggactgaggagctaacctctttagcagcaatgttgtcctaggtgccagagtgggcccttggtgatcaaagaagcctggcgtgggagggtagtgtgaactacagggcaggacatggaggctgcagacgtgtcctcatgcatccggctcagtcgcagcatcacctttgatgggcggtggcctcccagggacagcagaggaaatggccatgcacattcccacatgacacctgaaaagctctctttcccgcttcttgtcgtggctgaagtctcccaagctgtcaggctgccggtggctccggtgattctggctacacagcttgcttgctgtcctcgggcccagcacatttgttcctgccactgagtctctgaattggctgttctctgtggctggagggtcaacccccacacttgttcccttgttgccttctccaagtggccctggtcgccctgcaccgcctgtcacgtgcgcttctgcgggatgcagtggcctgcaatcgggggttcatggaagcccctgcctgctggcttgccatcttcacactgttcttgacgtggtcctgccctgccccagggcctttgcactggctattccctcagccctgagcactcagccccctcgtattcaacagagagcctgctgttggctgggttgaaagtagatgtgagaccggagccttcctcacagaggggacttgaacccctcttgaagctgcagaagaggagagtcctggaaggctggggtcaggcccttgacctgccctggggacgacacatgggaacagcagggtcatgaaggagaggctgtgggtgggcgctccccctgagggtggtgttcccctctttccatctgaggcagttggggcgcccaggatgggtttggggtttgctgatgtgagagctaccccaacgctgtgtttccttatgggggaggctgctcctggtcctgggtgctgggcctgcggctcctctctgtggctgccgctcccctgagccttgcccgcagtttcgcgatgcttcccgatgggctgactgtgtcctcctatctcttggctcttcacttcccttctgggttgatttggctaaatatgaaagttctttttcgccctccactctaacccctggaggtgctggttgggtgaaaaggcctctgtggttagcagatagccgagagattgttcctcttagcttagtcacgcatcacaccagctcgccttttaccccaaacatggaattggctcaaatgtcagcccgtgtgttggtcagagtggcctgcctctcttcaccgtggcgtcccgggccaccaggaacagcacatgaacgcggttttgggtgccttccagcatttaggctttacacacttgccagtcacgagtggctcctgaaattttctttttatccatgagggggtgtgaaccttggataagcagaaaataggttgttgtggagaaaacctgtcagaaaatggtgaagggaaggccaggctgtggaggtgccagaagagcgagggatttcccacctgcactgtcttcagcagctgtgatggcttgaactgtgtccccaacaaattcatagattcaagtcctaaccttcagtacttcaagacgtgaccttatttggagatagggccttgacagaggtcatcatggtgaaacgaaggcatcagcagcgcgcgtcccttcatctcagacttctggcctccggaactgggagaaaacccttttctgttatctgagccacccagtccgtggtgcttggttacggcagccctagcaagcacgtgcagcagcatttttttgtggatgcatgagagcgcgacccaggggcctttaattaagctattctcacacggtgtaggagaaacgtggcccccagtgccctctccatggaggcacatggctctgggtcctgaggtggcagaggcctgcctgctgttgtggagaaaggcccctgggacctgggctggatccagctgccccctcactgtgtgtgagacttaacctctgtgccgcagtttgcttatctgtaacttatctgtaacgtgggcctgagggaggcggtacttcatacacgggggaagtgcttagaatgaagccaggtacacggagccctgtacaaaggcgttgtgactattattatgggaagaagtctctggggaaattccaaacccttggctcttggcaccagcaacacaaacacctcacagcccagccctcctgtccctgggatgggggtgtgagaacactgaggccattgtgtcacccgaggccacatgtggttggcctcatcctatttccaacacgtgggctgggtttcaacgtggaacgaatggctgcatggccctgggtccataggaagcctgccatggtcacacaacagctgcctagtcctatggaagccagactgtgattgaaggaacacagggagtgctgggggcagggccggggccggggaggaagtgggaggaggaaaaaggaagtgtctccgctggttcgaggcagaattttgaaacaggcacagtttctttctgaacatccttttgctctgagcttccccctgtttgaaactccttggtcgtgtggccctccacccctcactgggggccaccacctggctcccgtcactgtcagtgccttcctgtcttctcccctctggtgtttggagggttagctagaaggggtggaatgagtcctggccacctcatcatcctaaaggtgcccgcattttaaaagcaagactcaaaatgattacaaatgaaaatgaaattcctggggtttcaggcaaggtggaataaggcagtgaaaagcttttgtattggagccagcctccaagatgggcctcgaccatcctacctccaggtgttcatgctcatgtgtggtcccctcccatatggaaccattcagggctgacctgtgtcaccaataggataccgtggaagcgacagtgtgtgacttccaaagctaggtcattagagaccctcctggttctcttggaccaccccctctagagaaagccaactgccatgtcgtggggacattcagggtatcctgtggggatgccagcgagcaagttggttgctatgtgagggagcccccgtccaactttcagatgacagcagccctggctgacatcctgaccacaacctcctgagagacgctgagccagaaagacccagccacactgctccccacttcctgacacatagaaaccgtgtgaatggtcagtgtaaatggtaattagtgatgcagcttcagataactgaaatgactagtaatggtccaaagctttcttggaggggaggcccagtgctggtctctccttgggtcagctccccaggctctggccatagctgccttcgttttgccccttctgaagctccacttttctctgatcgttccatatttgttcatggtattttctctctctttccttcctaggttggagaggagaggagcttcatgcaaagtttaggtctattgatgataaattagggcatattgaggatgagtttggatatatagatttttagtaaatgggcaacggtctgtatttcatgaaaatgtatatcctgtgtatctctttatagcctggaggcttcagtaaaatattccccaaatgccagtggggtttggctgtctgggcgttactttgggcattcggcctttgcagatgcgggatgtcatttttgatgcgagcagcccccttttcctccagcaccagggaaacacgccacagcctgtaatgcaatgtggagcccgtgtcctctgcccgctgcacaggggatttgccaactccagcgcctttgctttgtcagggctttcagacttctgacctcaattatttcagtgggaggtcatttttgcaagagaggatgcaatgggtgtttgaaaagagaaagtatttcacgggcacttcaaagaagtgttgcaagcatgccaatgaaaaacctcacttttgtaaagtgaagcagtgagatttaactccagctgatggcttgtttgggttgcctttggtcaacttttaattgaaatccatgtgcagaaaagtgcacaaaaggtaagcgtgcagcttgatgaattgtcacaaggtgaacacacctgggtaacagtgcccagatccagaaatggaacatgaccagttcccagaagccaccctcatgtccccttccaagggtaactgctatcctgaataacgccactggttccttctgcttgtttggaactttatagggatggaatctcggatccctttgtgtctgcttttctttgtgtctttcttttacttgacattaggcttgtgagcttcattcttattatgggatggagtggtacctctttcctcctcatagccctgtatagcctaatagctttctttgtatgtaaagtgtctcttttctgtcactgcttttaagagatcttctttttcacttgtttaacagttcgattatgctatgccttggtgtagttttcttcatttttttgtgtgtgcttggggtttgttgagcttcttctatctataggattatatagtctaatagtttaaatctttgtgtaaacaagatttcctatattgaatgttctggtcagtgtatctacatttatttccgagaaacttcttgagagagcttaaagggatttttaaggcagtttccctctcaagctgtcacctcctccacttggataaaaacagtgaaggatttgtcttgttgggctgataagaaaccgtcagcttgtggtgcttttagcctctgttatgggtccagagtccactccctcaggctccattgattctgtgtcgaatgcctgtggctggatatcaggaggacacctgtttttgtcagcccaactcttttcatgagtgaaaagtaacaagggaaacaagatgaattcagaaaaacaaacaaacaaacaaacaaaaccagtaaggaaaggcaaggtatgcccctcagacaggcattgctacaaattattatcatgtctttaaaaaaatattttctgtttttctttttaaaattttttaattttgctacaaattataaaactggtgggtgatggtggacgtttcaaaaccactcacgtgtgacatggcagtgacttcaggctggcctacatagccttttgttctctgtacatgtacagataaaaatctttcttgattctttttttttctttttcttttcttttctttttttttttttttgagatagagtctcgctctgttgtccaggctggagtgcagtggtgttatcttggctcactgcaagctccgcctcctggattcaagcgattctcctgcctcagcctcctaagtagctgggattacaggcatgcaccaccatgcctggctagttttgtatttttagtagagatggggtttcaccatgttggccaggctggtcttgaactcctgacctcaggtggtccacctgcctcggcctcccaaagtgctgggattacaggcatgagccaccacacccgccctcttatcttgattcttgagcatgtctgtgcagtgatgtccaaagcattcaatagctgactacttgatagggttttatatctattgatggatatagtattaataacactccctgtagaatagaggtagtatgtgtgcctggctaagctttttgtggcttagtggacactatttctatatagcaacattcagcaaacacttcattttatgcaggtccggatagtaaatagagatgagtaacataagcctttgccctcaaggagctcacagccaaatatgggaggaagcatgtttgtaaataatcacttgaacaaaatgcagtttctaaataagattgatgttaaaaatattaatataaacaatattaaaattttagtgattaaaacacaatggcaaggatgcaggtcatgaaatgagtggaaaataggaagggaacaaaaggttatactaggccagtggctcttaatgtgcgcccttggatcagctgcagcagcctcccttggaagcttgttagaaatgcagattccccggccccatccaagccttgccggatctgaagctctgagggtgggacctgacagtctgggtttccccagccctcctggtaatgctgatgcacgttcaagctgaagaaccactggtttagacggtgataagccaccagggttctgtcgggaagcctaggacaggccattttagtgcccacgttgtcccctaattgccagaagcctcagcacagcttggacccttttgttaggggactgatgtatgtcggcaatcaataaagtatattagggagtttttctgaattttttttgagacagcgtctcgctgtgtcacccaggctggagtgcagtggcgcgatctccgctcactgcaacctccgcctcccgggttcatgagattctcttgcgtcagcctccagagtagctgctgggattacaggtgcccaccaccatgcttggctaatttttgtatttttagtagagacggagttttaccatgttggtcaggctggtctcgagctcctgacctcaggtgatccacccacctcggcctctcaaagtgctggggttacaggtgtgagccaccgcgtccggctctgaattcttaaatgaagggaaagttttactttgcccaactagtacagcttactactttatttcttttatggattgtgtttttgatgtcatttctaataactgtttgcctagccctaggttttgctcatttgtgtaggagaggtaaagatcactcacatgggtttacacaggcaagggcataactggctgaagaaatataaaatgccatgtgatgctgccttcgtttgggtccttgcagaagtggaacttgaaattaggtttctggtgcaagttgatttgggaggggagtggggaagtgagaccaggaaaggaaggcagccattagggccgggctgttaatgtcacgcaatgggcgactggagcttaattccacactttggaaactctaggaaatggtgctcgctgtgtcatgggcccccaagatcacctctgggtctggtgatttcctaggagggctcataaaacttgacacatggcatatgcatggctatgatttagtaaagcaagaggacacagagaaaaatcaacaaagggaaaaggcttatggggtgaagtctggagaaaagcaggcacgtgcttccaagagtcctctcccagtggggtcacacagaacatgcctactcctgcccatggtgagttgagacaacatgtgtgaaatgtccaccagggaaggtccttagagactcagcgcctgggatttgtattgggggctgctcacataggcaccctctgcctagcacacatcaaaattccagactcccagagagaaagcaggcattcagcatagatcacagtatttggacaaagagtttaggcacagtgagccactcttaccagctctgggaatggtgggaaccctcccaaaatacaaattcccagatgccagccaagggccaaccttgcaaacaggcctttctaaggagagcagtctcaggtctgctatattacgtgttttctgcacaggtacaaagcacatgccttgaaataatctcattcaagggacaagggagtaggacatttgaagatgtctggttttctccagactttgccccgcaagccttttccctcgggagtcagttcttgagagtcatcgattaatacctattcccaataatgcacttcaggcatgccatgtaagcagagccaccttctgtgggtctcaaaacaatgacagtgaccttagactaagcgatatggttggaaattagctagagcttactggaaggttttgagtgatatgagtggggcgctggcagcatcagatacagtagttattctagaaattggatggggacaacagagccatgtgtatagggtagttcgcatgcctggggtcgtgtggcagtattgtaactgtgaatgaagagaccgaggtcaaggcttcgctctaacctccttaggtagatgcttccttcctgtgtctgctcattggaggaatgggaaagtgtgtgtgtttgtgtgtgtgtgtgtatgtgagagagagagagagggcatgcgtgtgtgtgtgtgtgtgagcattgtgggggcagaaaatcctggtacactagctgtattttaaacttccacttctaatctttcagttctgagcagcgtgaataggcagataaacaaatgtttgctatagcctcaaacattcatgccagaacatttttttccctccttccacacaagtaaattaagagaacagcggtctgttgtataatttgaagatggctattaatttgtgttggattgcatttcttaagcatgttatgttattcgaggagcaggagaccctggaggaggcgcttgtggggaagctttgaagctggagcaggaaggagtgaaatgacacagtctgatgacgatcacggtaatgcaggccttgcagcctggcgacattcttcaaaggcaactaactgcaagactgccctcttcccctcccctctcagacatctccaagaccctgccaaccgccagatgaaaccaatcttcctagagcctcgtgtggtggtctcaggcatcgcttgggagtgccttagaaattcggcgtctcaaatgcagtcttgggccacaccccagctctccaggatcagaatctgccgtttaataagaccctaagggatgcatggctcatccaagtcggagtcagatctcacccgaggccgcacattggcagcacctggggagcttttaaaaatgctgatgcctgggcgctgcctcagggaccccggtttaatgactctgggcggggcctgctccttgggctttctgaatgctcccacgtggttcggctgcgcaccccgggctgggaaccgtggggttccctggcagtacccttctggaattctccttccccagcctcccagtcacgtgactgcttaatctcctccctctgtggctctttctctgtcctctgctcctggctccccgatttctgaaggcagcccggtctcttttctttctttgttacctcctggccattctccaaagtgcctctgcgggggcgggagcttgtgagaaattcgagcctcagccatgccccagacctgctgaatcagcacctgcagtttaaccagaagcccaggggatgcgcatgtgcattgtcatatgagaagcgctggtctaggtgacgtaagctgggaaagaaacccagggaatctgctggaatgtagggagcctgggctcaggaactggaaggcgtctgtctgggtctctggcttgtttgttttctagctgtctcaacttgccactgtggtcatttggggctagatcactcttctctgtgcgggtcgtcctgtgcatttaggacgctgggcagcatctctggcttttacccacatcatgccatagcaatccccctccccagaggtgataaccaagaatgtctccaggcattgtcaagcatcccctgggggcagaatggtctctaggggacactttggtgtctgcctctggcctcattccctcccgccatacacccttggtagggttggtggttccaagttagccactaccgtggaaagagagacttcctttctccccctcgtccatgtgtgcggccctgcatgggtcccacgctcatccccatagccggtcattgtgcctggtggtcggggcactgtcattggccagattgggttctgtgccacatctggggccaggggccagctttgttagcaattgaaggagactgggagagttctgatggaggcacaaatggctattttggaccactctagcagccctttacggacccaagtcctccgctgacccttcacccaataacaagctcatttagcaaatatctgttatgtggcaacgaacagctgggccctgttccagggcgggcattttataaacagtcttcaggaccatcctaggaggtggtcttgttagcccatattgcaggtgagcagactgcagctcagcagggctggtgacacccatggcaacctgcggagcccagttgctccctaattccccccaccctgtgccctgctgtcagccctacctttctgtcacccccttgagctcttcctcccctccaggctgccctacactgccatatagctggacgaattgtaaaaggaacactgtgtcatcatgcctctgctcaagtcaggaaagactgttgctgctgtcatcttttgtcccctccccagtcccctcacctccctgcccctcagaatactctcctgacttctattgtgtttacgtctctacttttcattgtagatttaccaaagaattctggttcctgagctttgttaatttacttctgcccgtttttgaacatgatgtaaacgggatcacacagagtgtttggatgcatccggattcttttgctctgtattctgtgtttactcattgcaagcatactttgggaagtgcttgagtcaaagggtgggtagatgagaagccactgaaggtgacagaggaatggccgtgggtcagagagggaattaccttggcattacttgggcagagctggagtggtgggctacgcagttaggaggttgcggtgacctgggtaggagctccagcttagggtctgaaggccgtggggaggatggcaggtgaggcgtggtaggtttgggagggttgtcctgccttctctttctgacgaggtaggagttacaggttggaggagatggaaaaagggggaagcattcctcatacaggcttgttggaccagcaggagctgaaccagcagtcgtcttgggttgcagtgaagccccctctgagactaggggctcccagcaccaaggaactggcagccagcagccagcagccactgaggccagcacctctcgtaatccacaaggttggaagaaaagcagctcggtaaaggctgcttgtgatgagtcactggggctcctggaaaatctgtaagaaatgaagcttttgagatgtttatttttagctgccgtctgaccatggcctgtctctgaacttgatgttcttgggccctctcctctggctgtgtgttctagaatttctgttgtgtcctatgcttttcatggtgtcatgtgaacactacaggtaactgtgatgatcttgaacactttgttagcgctatggtatgatcatatttttattcatgagccgaggcacccggaatcttgaagcattcggatcactaattacttggagaaacttttctgattgtaggatctcacagaaacctctctctctctctctcccaccctctctctctctttctctctctctctccctccctccctctctctctctctccccctccctccctctccctctctctctctctctctctctctctgtgtgtgtgtgtatgtgtgtaataggaactcatctttattttcccaaagctttaaggttgaaatgttgatggtgacatcctttagttgcattgttgggtttctggaaactcattccttcccttaaataatcctaaggggaatgactgtggccacttgtctttatattatacttgtccccgtgggtcacgattatttgtttgctgggttttgttgggaggtgagggccgcaaatgtgctggtagctctggtgccttggacagtggcctggcaggtagcagatgcccaataaacacccatggtgtaaagcaggggccggcaaagcacagcctgcaggccagatccagcctgttcctgtttttgtaaataaagtgttgtcagcaggcagccacatcccttcatttccatattgtccgtggctgctctgctgtacaatggcacagtccagtaatcgcaatggagactatatggcatatggcccgcgaagctgaaaagatttcccacctggacctttctcagaaacatttgcaaactcctatcagttaagttactacgaggaaacaggaaggagcaaggggcaggaacagcttgtgggagaggctcatgagagccggaggtggttttagtagcagtttctaccctgcccacgctggcaggggaccctgccgggacttgcctctagggtggccttccttgcttgttggagactcttaatcttttaatctgagttatgactttccgttccatctgtccaagtcatctggggattagctaatagagcaagttggcaaataatctgacatggtctgatttgggaggggaatactggcataaacattggcaggtactgtggcacctggccactgctgggcagaggacagagggaacaggtggaagggcttcaaccacagcgttttatggacggtgtaaatactgatggcagcacaaagtgtaatggctccagatgggaaatcacccaagtgtcacccgcagtagaatggataactacattggggctgattcctcagtcaaatactgtgaaacaggagtcggccaagttcgtgatcctgtgggccaactccagctcactgcctgctttcgtacagcttatgagctaagaatggtttttgcatttttatatggttgagaaaaaaccaaaagaataatattttgccacacatgaagatgatatggaattcatatttcagtgtccgcgaataaagttttattgaaacacagcaccaggcattgatgtgtctatggtctctggctgctttgcaatgacagcggtggagctgagtcgtctagacagagactgcatggcccagaaatcttcaaatatttactctctggcccttcacagaaaaagtttggtggcccctgttacagtgcaaagagaatgaacagatagttacactgaacaacatgggtagatcttgcaacataatatagaatgaaagaagctggaaacaagatttcatttctttaaagttcagaagcaggcaacagtaatctatagtgtgagggttgggatagtggttaccctttggggtgggtcagggactagcgggggcttgaagtggtgtctaggggctggtcatgtttcgtcccatgatctgagcactccatacatgggtgagttccctttgtgaaaatgtgtggagctgttcatctatgatttttgcattttacgaatacatgtttacttcaataaaaagcttactcaagaaaagtgatttcagtctggcagctcctcagaaggttaaacagagttcccatctgacccagcaatccactcctgggcatatacccaagagaaatgaaaacatatgtccatgcaaagacttgtacacagatgttcctaacagccttattcataatagcccaaaagtagaaacaacccaaatggccgtcagctgatgagtggataaacaaaatgtgatacagccacacaatggaatcttattcagcaataaataaaaaggggtgaagcactgatacgcaccacagcctggatgacccttgaaagcattatgctaggtggaagaagccagatgcaagaggccacatactgcatgattccacttactgcatgattccacttatacgaaatgtccagaataggcaaacgcataggatggaaagtatattagtggctgcctaggctgggagaaggaagtgattgctaatgggtagggggtcatttttaggggggtgaaaatgttctggaattggatagtggtgatgattggacagccttgtgaatttcctgtaaaccactgaattgtacactttaaaagagtacatcttatggtatgtgaattacctctttaaaaatgctgtaagagattgctgctacagacctgtgtgtatctgtacaagtcagaaggaaaaggtctcaaggtgacagccacctcatccattcttcctgctactcctccaaatgcagatatcttgaaagttgacaggcagggggaatgcctgacttcccccaggtaatccagactcttcctctagatccaagccagttgagtagcacagagcagtttctagaatgtagctaacatgggcatgttaattttgctacttttgtttactaaaactgcagttctcagaaaaacaggataaactaaaagatcctagataacttgcttcctggacttttcctgtgattatgcctgacttcgcccccattttcctgatgtctgttttcctttggtctgattggagaggaatgggaatctatgtagtagccactggggcccattcccatagctgagcctgggctgtcggctccttgctggttcctccaagacttcattgcttcacagccaatgaaatggagcagtaaaaaaacaaacaaaaaacaacaaaaacaaaacaaaaaacaaaacaaaaacattaaaaaagacttcactgcttacctgtaggttgctttttatatatagttctcaatctcttctgaattaaacttcttggtccccacttctagatgttaagggccataatggttgcaaatattgtgataacttttgagaggatcccttttgagggtgcgagatgactacccagaggatctgaaggttttcattttgctgacactgaagagtgtatttcttaggattttctgctctgtaatgacagataatcacagctggcagtgaagatagcgctgaactttctgtaaagtcccagccctaaacattatctgtggcagagacaaacagttttaattaatgacaaaaggtttgcttgtccctgcgagggtgaaaggggccggtgctgtttcattccctgtgccatgtactgggctgaaggggcaggggagggagcatcccagggtcctggcttttgagagaggggcagagagggtcagctgtggtcacacacccatacttgggagtcgtacaagtctcttggttagtggtcttgccactttgaatagaggtatttcagatttgaaagaaaacagtctaaacagtctcctcaaagtaaatgctttgaggagtttttaggaaaagctatttcgaatgtcaggcatagattcatgttttaatggcctcactgattcttggtaagtggaatcccccagaaggtcccccagaagctcagttggaccaccacaatctccctgaacagaactggagtccatcaggtcccctctatcagttacagaaagcagaggagtgagcagatcaacctcagaaacaaggcgacatgcagggggataaggaaggggtgttttcatgaaacatgattttcattttaacaaacatttatgaagcgctaaccacatgccaggcacaaattgctttacaaatgtcagctcattccgtcttcttcacagcaccctgaggcaggtagtgctgcaattcctacttcatagatgggggagactgaggcacagtaagaaaggtccaacaacttgcttaaggtcacacgggtggtaagtggcagagctgagatctgaactcatgcagcgctgttctggagtctgtgttttaaccagtatgcgtgtgatgctgcctctcttgtgatgaacatcagaatatagagggacaaagtacaatattgaagatccaaatatctcatactgccaatttgttttaaaatacaactacgaagaaaacataccaacaggttatgggagttatcaagggcatgatgatgggtaatccttattttttttcttgatagttttctgtatttgtcaagaagttttgtaagttgggtggttggttgtgtgttttaaaaaaatagccacaataatatctctgacttcggaatgctcatctagaactttgccatttcctcatcaagaggtagagtctactttctctctccttgaacctgggtgggattttgtgactgcctcaatgaacagcaagtggcaaaagggacggtatctgacttctgaggctgagccacgcaaggtgatacagcttctgccgggtctctctctcttaacacacttgctttggggcccagagcctctgggtaggatatactgccacctggccgggcgcagtggctcacgcctgtaatcccagcactttgggatgccgaggtgggcggatcacctgaggtcgggagtttgaaaccagcctgaccaacatggagaaacaccatctctactaaaaatacaaaattagctgggcgtggtggtgcatgcctgtaatcccagctacttgggaggctgaggcaggagaatagcttgaacccaggaggcggaggttgcggtgagctgatattgcgccattgcactccagcctgggcaacaagagtgaaactccatctcaaaaaaaaaaaaaaaaaaaaaaaaaaagaaagaaagaaaagaaaagaaatactgccacccaaagtcacatgctgaagagaccacatggggatgccacatggaaagagagagaggcctgggaaccccagctgttctagtctccagctgttgagtctcttggcccaggcaccagatgtgtgagtgaacaagccttcggatgatgccagctccagcccctgtctgaccaagaccttgtgaaagaccctgggtgaggatggtcttgctgagtccaatgagaccccagtaccaggatagataaagatatgatgggctgcgtgcagtggctcacacctgtaatcccagcattttgggaggctgaggtaggaggattgtttgagcccaggagtttgagaccagcctgggcaacatagtgagaccccatctctacagataataaaaaaaaattagccagtgtggtggcatgcatctgtggtcccatcttctcaagaggctgaggcaggaggatcgcttgagtctgggaggttgaggctgtgttgagctgtgattgtgccactgcactctactgtgggtgacagagtgagaccctgaaaaaaaaaagaaagaaaagaaagaaaaagaaaagaaagaaaaagaaagaatcctttggaatggctaaagaagatgccccaactgtgtctggggaaattaatgcaagttccacagatagggtgaaacagaacagggttctgcagtgtgaataggagctttcaaggcagaggagaaggttcaaggtagaagagaaaagcacattcaaagatacgggtttctacctgacatttttggtcaaacatggataaccatgattcacctagggtagcatttttatattcagccaagccttgattctacttagaatctgtccttctagatcttgatctaggtgatttcctgctttctttcatcttctagaacctgttatgttattgctaatacccaaccataaaaagtccaggtttccttcgagtgttacagatccctgttctgagagcgagctgacccattcagagtcacttttaacatcagagctgtaaatgacatcattaatactattgtattaatacatgcttgtcttcgttgggtcctgggtgaagtgagttttactggacaggatctgctgttgaagaacttgagcctgattccttggggtcttcatgcttggagaccaaacctactgatacttttttgccttgaggcattggttgcaagatataggtgtcctgcattccttccacagttcctttggaggcaaataatggttgtgtaggagagatgttctcttgtcaggcaggatacttccagcctgaactgaggcaaattccactccaccctctcactattggtactgtcatgtatggctgctccagtcctccccagagttggtctgcattgctccagctaacttgacctgtcttccttccttcagagctcaagttcattctacctattaacccataattatcatgctgctgaataacaactccttcaaaggactcagtggcttaaaacaacaaccattcattattttcacaagtctacaggttggctgcatggttggatggggccaaagttggctgatcttggctggactcacacataaatctgtggtcggctggacctagatgattttttccccctttgagatggagtctcgctctgtcgcgcatgctggagtgcggtggcgcaatcttggctcactgcaacttccacctcccaggttcaagtgattctcctgcctcagcctcctgagtagctgggactacaggtgcctgccaccacacctggctaatttttgtatttttagtggagacggggtttcaccatgttggccaagctggtcttgaactcctgacctcaggtgatccacccgcctcggcctcccaaagtgctgggattacaggcgtgagccatcgggcctggcccctagatgatcttttaatcccaacctcacaatagacaccaacacctccttctgggtccccagggaagtcctctgaggctctgcagatcagagcctgtttattttcctcaggaccactgcatgttccgtcaaagtttaaagatatgattgctctctacagtgattttttgtttcaagcattattgcctgaagtagttgtttgactagagatgtagttaaattttaggtggtatcaactccttttgaatagactgtccaagtctctgcgattctatctgctggttgggtttttctgacaagggctctcttggagggtcaacagcctgtcgtcttgtttttcccatcagagattttctttcccacatatattaagaggttattttcatgttgtttttgtatacatgagaatgaaatctttgctttctaattttactctcttcctcatatcattggttgctactgacttctgcgatgtgattcttccctgggcactcatcagggggtattattttcaacttggcatggctcaaacctcaaacttttaaagttttaaagcagccgagttgcactgatgatcaataaatcaatcactgtgaccactttattgcttgtaaggtgattaccctactttgcccatagtgactcttcaatttgattaaaatgcagtttcattgggtcgtggttgagtcctctagatatataaatacatgagagaagcctgcactcaaatgtttttataaccacccttcagatttttaaccatctatgccagcacttttgtggtcctcatcctataattcaaatttccatgctctttgccaaagtaattcttatttatgcatattccaacctcttgtctctgtaagactgtattcttttttctgctaactggtggtgagccttggtcccactgcaaagcattttctacagctgaaatgagctcctgtgcaatctgtaaatcaggctctgatggtgggagaatatgggagatggtgttggttcactcgcgattgttttccaggtgaggagagctggaatagtgggagtagaattattatcttggataggaaaggaagacacattcaactgtgctactgccctggcagcaggagcccttttgactgcattttaagacattaaaaatgagcatctgtcctggagctccttgcccagggcagcgtgccaccagcttctcatggctcttggctcgcggcaggttgtcccacctcccttgtccagctccagggtggccccactcacatagagggctcctgccatctgcagattgcctgggctcccaccaactcattaaagtcttgccagcattttcactgtgccattggagtacattttgaatatccatgatgacaatcacataggctgcctgcctgagtggtccactttgtctcccataggaaccaattattgctttgattaccattattttcatttaaaccctatttgcccctccagccctgtcatttggacaccttgcttttgcagaatgtgaggttttccaggaatgtatataattaattaatcctcatttgcagattccatatttgcaaatttgcctactggctaaaatgttatgtgtagccccccagatcaatactcgtggagctttcgaggttgttcatagatacgtgtgtgtgtagagcgacaaaaagtgccagcagtgcccgttccttgctgaggtctgagaaggcgatgctctgccttcctgcttccactctcctcctgtcaacaagggtccttttcgtgttctatttagtgccatgtttttcacagttttgtgctttttttgttggtaattttgctgtttaaaatggccctgcaatgcagtgctgggaagctgtctggtgttcctgagtgtaggagggctgtgacatgttttatggagaagccttgttcaggcatgagtgatagtgctgctggctgtgaggtcaatgttaataactcaacaatatctattagagtgtctttaaacagaagtatataaacaaggtacatcttgattgtttgatgaaaatgtgaccaaagattttgcaggaacttaaccctgtattctcttgggaacagtagttcagtattcagtaattcagtgtttgaggtgactttatagagcataacctccacgaataatgataattgactgtgtatatatttcattacagcacagatgcctatgctgaaataatttttcttatataagaaaatagggcacatggactattcttcttgcatggccatggcatgtcctgctcatgtctttaacgaccggttttcttgcccaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaaggtaggtggcattccgaaaggacacactgcaaatggctaagccatgttttcattcaaaagttactgagctggggcttaggtccacgtacgtgtcatgtgctgggttagggtctaaagaagaaaagagccagtgggaggagcagatatattggcagatcattgtactagcaggagctttgggcaggacgttgtgtcatatggagggattgtggtgtggaggagagggaggggactttgcaggtgccatttctggaacctgttttctcatccatgaggatggaagtgattatgcctgaaaaggaaatgagattatgtgtatatgaaagcacatatgacagtgcctggtgtctagttggcaatcagtatatattttaatggaccacaatggttatctgtcaagtgctgtgggatcatttaggttcggttagggaagggtttttcagcaagggtaacatttcagttgggtcttgaaagatgactaagattttgctaggcagaggaacggtgaggattctaaacatcaggaatgccccccttttttaagtcacagaggcatgaaagaatctgatgtatctgggcaattcagggagctccgaggatctggtggaggattcctgcagagggagggatagggatgagtgtggaaatggaggcagcagggccacgtggggaacggccatgctggcggtggagaggagtttgcatttcatgctgaaagccacagaagacaataaagatgcgctgcaaagggagaaacaggaagcttggaaatgagtccaggagaccgaaggcagtgatgtgtaggtggagagaggggatcaggatggagaggtattttgaggcgccacggacgggattcaggggaggtgctggggccaggaggggaatggggtcacagaacaccaggctttggcctgatgaggatgatgcctttgatgcctagaggaagcaaggggggactggcagactgcggaggaggccattgagttctgtgtagatgcgttggtttgagctgcgctgcggatgggtgatcacaggtggcgagaactctgtggttcaagggtgagggaagggccggggggagaatgaggtccctgtgtgcaagtggaggctgaagctttagaaacagccacggtggcgtgggtgtgcagagacagaagggaagaggtagtcaaatccccaggcagtgcccagagttaccaggtccaggggaggcagatggggagcctgtgacaagaggggaccctgccaagagcagtcccctgtgaatggaaagggtgttgtgtaggggcctgctcacaaggtcaccctctatggagaggtcaggtaggaggcgagccagcggcatgggggctggcggtgaggggagagctgcttcagacgagggtgaggagtgacatggacagtgtgaccatgtcacatcgcctcacgagggctggcacgaaaggaggaggggaatgtgtagggagccaggctcagtcatgaagatgttgcagcctcttggctctgcagtgcaggaatgtggggtcgaggcagcattccctctagagcacagctcagcagactgcatcctgcgggccaaagccagctggcaccttgttttagaaataaagttttattggaactcagccatgcccatccatttccatatttttatgactccttttgtgctacagtggcagggttgaggagttgcaacggagaccatccggcccgcaaagcccaaaatatttactctctggtcctttacagaaaacatttgcccaccactgctctaaaaggccgtgagggaatgatgatctcagaggagcataggattctgttagcacagggaggtgtgtgtaggtagtccatctgctgtgggagacgtgatctgtgccagctaattctaagttcgtgctgctaaaatttaaccttgaaaacaaaaggaggagatgaagtctgtgtgaagaggctttttaatgaaacttagcaatgtaagttaagatagtaactcatattcagaatggagacaccgaaccaatgtcccccttcagcatagcttttaaatcatcaaagatcaaatcacatttagtatgttttttaattaagtgaattatttgagtgtgtgctcgaattctttggagacttttgtggcatctttatagctctgtgaactagaaagctcgtcgtaccgttgcggcacataactgaaagaatcacatcagtgggaatttagctgcttgatgacattcattttattttcttaattaccctgtttcccgaggaaacagtttcaaggaaaaaagcatgaattcgaaaatgcattcggatcagttgctgtatctgctttgttctagatcaccagcaagagcaaggagtccatatgggagttcatcaagagcctgctggatgcctggtcgggatgggtggtgatgctgctcatcggcctgctggcgggtacgtggatgggcatgcggcactcccgtgggaagctgcagaggccgaaacctcaaaacacgaaccctctgggagatttggaatatagcgcgtgtcgcttgtcgcttttacccctgtgggagggatttattacttgaaatatctaagggcaaaatgcatggctgtatatttaacctaaaatccatcatcaataaggcatgcccaaggcatgagctcaggcacaggcttctgaagagctgtgacgatagagctggtagcctttccacacagagcagagttttcttactataccggatttgactgaaaacacacattttttttggaaacggtcttgttccattgcccaggctggagggcagtggaatgatgccagttcactgcagcctccacctcccggggttgaacaatcctcccacctcagcctcctgagtagccaggaccacaggcatgcgccaccatgctcagctaatttttgttattttttcatagagatggggtctcactgtgttgctcaggctggtctcaaactcctgggctcaagccatcctcctgcctcagccaaagtgttgggattacaggtgtgagccactgagcccagccaagcacacattttatattcggttattcttgattatgtagatgacaacaaaatcagggactgttttatcttcaataacaaaatgtcatatgagattgccttttgctactactggtaggctctgggatgaactggaaacatcctgcaacagtcagcaccatgctagacacccacgggagctgaggcaggcccaggggcctccatcatcctgaccctcaggaactctgcatctttcctttttagaatcccaacaccgtgtttgcgagcagtagatgtttccagagtaaatggatgctatctggaggggaaacacgtctttttaatatcaaacgcaccagcccttccgggaaatagtttcctgaaacttatgtccttttaggagattgtgaaggttaatgtctaagaataaaaaatttggcatgacgaagaggtttccttaataaaaatcccctgcatataacaacataatagttatggttagagaacagatcagggaattgactagaacacaggcagaatatatgtagtaagtggtctaagaaggacagaacacaaatggggcacagatagagttttgtgattccaggggctttcagtttccaggtgatcttgatttattccctagctcatcggaggaggggcttggttgccagggaagggctctacctccctcacctgcctcagcattccgtaaagagctaagaggaatgctcagagggggagttctttcctactagtcacagatgctgtctgtccgtttctccaagcctgtccttcctttaccagtggcatttcccgtcatgtactggcagcagccagggcaggaaattagacttcattgtcacaagggattggacgaccaattttgcttgactgcttctataaaggcctttgaaggtgggccaggtgggagtttgctatgaattttgatgtccttatttagagtagattgataaaaccttatagtgtgtcatttttcttggctcgtaggaaggagaaataaatagggtaaatgaagaaactcagaacaggaatagatgttctgataacggcacagcttagattcattgactgacctaggagcccaactgggctgactttaatctgattttgaccagctggctttattatccacttgatttccatcagctctttcacgagggggaattaaaaacaatatgctgctgccctggcttcacttaaacagtatctctggagaggacctctagcttgaatacagcctgcccctcccctctgtgattgtaatgtgcagccaggggtgagcaccactggccaaaggagagcccatgcgcacgtcagcaggggaatacatgggagggtgagaatggggtgatgctgaaaatgaagggactacagtgttcttttgatttggatgcactttgaagggacagccagagagccacgtcccactcacttcccccttcctcgctggactaacagtggagaggacctggggtctcactgcctggccggctgtcccctcagtggctgttgtcttcggactcccctcatgggtaggcccacagcatctccgcatgtgcttatcagaagtcaccgctaggtgtcactgttggaccacgaaagaaagctgaggcctgctgaagcgcagtcagaaccagaatcagcaaggaagattgggtgtgcagtaggggggttgtgaatgaatgaataatgatgaaacttggggtgatcatcctgtttgcccctggatatctgcaggaccctcccatcttcttcaccttcttcttcaaatactgcacgatgtcacttatctgtggagtccaaaaaaataaaaccagtgtcatagaaacagagtagaaaggtggctgctagagggaggggtggggacaggatggggaaagagatgttgatcagagggcgtaagtttcagttagactggaggaataagctttagtgagcggtcgcactgcatggtgaccacaattaatgatcatgtattgtatatttcaaaattgctaaaagagtagactttaataatctcaccacaaaaataaactggggaggtgattcggttggtgcgaaggtaattgtggtttttgccattaaaataacggcatgatcggatctttaattagctcgatcaagtctttctataatgtatacatagatcaaaacatgacattgatatacacaattattatgtgtcagttttaaaaagttaaaaaatcaagataatgagctctttgcctttgtttttcctgtggaaaaacaaagaactgtggatagttctaaatttgacattaccggaccctgtggaaagacctcatgaaatactaaatattatggttcttgcgtgctgttgctagggggcagtgtttacttagctgactctgcaaactagcattaagcggaaccaagcttgcatccaggatttcatgatctagagaaaatactttgagcatgtaggatttcttttcactgggtttcagtttccaactttaaatcaggaaatagttttcaccattccacaaggtatatgtacttcaaaacatcatgttgtatatgattacaacatacaatcttatgtgtccattttaaaatgaaagaataaatcaggaaatagctaatgatatctctaacttaattagactaattatatatatttgtatatttggaatcaagtctttcattattgaattgcatgtttaaaaatttcaaacctgtctgatatttaaaatttaaaaaacaataaaattacatccctctctctgtaagcctcacctccctcacctgctctatggatgtatatatgtatgtatgtaaagctttattgaaatataactcacattccatataattcacccatttaaagtatacaattcagtggtttttaatgtatcacagagttgtacaaccatcaccgtggtcgattttagaataattttatcatgcccaaaagaatcattataccctgtagctatcaagcccctgctccccaaccatcccccttccagccctaggccactgttaacctgctttctgtctctatggatttgcctattctgggcatttcatataaatggaatcatacaatatgtggtctttgtgattaacttattctactcagcataatatgttcaaagtttgtccatgttgtagcacgtgtcagtacttcattccttttcactaccaagtacaattccattgtatggatagaccacacgttgtttatccacttatccattgatggatatttgagttctttctactttgtgactattttgaagaatgctgctatgaacatttttgttcaagtgtttgtgtgcatggatgttttcatttctcttgggtatatgcctaggaatagaattggtttttttgagacagggtctggttctggcgcgatcatggttcgttacagactgggcttgagcaatctgcctgcctcagcctcctgagtagctgggactataggcgcgtgccaccatatctggttaattttttttttttttttttttttttttttgtagagacaggatcttgtcatgctgttcaggctagtcctgaactcctggcctcaaacgatttgtccacctcggccttccaaagtgctgggactactggcataagccactgcgcctggcccttatactttttaacagagcctttaatatacttattttctcctgtcccaggtacagttacacaaaggcaggggcctgggtctactctttgcactgctgtattcccaagacatggatgagtaactgccgtgtagtaggtacatgttcagtaactatcccttgaatgaatgaatggacctgagttttctgattttttcattcatttatttattgcaatattttattcaacatggatatatagtgccaaccatgcacctgacatggatataacaatggacaagacagatagggtccttgcccacttagagtggacacagggtctggatgccaggcctgaccccccactgtggtatgaaaaccaaacaatgaaaccttttttacccaccacttatagactagtggaagtacacacacacacacacacacacacacacggagaaaaagagaaagagagctaattgtgatattaggatgcgagaggtgtggtgatggggaaggacaggcagccacaggaatgccagggaagtacacctaacccaggcttaggaaatcaggaaagacttcccagaggaggtgatataaatgctggaatctggatgataagtaggagtctgatgggaggggagggcagtgcttgctgagatggtgcaggtaggagagcgtggcacattccaggaacatggagtgggcagggtgtggggagttagtgagggaaagagatgaagctggagagatctgaggggccagctgtcagggtgggtgacctgttgaggatttgggtgttctcccaagaataatgggtaaccatggcagggctttccacaggggagtggcacaggtcagtctggcatttggaaagcctatttgaccacagtgtggagaggccatgaatggggcaggactgaggctggagaccagagaggaagctcctgcagcagtccagccagcaatgacttcaacacggtgatctgaaagacagcccgagtggggatgggggaaactgcagtgattcaagagagatttcagaggtggagctgctgggatatggggattgcctggaagggggttgctttcccagatttctagtttgcacagtagtgtgcctggatggtgggttcctctcccagttgggacgaagctgaggctgggaggaggatgctttagttcggtgtcggatggtggtggactgaagtggagatatctagtagacccaagaaggcaaatagacttgtgttctttgacaatgcccattcattggctttgactgcctggggctttgctacaaagatttgggagggtaggtccacaagtgtgtgtcatgattgattagtgatgtctgtcatgggcatgtcaaaagaattgtgaaggggaatccaatagagtgtgctattattgattggtgatgtctgctgtgggcatcggaagctgacggctgggctatgtagtgattggctctgtaatagccagtgggctctatgtgcttggaaaagcatagcttgagatgtacatttatacctaatggtaaatagtaggatatgaataaggttgccagggttgagagcatagtataaaaagagaaaagggtttagggtcaagctttgaggaaatggcctttagaagttgggtggaggagtcagaaagatcagaggagtcagagcaaaccagagagtgaggaggaaagcaggagagcatgatgtggaagccacgggaagaggtgtttctggaagggtggagtggtcaacagagtcagatgatgctgagagctctggaactggggtcagcaaactttttctgcaagaggccagagagtaaatattttcaggtttgtggcccatgtggtttctatctcagctcttcagttctgccactgtagcatgaaggcagccacagagtgcatgtaattgaatggtgtagctgtgctccaataaaactttatttacaaaaacaggctgtgggccagatttggcccatgggctgtagtttgtggatcctgttctagaggaatgagctaaggccattgccttagctgcatgggaatctcctggtagattgaggggatggactgggccaagggaaggaaagagattggatggtgactagagggaaagtggaaacagggagggttttttttttttaatgtttaaatgctgatggcaaggagaggaagaggttgaagatacaggagaaggaaaggggaatgggaagaacgaggccccatggaggaaggagatgtagagctgaggtgggcggtgtccgatgcaacaccaggagaagagaagggaggggtgagtgctgatgccaggtgtggatgcttttggtgaggatgtggatgcagaaccgatcctgtaataatgatgcagtgaaaaggctgaaaaatgaagatgcttgaaagcattctctgcctttgtgagagatgagaatgcattattctggaaagagacccaaggccgccttttgtgatccattcaactgcacattccgttttctcccatttctattggcttttaaaatacttatttagttttatagacccataattctttataatttaaataatgcagagagttttaataaacaggatcttcccgaatttggttctcatttggtggcaaaaccttactcatttatgatgtgaggccgtcgtagttgttatgagtccattttgtctgaattatcatgtttccctgagaaatattaatgtgtgtgattctaggatcctgccccagaagccattgagagagttctgtcttttacactataaatacccaatgtcaaaaacttggaaagggaaaaattgcaaaagttgcttgtctctcctacccagttcaagctactgaaccctttgtatttctcattgggcttgtgctgccttgcccataacataaatgttcaagtgctgcaagtttaatgaaagaagcttcctatgtaagtgacagccccattgcaagtttattgcctgctctggaatctgggccatcattgctgatgtgcccctgtctggccgccgtgttggtctcattcttgtcgcatcatggggcgattcctcttagtggctcgtgttacttcttccaggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagaggtgggtatttgggcagggtcctggctggggacccctgccgttccatgcgtgcttgggaatgctgctgggagatttgtgaatgtctgtgatttcaccttcaagtgcctgctctgaagttcgtggcttaacactagatgacgggctttttccagctctaatgctaccactcaaacttcacttgcaaaacccttccccactgtttcatgtgcacaatgcatatatatatatatatacactttaagcctcatatttggctttatcttgttatatttggctttattttttcttaccgaaggtggtttgctgatcatgctgaagaaacaaggttgactttgatatcttctaattgagaagaacataactttttaagttatcctttaaaaaaaacagctttagtgagataaattcacagttcacattgttcacccgtttaaagtgtacgatttaatgcttgtagtatattcagttttgcagccgttaccacaatctaattttagaacattttcgtcatcctttccaaaactctgtctccattagcagtcactcccatgtcccccaacctgccagctctgagcaaccactaatctaccttttgtctctctagatttgcctcttctggatgtttcatgtaaatgaaatcatacaatgtgtggactttgtgtctggcttcttccacctagcatcatgtttccagacttcttcctattgtagcatgaaccattacttcatttttttatggccgaataatattctattgtatgaatggaccacattttatttatccatttgttggttgcttttgctttttggctatgatgaatgatgttgctatgaacatttctgtacaggtttttgtgaagacatatgtttcatttctctcaagtatatatctgggaatggagttgctgggtcagatggttactctatgtttaaccttttgagcagctgtcagactgttttccaaagtagctgtaccattttacattcccaccagcagtgtatgagacttccaatttgtccaccttcctgtcagcacttgttattatctgtttttgattatagccatcctagtggttatgaagtggcatctcattgtgctttcagtcatcttccattgcattttatgaccacattatagaggatgttctgggccttctataaagagaatgccctaggcacaggagataatagtggtgaaccacagacctatagcatttagagcttcagatctttattaaaatcttagttcaggaaagagttaacttctaacccatttcagtggttaccaccatgactatgagttattaaaggatcagaaagccacgtgaggaggaaccaggttgtcaagcttcacattaggggtaatgtgaggatctctcaagctagaactaatctttcaaggtatatgtaatctatttatacatctcctcccttccccactttttttttttttttttgcctgactgacttaccacagctgaagacatttggaatgcactttgccatttttgctaaacctctttctcagtggaattgaaaattaattccttcaaatctcagaaggagacagggatcttgaaatctcacatgttctcagtgctctccattacttccaaaaagaaattctctacttgggttgatgggagcgggcagacagaattggctgtgcgccatatttttattcttctctcctacttgcaatgtgtgttttggggaaatacagccatccatcttttcagctgtttttaagatttatactttgattcgaagaattacctttagtaagagtgagagttatttttagcctccaaaaaagtacatatttaagtgggtgaaaggtatttcttagtccgatttctcaccgcatagggtgtgaatatatgtgcttgtaaaggccagagcagtctcctggaacgtgtttttgcatttaataggcacacatgtggctgtccatggcctgacttgtaggtgacctctcttttctgccccctttacttaagtaatccagatggtggcaagaagctgaggtctagagagtgtggtctgtacccagcagaccaggcctttcacgcataggaccccagactgtgtttttggttcagaaaaccttctccatacatcagataatttggaataaatggttcaatgaattattctgaaagtgatcacgtttttcttctctgatagtgcctctcaaatgttagtgcgcatagaacctcctggagggcttgttaaaacatattgacctgggccccagccgggagtgtctggtgtctggttcagcagttctcgggtgaggcctgagagtctgcatgtctcataagccactgatgtggctggaccatggaccccaccctgagcagcagtattctaaaatacaggcccgacccgtattcattggcagtgcgggtgcttgctgtgcttgggcgtggccttaatgaaagctaagagagaccaagccaccacagacaagacaaaactaatctgccagggtctcggaggcaggattttctgcatcacacctttgattaactctatgcaagtggtgattaaaaccaagcatcatccacggtttccattactgctgagccttccctgtgtagaaggcgcgtgtaaacagctcccagagaaacacccgctgctctgtttgtgtgtactgactgtagcaatagcaacagctgataaacctacgctggccttttggtttatacaggactgggaccaaacctgcccaatcccgtcaaagcttttgttgtcaagacagatggggaggggttgagtctgttgctcaggtcagctgtggctaatgtttccttttgtgttttgtgtctgttgtctagggtgccagtgcttacattctgaattacttaatgtacatcctatgggcgctgctgtttgcatttttggctgtctccctggtgcgtgtatttgcaccatatgcctgtggctctggcataccagaggtgagttctggctgatttttttggtaccaataataagaatagcaaattcttctgtagcactgtcatgccaagcacagttccaagcgttttacttctactaactcattaagtttctcaataagactatgacgtaggtactattattctgcatttgatagttgacgaaactaaagcacagagaggttaagtgacttgccccaggtaaccaagctggtaagctgtgagttgaacccagtgttctgacttcaggatttacacactgtcttcaagatttctgtgctattgcttctcagatgataaaagccttgtctttgtaaaccaggcataactcttaaagcctgtggaatcagagttcattaaccacacacataaacacgctgtaataactcatcagtgcatctgtgatgtaatgtgagagacgatagtggaggtttgttgctgtgaaagttcactgatgatgaaatctctcttgccatgttttgctcttctggtggcaagctaatagcaatcttttaaaaacctgaattctgcctttaatacatgtactgtgaacgtacccccgtgaatttcgagttcttataaatagttttcagcactttcatgtaaccgaagcatgagggaagtgacctcaccgattaagaggagtgcctgagaccaaacttgaaacctatgaggacctactgggcagaatcatgataattgagctgattcccgaaaagcccagatggtggaaattttagccagaagtaattttaaaagttctggtattatcactgtaatccatgcagttcagttctcctttgggttgatgccttagcgatgcacacaggcagtgggctagagagtttgaagatgtagttgtgggctgagtatggcagtaaatccacaccctttgggaggaccctgcagccctgatggtggtccaggcagtttgcagaaagggctgaagtcatgaaaagacaatcagaggcaaaattcaacatggtcttgtttcaggaaagatagaaaaaagaagtcttaatatgtcatgctgaatttttgatggttgatgttaacatattgcttcaggaacctgaaaaataagctgtattaccaacctgttttctcagcgcagccagttctgctataatgcaacatacgcattcctaaaaatcaccatgccatgcaaaatcacacaacagaaaccacagggctttatggggaacatgaattaggggcacaatacacaaaacttcatcactgacacatatgacaaaaagaggaacctagtaaaaacaggagcacagctgtacacattaagtggctaagaaatatgtaaataccacaataaatatgtcacttcctgcaaagaacttgaagtttgcttgtggaagtgggtgtcgcaagggctgcaacttacgcgttgctgtgaagggcataaggaaggttatctgaagttgtaggggaagttgagacagcaggcgtagatgggtgtggcaccctggcatatgtgtgaaccggtagatgtttgactcgtgtattttgtgttttcctacatgactgggtgcaattttctgcatttacctggtatttctcctggaggaaatgcgcataaatagacataaaatttgagttatgctcaaattcctccctaacatgagtggcattggaacaaatttgcattttctttttttctttttccttttctttttctttctttcttttttttcttttttgagacagagtctcgctctgttgcccaggctggagtgcagtggcacaatctcggctcagtgcaacctccgtttcccaggttcaagcgattctcatgcctcagccccccaagtagctggggttgcggatgtgtaccaccatgcctggctaattttttttttggttttatttttaagtagagacggggtttcaccatgttggcctagcctcatgtgatccatccgcctcggcctcctaaagtgttgggattacaggcgtgagccgccacgcctggccttcttgtttttttattgttttatatagagacgaggtctcactctattgcccgggctggtctcaaattcctgggctcaagtgatcctcccgcctcagcctcctgtggagctgggactgcaggcacgtgccaccatgcccaactaatttttgtatttttttgtaggtttttgccatgttgcccaggctggtcttgaaatcctgggctcaagcaatcctcccgccttggcctcccaaagtgctaggattacaggagtgagccacagtgcttgaggcaaatttgcattttccaaccaagtgtcgtagcagagctgactgtattttatttgatgtctaaaacatctcagtttgtgatcccactgcccaacagtaggcatttttgactcaagcattttgcaaataaggagatggccgatggggaattggtggaaaatagaagcagtaagaggcacactgggtagtcccatctctcccttccaagaactgtagatgtgtggctcagctggtgtccttatagacagggagttcgaatatcagttctatctttgaagggctggctggactttgtcatcatctaaattgggcattttattggtgatagctgaactcagaaggagtaaaatactgagttgaggatttgtttcttttcttttctttttttgacaaggtctcactctgttgcccaggctggagtgcagtggcatgatcacagctcactgcagctttgaactcccagtttcaggcagtcctcctgcctcagcctcctgagtagctgagactataggtgtgcatcatcatacctggctaatttttgtactttttgtaaaggtgggctttcaccatgttgcccagactggtctctaactcctgggcttaagtgattcgcctgccttggcctcccaaagtgctgggattacaggtgtgagccactgtacctagctgagcatttgtttcttatgtgacaaaagtgcaagggatacatagacatggatgaaattaaaaaatgtgatgttaagtgaaaaagcaagttttacaaggagaaagtatgattgatagaacgtctataaacagctaaaatgaaaaaacgtatgtgctaaaactatagagaaaggggaagaaatggtaggaagtggtgaggggaaggaggaaggttcgactggggaggcaaacacgaggtagccactcttctgtttcttaaacttggtagtgggcacatgggtactcgcttttattagtattcttttaactctatataagtgcgtgatggattcatttctctatttcctaaatagttcataacaatcttttaaagaactttcaggaaccaaatggaggtttgacccagcagtagcaaagtcttcatgttactatagtagagctggaaattcttaacataaggatacagtatttttcccagttcttggaggagagggtcagagtaaaaagtaaatataaataaataaatcatgggtaaaaagaatctcctcccagtcagcacccaactaaatatggaaactgacttcagttgagacatgaagctgttcttcattcattctagcaaagatattgactgaactatttggaaaacatgtttatcattgtctgaggtgatctgccataagctgctatatggcacactgtgtaagaatgaactttgactgtgatgcacttatgtatatttaaaaaattgctcatcctccctagcatttgtttctaaaacattttgattacttagagtgaaaaattcctttggaaacattttttaaaatgcaaatttaggtcaggtacgggggctcatgcctgtaatcccagctacttaggaggctgaggtgggaggattgcttgaggccaggagttcgaggctgcagtaagctatgattgcaccactgcactccagcccggacaacagagcaagaccttgtttctaaaacagaaaaaagaagcaaatttaaagaaggttttttttattttatgtaataaatgctctctataaaagttctataaagcacatttaaaggtgaatgcttgcctgtaatcccagcactttcagaggccaaggtgggaagattgcttgagcccaggagttcaagaccagcctgggcaatgtagtgagacctcatctctacaaaaaaatgaaaataagcggcagagtgtggtggctcacacctgtaatcccagcactttgggaggctgagctgggtggatcacttgaggccagaaatttgagaccagcctggccaacatggcaaaaccccgtctctactaaaaatacaaaaattagccggcgtggtggcacgtgccagtaatcccagctacttgggaggttgaggcacgagaatcgcttgaacctgggagatagaggttgcagtgagctgagatcacaccactgcactccagtctgggtgacagagcaagattctgtctcataaaaaaaaaataaaaatagccaggtttggtggtgcactcctgtagtcccagctactctggggactgaggtgagaggatcacttgagcccaggaaattgagactgcagtgagctgtgattgtgccactgtactccagcctgggtgacagagccagaccctgcctcaaaaaaaaaaaaaaaaaaaaaaaaaaaaaaaagagtgaatactcagcttttgttgcacgtgggacttgagagagaactgggtaagggtgtcctctttctacttgcttccttttgtcagtagaaccactgtcgtgtcaactatatgagaaatcataccctctcagaacttactctgtgttgatgtttcagtttattaaaaaacataaaacataaacactcttacaaatatttatttatcggaaagagttctggttttcaggttaacaccagcaagtcacaaatccgctgcagtacatctcgttaaagccctgctcgcttcagtctctatgaattcaaattaaagcaagtgattggattttgccatctactgggaatgaatttgtcttatttagtccctaatttgatcatgagaattttataaaatcatgttagagaattacaaaatacctattacattgttcaattcaccacatgtcatggctggcaaaggctcaggtaatttagatgcttgtaattttctaaatggtattacgcttttaaactatacccttgggtccaaatccacattaactaactgacaaaaaattatagataattttatttgaggcaacacaaaagggcagaattgtggcaggcgtaataaaacatcccttaaataaagggatctgagatcccagagcacgggctcaattaagctaactaccactagttaaggacgggtctaaccaccactagtttgtctgccacgagttcaaggctagttcaggaaacaccatctgactgtatagctaggagaccttgcacatgttctgtaggaaggagctcactgagtccttcaggaacatacacactcttggatgagctcacttcatgaccctccccaaatcgcccaaggtgacatgatgctcagtagaaggacctggtgaaagaacaaagagtgtttcacggctctcccttaaatactgtattgagaaataaggaatctctgtgctgctcttttcaggaatcaagcagtgctctccacctgggctgcattttcgagtcacctacagaggctgtaaaaatcctcataccctggatgcacctcagaccaattatatcaaatctctggggtgagagccagccagcagtgttttctaattccccaggtgactctgatgagtgccacggttgagaacgactgtagtagctatttgagaaactgattacttggcagagcaatgcccacaaggaggtgttttgaagttacataaataacactgacaagagataaccttgtcccattatgtattacataatgggaaaaccagaaattgaccacagatttcattgactgattcacttggtgtctaattaatctgtgattacaggcttgtaagttgctaacccggcagtaaacattcagtccatttcagccaattgggggacgggttggaggtagaaaagttgtttgatcattgatgatgcttctatatctaagagaataccattttggcaggggagaggcccttggtgtatgaagttaatcactgtgataggcacccagttgaattctaaaagcattaggcaaagactcaagtgaacgtttaggaagaaagccattatttggtatttataaaatgcagcaggtctggaaatggagcaagataacactccctatagtcaaagtcctttacaataaaagagggtaggatttgatagaagagaaggggtcatgatggattcaaacatctttacatcccccaaacatatatcattggaatgttgagcgtcttcttcattttctactgttgtattaagaatattttcaaacatacagaaaagttgaaagaattggacagtaaaaattcattaattcattgcctccagcaggggttggcaaacttttcctataaaagaaagagagtcaatatattaggccttggaggccaatgggcaagatggagcaactattctcaccagaaagctagtagtcttttttttttttttttttttttttttttttttttttacatactacttttaaaaatgttaaaactacacttggctcgtgggtcatacaaaaataggtagtgggccagatttggaccacagtctgtagtttgtcaacccctgacctaaagttcaactgtcattttgctcttgtaggggcaaacacctttttaggggtttgcggctgggcctgcgaattaaattgacatataagacagatcaacaggagaaaagcatacatgtttatttaatgaattttacatgacatgggagccttcataaggagtgaagacccaaagatgaagttagggttgaatacttatgtgctgaattggacgagtagtaatctatgaaagtgtgacgaggcagaggagcctgggctggggggttagctgggtgaagtggccaggaggatgagggttagtctaacaaggttggttcatgcagatttccctcagcctcaacttcctgtctttgatgataagaatgatgcttccttctagtatcggaagggcatctttcacatgggaatttcatctccagcttttaagaaacaaaatgggccagttgcggtggctcatgcctgtaatcccagcactttgggaggccaaggcgggcggatcacaagatcaggagatggagtccatcctggctaacagggtgaaaccccatctctactaaaagtacaaaaaattagccgggcatgatggcgggtgactgtagtcccagctactcaggaggctgaggcaggagaatggcgtgaacccaggaggcagagcttgcagtgagccgagaccgcaccactgcactccagcctgggcaacagtgcaagactccatctcaaaaaaaaaaaaaaaaaagaaaaagaaacagaatggtcaggtgatgttcttgttcttgtacctgctgtttttcaagagcctttaacccaaaatagtcagtttgccagagtggcatattttggggtggcatattccttttttttttttttttttgaaacaggatcttgctctgtcacccaggctacagtgtagtggcacgatcacggctcactgcagccttgaccttccgggctcaagtgattctcctacctcagcctcccaagtagctaggaccacaggtgcatgtcatcatgccaagctaattttaatttctttttttttttctttgcagagatggggtctctctatgttgcccaggctggttttgaactcctgggctcaagcgatcctcccacctcggcctcccaaagtgctgggattacaggtgtgagccactgtgcccagcctggggtagcatattcttaactacttcactctccttgccttgtcacatagtcagccagctctccatctcttaatctaggatatatttcagagtcaaaagttaacagttaacatcaataggtacatgtctcttctcaacataacaaaaggtaatgtgaacaggataaaatgccataaatcaagtgagaccttgttaatgatttattcagtcctctttaggatcttttggtactctaggactccttacgatttaccatgcattgagtttttaatatttcagttaatataaaattatagttaaatcaaaaatgaaaatggtttctgttccatgctattgagtgaatctaaactttgaacgtgtctctcagaggaattatagctcttttcctagccatggattgaaggagttcattccctcttgttctccatcctctgtttcagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgagccagctcagcttccatctgcagcgaaactttcttctcaaagccccctcctgctgtctgacttgcaggtttgcacgtttgttttcatggaaggccttgaagcttatgtagaactatttgttttgtaggtgctttcagctgcagcggctgct

SEQ ID NO: 5457 - DNA, 175324 bp, human; identical to SEQ ID NO: 2996

SEQ ID NO: 5458 - DNA, 232429 bp, human; identical to SEQ ID NO: 2992

SEQ ID NO: 5459 - DNA, 174863 bp, human; identical to SEQ ID NO: 2993

SEQ ID NO: 5460 - DNA, 438166 bp, human; identical to SEQ ID NO: 2995
  misc_feature (63089)..(113088): n is a, c, g, or t

SEQ ID NO: 5461 - DNA, 438177 bp, human; identical to SEQ ID NO: 2994
  misc_feature (63100)..(113099): n is a, c, g, or t

SEQ ID NO: 5462 - DNA, 222612 bp, human; identical to SEQ ID NO: 2997

SEQ ID NO: 5463 - DNA, 53630 bp, human; identical to SEQ ID NO: 2991

SEQ ID NO: 5464 - DNA, 17592 bp, human; identical to SEQ ID NO: 4275

SEQ ID NO: 5465 - DNA, 9740 bp, human; identical to SEQ ID NO: 4274

SEQ ID NO: 5466 - DNA, 16978 bp, human; identical to SEQ ID NO: 4277

SEQ ID NO: 5467 - DNA, 16940 bp, human; identical to SEQ ID NO: 4283

SEQ ID NO: 5468 - DNA, 3637 bp, human; identical to SEQ ID NO: 4281

SEQ ID NO: 5469 - DNA, 4371 bp, human; identical to SEQ ID NO: 4279

SEQ ID NO: 5470 - DNA, 16846 bp, human; identical to SEQ ID NO: 4276

SEQ ID NO: 5471 - DNA, 16199 bp, human; identical to SEQ ID NO: 4273

SEQ ID NO: 5472 - DNA, 6018 bp, human; identical to SEQ ID NO: 4284

SEQ ID NO: 5473 - DNA, 1413 bp, human; identical to SEQ ID NO: 4272

SEQ ID NO: 5474 - DNA, 2864 bp, human; identical to SEQ ID NO: 4285

SEQ ID NO: 5475 - DNA, 1444 bp, human; identical to SEQ ID NO: 4271

SEQ ID NO: 5476 - DNA, 2738 bp, human; identical to SEQ ID NO: 4282

SEQ ID NO: 5477 - DNA, 4029 bp, human; identical to SEQ ID NO: 4278

SEQ ID NO: 5478 - DNA, 8209 bp, human; identical to SEQ ID NO: 4280

SEQ ID NO: 5479 - DNA, 586057 bp, human; identical to SEQ ID NO: 3046

SEQ ID NO: 5480 - DNA, 586057 bp, human; identical to SEQ ID NO: 3046

SEQ ID NO: 5481 - DNA, 23297 bp, human; identical to SEQ ID NO: 4293

SEQ ID NO: 5482 - DNA, 25831 bp, human
gccattgtagagaatccaagccgagtttaagagtgctgtggaaatacactgctgctactgctgtttctattactgtttgatgctgggactcttatgctccaaccacgttttcacccagctgagtcgccttcgtatcacgcctttccagtgagtaagatcatctagatagattctccaaaagaaataacccagtaagggaggggcaaccagcatgaccacaatgctagttgttgtgtgcgaatggtaaacagaatgaaattatgaatgtgtgtgcgggtcattatatgcatgcagacacatacatatgcatatgtagtataaatctccataaatgcctaaggtgatggcagtgatgaggggcagttaaaaatgttaagcacaaattggagctgagacactgatcagagaaaaattatctgtaatactgagaaagagccatctgtcatggctggaggctcaagcagagaagggataagtggagaggccccaggaacagatggagaggcttgaacccccacacagagcagagcgtccaacagctgggactgattaatccagacggccgactattacgtcatgtgttggattacaaccaaatgagtggctaaaagctcctagcaagttcaggccaacacgaagtcgcttcacagatggcatccaccttggaattccgtgagggatgaagacactgctcagtcctgcctcattgtcctctgtggaaagagcaagaggaatgaggataggcctttcccacccctttattcttctttattctcagggtaaatggaagtagagaaggagagtaagtgagattttaaagaagctttttgacctgtgtctttgttctctccttgctctctaaattacatgatagagggaataataaggaactttaatgtatgaagttcagtccagtaaattgatcccatagcccagcatgtgataaacagtttctgaatattaacttgatctactcgtgcttcttagtaatcccacaaacactttaaacaacatttcagaagcacaggtaatcccacaagcatttcagcaacatttcaactcaacacctgtcccctctccaatgttcccttcaagtcagaaacctaactttgggtacccaactctaccgtcaatcagtcactggggccttatggaatcaatggagtcttgtagattccatctccttagcattgcttgaaacgatcttgacttctctattctcattgctattgccttaattctgaccttcagtaagtcctgcctggaccgttacaatagtttcttctaagctatcttctggtttctttgctccagtgcattcttttcttttttttttttctgctgacacccagcactttattagtggggaaactcgccttggtctggcagagactgggatggacaggaccggcgcccatctcgagggggtattttctggaagatcaggtgttcctcccttgtaggtttagaggaaacaccctcatagatgaaaaccccccagagagcagcactgcaactgccaagcagccggggtaggaggggcgccctaggcacagctgggcccttgagacagcagggcttcgatgtcaggctcgatgtcaatggtctggaagcggcggctgtacctgcgtaggggcacaccgtcagggcccaccaggaacttctcaaagttctaggcaacatcgttgcgacacaccggagaccaggtgatgagcttggggtcggtcataagcgcagtggcgtcgtcgctgggggctggcagggcctcccgcaggaaggcaaagagagtgtgcgcccccgcaccgttcacctcgcccttctcgaagagcatgaagttgggctcgaacccaccaccaggtcggacgtacttgagggaattcagaatctcttcgttcttggcgttctcctgatgcccaaactggttgcacgggaagccgagcaccaccaggccccggggtccgaggcgccgctgcagctcgttcatctgggtgtagtcccggaccgtggagcctcagagggacgccacattctctataagtagtaccttgcaccgcagggagcccaggctcacaggctccccgccggccagcgggcgcgccgagaaggcatacaccgactgggccgccgccgccgctggccgagcagcacacatggcgcaattgtccaagaagccagcggagcgccccgaacaagcactgtctccagtgcattcttttcacagggtcggagccatgggaaaacttcctctttgccctctgaaggttctctgaaaatcactgacaagagacagattagattaataggagaaaacgcatacaaatttatttgagatcatagttttacgtgacaagggaacctttagaatgaagacccaaagatacagagcaaactggccatttttatgcttaggttcaacaaagtgtggacagctgtgcagaaatatgattggacaaaaatgttgtgatctaaagctaatggactgagtgtggaaacccaacaaggcctgtctgtctagattcttcttggcctctctgagcagcgttccttccttctgggtgtaaggcaagaccctctctggagtgggggtgttatgacctacagtcaaacaaggtatgtcagggaatttcgttatggccagtatttacacagaaagctgggagggaaagttagagtaatgtttttaggttttatggctggctttggggaacaaggtttctggtttctagaacctgccttggggaaggattctagcttctgttgctcctctggggagaatgggactgagacaggagggcaggggaaggtcagagaacaacatttgcttctaaacctgcttctggagctttttttggggggtattgttatccgagtccccacaatagcctccagaatagccttcttaaaactgaaatctgttcttgcgccactgctctccagcccagcctgggcgacagagcgagactccgtctcaaaaaaaaaaaaaaaaaaaaaaaaactgaaatcttttcatattattttcctgcttaccactcttgtatggctgcccattctcaaaggtttttagacatatttttgtcttgacagaatatagatgaaattcatcagagcaacacaattctatatacgtagtcagattttcatgaaactctaattttttttttcagagaaataaagttcatcacagtgagtcaagatgcctcattccaagctatggtgtaaatttcatagactaagaaatgtgcaagtttcctttttgctaagtatgacacatcacctctctctcacaaagggatatatgttgttactaatgtaaactcattagttttgatcaatgttttgtgaactcaaaagtatctgagacagctctcaatcaatttagaaagtttattttgtgaaggttaaggacatgcccgtgacacagcctcaggaggtccagattacatgtgcacaaggtggtcagggtacagcttgcctttatacattttagggagacataatacatcagtcaatacatgtaaggtttacattgtttcgatctggaagggtggggcaactcgaagcaggagtcgggcttccaggtcataggtagatttaaacattttctgattggcaattggttgaaagagttattatcagtagaaagaattgtttgggttatgataagtggttgtggaggccaaggttttatcatgcagatgaagcctccaggtagcaggcttcagagaaatagactgtaaatgtgtttttattggacttaaggtctgtgttgatattaatgctggaggggtataatgaggcttgtccaaccccctcctccatcatggcctgaactagtttttcaggttaactctggaatgcccttggccaaaaggaggggttcatttagatggttgaggggctttagaattttatttttggttcacaggatcatggttatataagatgttaacattaggagatgctgggtaaaaggtatatgggaaccttctgtactgcctttgcaactcttctataaatctaaaataatttcaaaatgttactattaactatactcgaggttatttatgtctattttatctgaataatgggaatatcatctaatggtgtgctaatacctctttccccaactccacattcagtgatggctagttggtggtttcacatcagacaatgtgggagtatttacaccctggcaagtggtacgtgcaataaacatttatcagcatactgaggcagccagatgtgactttctctgcctgaatatgaaaaggtatcaatacatatgggttgccaaaagtgcaagggagaagagaagacagcaactgtgaaaacaagctcccctctttctctgtaaaggctgcaaatctgcttatgagtgtttcagagtcactgggcaacccaggtcacaggcatatagcagagatcactatgctgctccgggcccctaggaaggcagggtgtggagcctatcatttcagattctgaaaactttgagggatgcgagaagagactatggaagccaaacaggaatcttctcataattttagccatgatgagtatattgagaaacattcaaaatatttaaaatttggcatcaggagtcagggcctatcagttctacatagcatctacaagcataacattttccatcatggttttctgtctgttaaaagtcatgttattattctgtgccaaaatcattcaatttagtatatgaagaaaaaaggaatacttccggggaccacacacccaacagagtgggatgctgaaaagattcaccatccagatctttcatagtagaggtgatcagcattgagggtacagtttgatcttttttttttttttttttttttttttttttttcagatagagtctcgctctgttgtccaggctggagtgcagtggcatgatcttggctcactgaaacctctgcctcccaggttcaggcgattctcctgcttcagcctcacgagtagctgggactgcaggcccaccaagcctggctagtttttgtattattagtagagacggggtttcaccatgttggccaggctaggctcgaactcctggcctcaagtgctgggattacaggtgtgagccaccacacccagtcctacagtttgatcatttttaaggtgcaaattctattcaacttcccatatacatggggtttcacactgggacggtgaggcaggggatcagaggtggggttaagtattgaaatcagcatataaggcaagaatagttgataatcaacactactctctaaaactccttaaatcagtggtgctacagagatagtacactgctagaggcaatttagaatattttgttgtgtgtttttggttagcatagccaagggagggggtaccttagatattcatgagccacagctggggattttaagcaaccgtcattggtcataaagtccagagaaaagaaggatcctctccggtccttcagcacttctgaatgccctgctagacctgcattgtgtgtgaaaacctgctcaagattatctgaggatagatgctcacagcattttacaaataaacacaaaagtatttttagcaatcttaataaaccctgaatttttctggaaatcaactactgtatgaatcaaaagtttgtattttgctctgtatggaacttttagcacaaatcattcattgttgtggaaaatcctgacaccaccagttctcaatataacacacctgaatctactggcatttgtaactattgcattcttagttttcctacaactatttattattaaaggggagtactgttctgataaggttggaaatcactgccttgaatttctgtaaatcactgaaatctatgctgcttgaaaccaatgtgtagggaccaagggaaaacttcccctttgccctctgaaggtttgctgaaaaatcaactgacaaaaggcagattaataggacaaaaggcatacaatttattaacgtgcatgagagtcctacaaaataggagatctcaaagaaatggccagataattaattgatgcttttataccatcttgaggttacagaatgaatggggacttgggagattgcaaagcacgctatgttggcaaaacaggttataggagaaggaggagaggaggcctggctggcaaaggtggtcttgttaacacagaaaagacctcacaggtagcagctctcagagagaatagatggtaaatgtttctttcagacctttaaaggtgtcggactgtcagttcatctttcctagatccggacaaggcagagctaagagaaaacctggctgcatcagtgcagattttctctacagatgcaaatctctccccacaaaagacagctttgcagggctgcttctgtttgcaggcgccctgaacagccatctcaaaatatgtcaaagaaatatatttaggggtgaaatattttggttttctttaaagtcaacaatgaaatttgttatttttttcactttacattcaggttgttgtcgcctttcccagggacaccagaggtcctggctttgcttaaagacaaggcttctcaacctcagaactaattaacatttggggaaaatgcacagtgcatattgctaaaccctctacagtgcacaggacagtaccagcccccaccccaacatggggtatatccgtggcctctacccactagattcgagcagcaacctccccacaagttgtgacaaccagtgttaaaagaaactttatacgaattaaatttaatagagtttaactgagtaaagaacaattctaaaatcaggcagcccacagaaccacaataggttcagacctgaaggtctgccacatggttggataacatttacagatagaaaaaggaaagtgacagaaaacggaagtgaggtacagaaactgctggattggttttatagcaccgtgtttgccttatttgaacagggtttgaacagttgactgcccgtgactggctgaaactctgtgattggtacaagggtaagttagtctgtttacataccaagttaggttacagttcagtatgtacggagaaacctttaggccaaacttgaaatacataaggaggcagatttaggccaaacttaattttaacaccagaaatgtctctagacattgccaaatgtcccctggggggcaaaatcacccctagttgagaacctctggtttaaggcaactctactttggaattctgttcagaatgaggagaatttgggtcatgtttctcaaagcacgatttgcaaatcagatcaaaaatacaggattcccccaaggtacgggccaaaagtgcaaatcagaatctggggtgtgtcatatggtgggtcagagccaggcacgatggctcttgcctgtaatgccagcactttgggaggccaaggcaggcagatcacttgaggtcaggagttcaagaccagcctggccaacatggtgaaaccctgtatctactaaaaatacaaaaattagccaggcttggtggtgcatgcctgtaatcccagctacttgggaggctgaggtgggagaatcatttgaccccgggaggcggaggttgcagtgagccgacattgtgccactgcacttcagcctgggtgacagagcgagactccttctcaaaacaactaaaataaaattagaaagatcctggcttgattccagctctacttgttagtaacagtgtggccttagcaatttaacctcactgaacttcatattccttagcagcaaactgagagtgaaaatgatgctacatctcagggatctttcgaggattaaatgagatactgtatgtgaggagctcacgatagcgtgggtcttattgatctttgtaatgccttgttatcctaacccaagctgagcacacacagcaggaacaaggtcagagaccctgggagcagggactgaggagccagccttggcttcagatgggcaaagtctataatcaattttgtttcagagttaaaccataaattaaattcctttccaaggttagttggcctacgcccaggaatgaacgaggacagcttaaaggttagaagcaagatggagttggttaggtaggtctgatctctttcactgtcataatttcctcagttataatttttgcaaagacattttcagcatatcaaggctttaggctagtattatccaatacagtagccactaaacacatgtggctatttgaatttcaatatatattaattaatattaaataaaattaaaaatcagtttttggatcacactagctacacttcaagtacataaccaaatgtggctaaggactactatactggaatgcacagatatagaacacgtctgtcatcatagaaagttcatagcatgctgaattttaaataaccacagaagcctagctcagtgtttctgtcatttttactaggaacacataaactaaaatgaagacaaacattaggactgtctggggaaaagccaccaacgttttttcaccttaaatggttgtttattttttgtcactttggggaagttaaaagtaaatattccctgtatctgttttgacttctcattaaattaataactaagtcacagaaaagatactcctttttccaacactctgttagtgctcaggctgcccaatctgctttcaaagagaaattatttccaaaatgccctactcagagttattcagtttcccttaaatgtggacttcaccatattttttaaagactatgaaatctaccacattaatcagaagggaatttttgataataacaattattacatacatagggtaactatatattatatatagggtaacttcctgacgttgccatggcatttgtaaactgtcatggcactggtgggagtgtcttttagcatgctaatacattataattagcgtataatgagcagtgaggatgaccagaagtcactttcattgccgtcttggttttggtgggttttggccagcttctttaccacatcctgttttattagcagggtctttatgacctgtatcttgtgctgacttcctatctcatcctgtgacttagaatgcctaacctgctgggaatgcagctcaacaggtcttagccttattttacccagcccctattcaagatggagtcactctggtccaaacgcctctgacaaggtacaaataaaacaagtaggattaatttacttgacggaactggagccttttggagcttcctagaggaatcatgtcatcctaaaatgtcagagctaaaaaaaatcagagaaaacactttatctacatttgtgaataaaaagaccaagattcatagtgaagggacacagccagttagtagcagaaccaggactaagggagtgacaagaatctgtttgacttcaaatcgctggtactttccttttcaaaacctggccagaatagggaatgcccttttgctgtaggactgacaacagaccaccatgtctgcagtgtctgttcaggttcaaccatgtcatataacatccccagatagggggtatcaaattcctgacacagcataaagctacaaacatcccttttcattcaccagctcccagagtctttgaaaacctagaaattggccacttttgcccttcaagaccttctgctactttgttcaaaggaagcagaagatcaaaggaaagtagccatgtggaggctcattgttcaggcctaggctggctgagtttccaaggcctccagggaattagggattgaggaccatgtcaacttgattagaccttcaactagcctttcaggaaataattctctcatttgggagcaaagagagtacctttctccccatactcagtacattatatctgttcccttcttaatgcctttcttttttcctctcttccatgacgcagaagtaactggatatttatgaagacagcctccaagacctttcatattcccccacatttgtgtgtatccctgacacataatacttcaattccctcagccttaaaatcaggcaagtgtgcctacatcacaggattgttgcaggattaaatgcaatgctttattaagtgagttggagactctgggtttattcatttcctaagggactttctgacactaaaacacacactagccaaatagtgcttctcttccaaaatggcaaattacttcaagcaaaagcccttcagactcagcagggaagaagtaaagagtcaaatgttacatccaccaataccaggagaatccagggaagtctctttagtttctttttcttgtattccttatattgctgttagattatggatgaaggaaaaaaactcccagatcctaaagcatgctgactggacccaaataaatgacattatgagagcctgtattagttatctattgccttccaacaaattacccaaaaatattgtggctcaaaataataaacatttattatctcagtttctgggggtcaggaattcaggagcagcttagctgggtggttctggcacagagtctctcatgaggtcgtagtcaagatgttggctggagtgacagtcatctgaagccttgactggggttggtggatcgtcttccaagacgggttactcacatggttgttggcaagaggtctcagttcctccccaagtggaccttttcatagggctgcttgagtgtcttcatggcatggcagctatgatataagagagacagcaaagaggaagttgccatgctgacaccatctagtctcagaagccacacaccaccactgctgccatattctattagttagaagtgagtcactaagtctagcccatgctcaagtggaagagaatgagtctccacccttgaaagggaaaagtttcaaatgtgttgacctattttaaagctaccacagggcagctgtctgggtggctccttcatcagttttcttgcaacacttcatatcagctctctgtacctgccaaacttcaatgattataaatgtatgagtctagtcatgtataaaaagctctgaaaaattaggtagaagaaacttcaaatagtttaataagctttgcattgcattttcattcccctttggttggattttcattggaatgtggatttctataaactacatattaaaactccctttatgggtcattgctaatctaaaacttatggtgatttagacagggattggattataaaataactttgtccataagcacaaataaaaaagtgtaaatgagatctgaggaacagtgtttacatactttaatgaggtcattgctttcaggcactttatgggcaaactttccatttaattaaatcacagaggccagatttaagctgacactttaaaatgttcattaaaaaaattatcctttttgtaccctggacccaagggaaagatcatgaagtatgtgctatatgcacaactatgtcctgagaacaatgaatcagctgttttttaaggctatttttctttgtttgcattttcccctaaattctattgtaaaaaattttaagcatgcagaaaaattgaaagaataacacaataaacacttggttatcctccacctagatttgatcattttgacattttgccaaatttgctaattctctctctctgcacacacacacacacacacacacacacacacacacacacacacagagagagacatagatgcacaaagcctataaaagcatcgcctttttggaggtgctgacccatttgaaagtaagttgcaaataataccatcactcttcacccgtaaatatatctcccaaggaaaggggacattctcctatataaccttaataccgttgtcatatttaagaagattaataataatcccattacatggccttcgcatgcaaattttccagctgacaagtcaaaaagacgcagaagccagcttaagggtgttcctactgatgaaattaggaaaaatttgagcatcagaatgaatgacaataaaggagtatagcccattaaatgaaagaaggatctgtgtgtccatatttatataaataaatggtggggaggcaaggggaaaaaacattgtccttgtagtagaaaaccacctattaaatagaaggaacaatgggataagaaaaattacggtcataataaaaatcgatttaggcaagaatcatcaatggatactaaaattagtgggtggaagcttgaggagtatattgtattagtttcctactactgctgtgacaacttaccacaaattttgtggctaaaacaatgcagatttattatctcacaattctgtaggttagaagtccaatgcaagtctcccaaggctaacgccaccatgttagcagggctgcattcctttctgaagctctagggaagaagccctttccttgccatttccaacatctagaggtatatatatagcgtatttttattttctctatttttaatgctttgacatcttgggggcttggtgaccctggagctcttccaagggctagctaatccctagagatagtagaggatttgactgcaagtgtgcctttctaatgcaaaccaactaatccaaagcccacacccacaactgcctcctctattgagctctgacaccctgggccaccactaccctgccttaatcacccaggctaggtgccagacactagagacagcccttacacctcagagtccactgaaattattcaaactagctgatctaaacctgcttaccctgcctcacccatttcttccaatggaaaccacaataaaggctcttgcccacattttcaccttgcactctctgcctcctgaccaactgataatagtttggatgtgtgtccctgcccaagtctcatattgaaatgtaatactcagtgttggagttggggcctggtgggaggtgattggatcatgggggcagttttctcattaatggcttggcaccatcccccttggtattgtcctcatgatagtgagttcttgttaggtgtgggtgtttaaaagtgtgtagcacctcctccctcactctcttgctcctgctctggccatgtgacatgcctgctccccctttccatcatgattgtaagtttcctgaggcctccccagaagctcagcagatacagcatcatgcttcctataacagcctgcaaaaccatgaactaattaaacctcttttctttacaaattacccggcctgaggtatttctttttttcttcttcttcttttttcttttttttttttttgagatggagttttgctctttcacccaggctggagtgcagtggcatgatctcggctgattgcaacctccatcttctggtttcaagcgattctccagcctcagcctcccgagtagctgggattacaggtccacgccactaccacctggctaatttttgtatttttagtagagacggggtttcaccatgttggccaggctcatcttgaactcctgaccttgtgatccaactgcctcagcctcccaaagtgctgggattacagggcgtgagccaccacgcccagcccctgaggtatttctttatagcagtgtgaggacgaactaaaacaccaagcccagtgcttcctcatgtagcccccataatttggcatgtccctactcttgggatctgcgagtataacaaagtattttttcaatggaaataaacgcctggtctgtcggcctcactgtatctgaataataataagatccacattttaaaacaaaggccacccatgtttcttagctcatgatccccttcttctgtcttcacagccagcaaatgatgggtcaagtccttctcactttgcataattctaatttttgcttctgtcattataactccttctctgattctgattcatttgcctgcctctggaacttttaaggacccttgtgattaccttgggcccaccagcataatcttcctctcagctgattagcaaccttaattctgtctgtaacttttattcaaccttttgccatgtaacatattcacagtttacaggattagacatggccatctttgggaggccattctgcctagcaccaggagtaaaaggatatttacagagtctcaaagtttttcctcacaagatgttcattaattacaaaggggaaaatagtaagtagctttatagtagagaaatttgtcatacaaggccttaatcaagtgatcgaattcagcatcaccagaaatgggacaaactgacataaatgtgatccacaatatgatgtactgagtacacatgatttctgtgctattcctgccaaaaacatgcataacctgagtctaatcatgggaaaatagacaaactcaaactaaagaacattatacagagtaactaatctgtattacaaatgtcaatgttgtgaaaggctaagaaggactaagaaagtatttaggattaaatgagattatagacataagacaactaaatgctttataagatctgaaattttcttttgctgtaaaggacattattgggacaattagcaaaatttgaaaaaggtctatagattagataacagtatagtgtccatggaaattgccagattttaatgattattagtgtggttatgtaagagaatgtccttatttcttagaaattatcactgaaggaaagaagcatcatgcctgcagtggacttcaaaatggttcaggaaaaaattaaatatataaatgtacatattttgtgtgtgtgtgtgtgcatgtacatatgtgtgtgagagagagaaggaaaaagtaaatgtagtaaaatgttaacacttggaaattatgagtggagtttatatgttcattctttgtattattcttgcaacttttctgtaagtaaaattatatcagaataaaagctttttggttttttttttgtttttcgtttttgagacagggtctcactctgttgcccagactggagtgaagtggtatgaacacggctcacagcaacctctgcctcctaggctcaagcgattctcctgcctcagcctcccgagtagctgggattacaggtccacacccctactacccagctaatttttgtatttttagtagagacggggtttcaccatgttggctaggctggtctccaactcctgacctcaaatgatccacctgcctcagcctcccaaagtgccgggattacaggcgtgagccgccgcacccggccttattttttttaattacctaatattttggatttcatagctattttttcaactagaatctaatcatggttcatagaaacatttggacattatgttccttcagtttcaatccatagcactcctcctcacttttcctttcatgacatcaactatctaaagagtccatttcaactgctttgttctacataatggatttatctgcatgtttccttgtggtgtcatttaacttatgcctggtagtgtgagctatcagttttcttactccaatgtcactactgaaaggtcttcttaccatggcagaccaaggtctgccaaacctataaatacttattagcaagaaggcacacaaaaccatcacattgttccatagtacagggtttgcccactctcccccagaacacaccgactagcaccttatgtgagaggcttactctgaagtgaatacaaagatatttgggcagcaggactggatagactcaagtgatagtcaggggctgttgagaagaggagagccatgggacgttgtatctcaagacctcaagaactacacatattgttttaaactgtttggctgagtgcagtggctcatgcctgcaatcccagcactttggaaggctgagacaggcagatcacttcaggtcaggagttggagacgagcctggccaacatggtgaaaccccatttctactaaaaataccaaaaaaaaaaaaaaaaaaattaaccaagtgtggtggcaggcgcctttagtcccagctactcgggaggctgaggtgggagaatcgcttgaaccaggaggcagaggttgcagtaagaggatatcacgccactgcactccagcctgggcaacagggagagactccatctcaaaaaaaaaataataaaaattaaaaaaataaaagtaaaatgttgggttcggttgtggtggctcatgcctgtaatcccagcactttgggaggtcgaggcgggtggatcacctgagatcaggagtttgagatcagcctggccaacatggcaaaaccccatctctactaaaaatacaaaaattagccaggcagtactggtgcgtgcctgtaatcccagctactcgggaggctgaggcacgagaatcacttgaacctgggaggcggaggttgcagtgagccaagatcacgccactgcactccagcctgggcgacagagcaagactccgtctcaaaaaaaaaattaaaataaactcttagacataaagagtggcgcattttgaacattatccccaaccaactgcttttcatgaccaccactcattttgccaataaaatattcttcacatcccttcgtgtcaactagcaaaatactagatataggcttagtaaggattcttcaagctctaaataatcaactccagcggtattgagtcctgaataggccccttcattgactactgctggagtggatacatgcacgctcacttatgtacacttatccactgtatacacatgtaaacacgtatacacttcacctcattctgaaaacaatcaccccccagggactcattttgcccaacaaacacacacttgtttgctacaggtcattaaaaatagcaaaggctgctggaagtgtttttatgctcacattccctatgactaagaaaatgcccacctgaatctaatcctgagaaaactcagacaaacctgaatcaagaggcattcaataaaaaactgccctataatcttcaaaagtgtccaatccatggaattcagagaatgactgaggaactgtttcagctgagggagatggaaaagatatgacagccaagttccgcatgtgactctgcactgatccttttgtgataaatggcgttactgggatagtcgtcaaaacttagttggcatctgtagattgcagggtcttaatgtatcaatgctaatttcctgacttggatggctgtattgtggttgtgtaggaaaatgttcttttttataggattcaggagggttggagcatcagattgggaactggttcagggaaaaacaattctgtattcttctttcaacccttctgtaagtttgtgtttgtttcaaaatgaaataatttatttttttaaaagataatgccaattgtgcatattgaagagtgttagataagtgggtggcttgagaggtgctagtagaaattgaaggagtgtctgaggatctttctctcacaaatccacccttggccttgcccctggttgttctctgggaatccctcagatacttcacttcttctccatgaaatcttacatcttcatctcaaagcaaagggattcaagatgattgtggggatgacgtggtgatttccacagactcctcagttatcctgtagtatggccataagcctccccactcaaagacaaatgtgcatggctcttctttgtgttcctatggaacttgattagttcaccctcaattaagtcatgcttacctaaacattctagttggcatgctgttttcaaatgtaagtttattattattcaaatatggtgaggccaacagatccgattgccattgaaaagatggttggttacacttccaaagaagatggagacgccatgccagtcaggaccacgtggagtgtaagagttcaataaaagaagtggttgagggtatgggctttggattggttggtttgtatctagaaagacacacttgcaggtgagcccttcactatctctaggaattgactagccctgtgaggggctgtccctccagggtcggcaaggctcaaaaacgtgaaagcatcagaaacacaagactaatacacaaacccagagtagatagctaccgttgctcttccaaaatgacttacacatgtctggtggcctgaggcctcagttcttctccacatgaacttctccacaggtcttaaaattttccctttctgaacaagaaagacataaatggaaatggccaagcaagatggaagaccctgagtgaagtgcatactgaggtttcagcaactcttgtcacaccctgcaggttttgatagactagaaaaatgacaagactccaagtccttgaagaggaggaaaagtgtgaagaaaacaaaaaagggagatttatgtctgcttcaccattttgcccaagacttgacctgtcatacactgaaggtacttgaatgtttataatcataaattgcttattttaaaattaaaactctaatctttctatatcattagacaggctttttccccaatcagtctggattgtcaagacttctctatataagcatcatgctttgtgatgaaggatgcactcattcaatcagtatttattgagcactcaccatgtgccaggcactgtaatcagggttggggaaaaaatggtgaaaaaacaaatatggtgtcctcctctataaagcttacttgacactctaacagggaagccagaaaatcaagtaacatgaaatagatgtgagactacaacagtgataaatgctgcaagttacagtaaggaaacgagtcagggaagaggtagtttttcagaaggaagttagaaggagggtaaatatcagactgttactggtggagggtgtccaggttcttggcgttttgaacaaagaattggacaaaacacacaaagcaaggaaagaatgaagcaacaaaagcagagatttcttgaaaagcagagcacactccacagggtgggagcagcttgagcaagcagctcaagagcccagttacagaattttctggggtttaaataccctctagaggtttccattggttgtttagtatacgccctatgtaaatgaagaaactaaagtgaagttacaaagttatttactcggtgtacatcatatgtaaatgaagaggataaagtaaagttacgaagtcattgtattagttcattttcacactgctgataaaggcatacccaaaactgggaagaaaaagaggtttaaatggacttacagttccacatggctgggaaggcctcagaatcatgacgggaggcaaaaggcacttcttacatagcggcggcaagagaaaaatggggaagaagcaaaagcagaaacccctgataaacccatgaatctcctgaaacttattcactatcccaagaatagcatggaaaagacgagcccccatgattcaattacctttccctgggtccctctcacaacacatgggaattctggaagatacaactcaagttgagatttgggtggggacccagccaaaccatatcagtcatttactcattgtatgccctatgtaaatgaagaggctatttcctgtcacagctgaagtgtttccatttgatttagttctaggaagtccttaggttctctgccttcaggccctattctcctgcctcagtggtagtccccaaaataatatagctaattactatgctgaagctacccaggataacaacatgttttgaggtgggaaggaagactgtgagtaaggtgcaaaagtcttccatcaatgttggggagttaccaggaggtcagtaggagagacagaaggtgggacagggatgaaatggcatgagctggaaagaggttttttgtttttaataagagttctaataataccatagagaatgttcaggaagaggcaatgaagaataagggaaaatactaatcgtgaaaaaatgaatgcaaactttataattttctaaaatgcccatgggcctccccatgcccccactggaaagttaaggcaatgtaaaactgatctatgaaaggatttggagttgttccacagagcattcagaagctttttattaatcatttattccccatctctgcccttccttcctatgacctcatgctttgtctattctcccaataagcatgtttctgaaatatatgttttccattccaggctgacattcataattctagtgccttctagtgcacaatttgtttcccatttcagtccacttctttcagcaaatagatttgctttcagaagagcagccttaaggaacagctagcataatatatggtccatcaactagagagtgtatttctcaacagcccactcatatttcataaatcacagagcaattattacaactgatttactcagaaaatttcattttattttcaatttaattattttgattgataaaagtaagatggttaatggctccttttcttggaactcttaaaacacaagtatataatatctagctttctaaactagtgaaattcatggtacattgcatttgtgttgtgaaaatcatcatttttgaagctaaattagcctctctacccactgagagaaggtgctcaacttgaagagcctgtggcagaaatctcagctaaaataaatttagcccctcactctctttcccagtgaatctgatatctctatccaatacaacgtctgcaatttaaaacatgtacacaaagataattggaattttcaaagaagcaagtaacttatcaatgactggagatgcctgtttaaatgttctctcacctttatatcttgcaggaagctcttgtttgaccttctgaaaaaaatcttgaagtatctatgagaacagctattatatgaagcagagattataatagatatggagtttaagttgcagaaaaagaagactgaattattaaatgggacatcagaaaataaaagtctttccttttatctagtttggaggacctaaaaaaatcaataggcagaaatttacataatccttattagattccacgagctacaaatgtactattagtacagattgatatgaaagaaagattagttatgcttatggataggtaagaagagacactcttgcaaaatggtagattgaaacacccactgaatcttcctggaagtgtgttgaaatcagttaaagggttaatgacacaaatatgaggatgattttgtaagggtatgatgaagggggcaaacagcctaatcaaaagaaaaaagaaatagcacatcatgcaaggttatcgacactgttctcagtaacctcttgcatccctgctggaaagaaactagtagggttaagtcaagaatttcctattgtgaaaggaagaagtgaccattgatttgtgccttgtcactcaggttaactgccaaagaactttgctcatccaggggtgcataaatgaatgccatgtgctaccaaaaaaaaaagtaataaaggattaaataaggccatggaaaaatgaagcaaactgtcacctggcagtgtctcaagcctgcaaacttgatatccccaactgcattccaaaagtagggttcagagaccacaagtgctacaggcatggatgagttaatatttatatctaggaagaaaggattagcatatgccttccaaagaatgtttcagcaaatgcatgcagctgcctgggcattcgcagttgattgaaatgactcaggggtcaggttttggtggccaggcctgctccacctttactggaatgcatgagtcatgtgttagtcggctgggtgagaagactacactggctttgcgcattcttatatttctcacaatccagacaaagcaaccacatgaccagattccaacaagactaacagtcagataaggagggaaagtcattgaaataaacgagagaagagaaaacctaaatgtgttttaaacttctaaagcgagaactgaacaataaacagttttctacaacagggcttctataagaccagtaacttctatgctccccaaaaagtatttatgaaactatttgagtggttttacatcttgattattcttccacttaaatattgtctttaaatgacctgcctgggtgcatgtccagaatggaaatagcaaaagttagatgtcttacagtccaagctctacaagtcctagctatgtgaccatgttggttatgattagaccaactgcatttggtctaatcctaacctctgggtgttttaataaactctgatagcctccagggattattaaaaagtccagaggtgaggccaggcatggtggctcacacctgtaatcccaggactttggaaggctgaggcaggcggatcacttgaggtcaagagttcgagaccagcctggccaacatggtgaaaccccgcctctactaaaaatacaaaaaaaaattatcctggcatggtggcacacacctgtaatcccagctactcgggaggctgaggcaggagaattgcttgaaccttggaggcagaggttgcagtgagccaagatcatgccactgcactgtagcctcctgggtgacagagtgagactcagtctccaaaaaaaaaaaaaaaaagggccagaggtggtcagtccaggccgatgtagtaccttaacaaagtcactgggcagtcagagtccttctatctgcttcaccattctcatacatacatggtttgcatcctcagtgtcacaatatggctactctggctgcagccatcacatctacattccagggaacaggaaggtaaaaggggtaaggcaagaagaggcacgtcctattcctttctaaggagtctttccggaagtgacacccaatagctttcatattggacagaattcagttataatgccatgcttagctgggaaatatactcttttagttaggctgccaccctgaaaaatatcaggactcattgactaaagatgtaaggaaaagtgaatattaggtaggcaacaagcagtctcagccagagtgacattaaagtcaccaccatctttgagtccattgtctgttcatttataaaatggatgtaaaatttataaaatggataggcaatgcctacttgacatgattggtgaggtgaaaaacactatacaaatattagctgataacagcccccaaaacctagcttagaataataggtatccaagtgtacattcagtattaccccactttctggaaaaatcaagtccctagtcagataagagttcagagactcagttttgcttcactacctcatcctagtcctactacctggacatcttctcttttcctttcttacaaataacttgaagaaatagctctctttcttcattctgtcttcctagttctctagtgtctccatgactgggcccagacttgctcttcccactctatattgccatcaacctttaaaacttgaggatctctcgttttttatacaaatcctttcagtgttttttaaaaactcacaagtcttcataggatcattactttctcatctcacctgtatcttttgcatttcctgggaaactggacacaagaacttaatagacatgtgcaatgtaatgtgtattactatgtaggggcaattgcattggtccctacttagaaatgtggtaatgacaactagtgtgctttattcaccaccattatttccacctggtgtttatttatttatttagtttagagacgaggtctcactatgttggccaggttggtcttgaactcctggcctcaagcagccctcctgcctcagcctcccaaagtgctgggattacaggtgtgagccaccaagcctggccacccacctggtgttctaataagtttcaatctgcatattttaaaagacatttcgcatttaaattctttaatactctgtaagatacactcttcaggtctctcatgtagtgctaagaataagttaacattttacagatgtgaaaattttagtttcagtgattaagtgaattgtttctgaatttaagtagctcatccaagaccttccacgctataagcagtagtgctaagatctatatccaccatccgtttccaagctcaggcactttttcaccagaataaaaatgcccaatttctacttaagtcaatgcaaaccacactgctctattttatggtgcattgagaaaatttaaggtttaaaacttagaagtctaaaatatgcttctatcatgataaactatactattagcactcatgatttcaaacactaaaataaaaggtggtggtgagataaaaatccatgctagtcatttatttataaagctttatcctacagtagtctgttcgacagacaggtcaatcaatcttgactataatgaagaatcttgcttgtcttaagaataggtatgtagcccagaccaggttttcctaaaaaattatcttcctgtaggtagctttataagaatagagacattttaaattttagaagattttggaatgtctggtgaaatttcaagccactaaggttaaagtaattgttttataaaacaatgcctttgcaaattggcatctaaaattggtatattgatgagggaaggaaggttctaatctaatgcagaggctgctgaagagtcggcatacagaactgacttcaagaatgcctgaagctaaatgtattgattgaaaaggtcagcatattagcagaagcatccattaacccaaaatagtgagcgaaaccaaggggaaaatggaaagctcttaaacaatgaaatggcttttgccttcctgaaatgacacctgactatctatgtctccatccctggagcgttttcaccagagccctaggattctgaactagggtggctatcactgcatgaaaaatgagaagtccattatggaacacaggtaaaatgtggaaggcttgttgaagactcactagcatgaaaaaataaatgaatcacttggtcgtaacaataatgaacagctaagaacataataaactacagaaagtgaccaccaagcaaagttaatattatacataaaatgcatagtgtcttacattttaaccaaacatagccggatgtatgacaggatgcaagaaccacctgtgggaaacaattcatagccacacaatccttgccaggataattacattgaactgtcaaaggccatggttttggccttccttgggtctttgtgattttatacagacataagagactggcaagacactactggaaccaaaccatagttttgctgattaaaggctaaaacaggctgccctccattgcttctacctcactgaggccccaaagaccttgatctctaggatccaatgtttactgggatttaccactgatgtagccaaacatatggaatttggaatcatggcttgcctattggtctagatgggaagataagccggatgctgtggctcatgcctgtaatcccagcactttgagaggctgagaagggtggatcacttgaggtcaggagtttgagaccaggctggccaacatgacgaaaccccgtctctactaaaaatacaaaaattagccaggtgtgctggtgcatgcctgtaatcccagctacttgggaggctgaggcaggagaatcacttgaacctgggaggcagaggttgcagtgagctgagattgcaccactgcactccagcctgggtgatagagtgagacttcatctcaaataaataaacaaattaattaattaacaagaagataagaggtttctaagagataacatgagaagtcccctattatgatacctaacaaagagtagctgatgcccagtaaatattaaatattccctttcttcttttctcttcctcagctcagagaggaagaaaggaccgtgtgagagaagaagggaacagcctttcatccataggagaagttcgtctatgacaaagccactagctccatgtggccgctgagcactcaaaatgtggccagtctgaattgagatatgttgttagtataaagtccacatcggctttttgagcactttgtatgagaaaaaagaataccaaatatctccttaataattgttacattgattatatgttgaactgataacattatggatatattggattaaataaaataaattattaaaatcaaataaaaaataaaatc

SEQ ID NO: 5483 - DNA, 19220 bp, human
taagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaattgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctggtaactgtaaatcagtgttctcttaacagataaccggagtgataccttttatttgtacaacccttttgtgcttttaaaaatcttatacacactactctctaaaacagaaaaaggaggaaagaaagtcgttagctgaagctgccaccaccatccctaaaagttacagtttggggagagggagtggatgactatttatattgtgccttgtggccatttagtaccttactgtagacagagtgtgggtgagaacagcccagcataaactgggagactgtgggaaatgcattcccaggcctcacaccattgaatccgaatctgcattttgacaggatccccaggtaatcttccaggataggatagtttgagaagtgctactttagcaataggcctgtggctctcagcagtggctgcatattaaaatcatctgggaagctttgaaaacccactggtgctgagaccccaccctagaacaattcagttggaacctatgagatgggacccaggcatcaacatttcttttttcattcctcaagttattttaagatgcagtcagagttgagaactactcagaaataggctctcatttgatcctttttacagctctaagacaagaatgttattccaggcacttcacgaatgaggaaacaggtccacagaggtgtggtgacatgtccaagtgacacaaccataaatagtaccaattctgacagatcccagattttctccctcctgactcactgagactggctcaatatcgacttctgagaaatgtattcctggaggtcggggacaaaatgaagaatgtgtttaaactccaacattgggtgactagatcttcattcttttcccctctcttttctcatttataggtctcccttcaaccacaaaagtcaccctggaactcatcccgcagttagaattttgtttggagccctcttgcttagttgaaggagtttcgtagttgttttttgtttttgtttttgtttttgttttttccccctgtgaacaggtttttcgggggtatgtaaactctaggatgtttagtttctgatgtcaggagtcttcatgttctcaaggacaagtgtccttgagatggacattaatggtcattagtctgtcagaggaagcccatcactttagcctttgaatgtagtaacagacgtttatctaataaatgaattgaagataaaattacctctttgaggcctttgcaaacagtgtttaaccagtttatataattgtttgactacaacacgccttctatgtgattatggctgattttttttccttaaaaaactcatggaatgttcaccgttttatagttttaaaaagtttactttggcggtctctacaaacctaccatttcactttctcaccagttcttttctcctaactctcttcctttgttggagctctgaaggcctaactgtgtgtacactttacctgcctgacagaattctccaaaacatgcataaaagtaaaatatgttcgtattttcaaataatttggaagagtcggctcaatgccatcaagtgtaaaatctattttgatatacttgctctccgtgtcttcccagggctgctttttgtgatgcaacatgtttagtccttaacttgcaaggtcatctaaaacttgaagtttcacaaagtgtggtttcatatgacttggaataatctgaaaaactattcagtggttacgaaagagcacagcacataaaaaccaaatttgattagttcaagtcggtgtttatgttttgctttgggggtttgtgtgtatgtgtgtagtttttatttatattggaatttggcaaactaaatgttcagacaaataaaagtaattaaaatggaaatttccttactctccaaaatataaaaaccttcatggtctggccgggtgcggtggctcatgcttgtaatcccagcattttgggaggccgaggcgggcggattgcctgaggtcaggagttcaagaccagcctggccaatatggtgaaaccccgtctctactaaaaatacaaaaattagctgtgcatgatggcgggtgcctgtaatcccagctactcgggaggctgaggccggagaatcacttgaacccagaaggcagaggttgcggtgagccaagatcacgccattgcattccagcctgggcaacgagagaaactccacctcaagcaaacaaacaaaaaaaccaatctgcgtggtcttcctcatttcatttcatctttattcgtgagttttgcaacttgagataggaaaatagtaatctgtgtgtttttcttttggttaatgagacagcattacattttctgcctataggtaattctttcagatcctatgtcctttcccctaaaaggaaaggactttctttaaaattgactgcagggtaaagatttttttttttttttttttttttttttttttttttttttttttagacaggttctcactctgtcatcaaggctggagtgcagtggcgccatctcagctcactgcagcctcaacctcccgggctcaagcaatcctccaacctcagcatccccactcccttgagtagctgggactgcaggcacgtgccaccatgcccagctaatttttgtattttttgtagagacagggtttcttcatgttgccaggctggtttcaaactcctgggctcaagcgatcctcccaaagtgttcggcctcccaaagtgctggtattataggcatgagttaccgtgcctggccaagactctttaatttaaaatcgctttttcagaaacagcaaatggaagaccctgagacaggagactgcctgatacacgcaagttccagcaagagtccacggcagctaagtcacagtgagcaaggggaacaaggatgagagatgcagtcaaagaggccatcgtgagggctcttgtcggtcggccatggtaaggatttgggggcgtttcttaaaacatgatgggaagccactgaagctggggagtttgtggtgatgagatttaacaccctttaggaaggatcactctggctgttatattgaattagaagggaaggaagcaaggatgcatgcagggacaacaggtgacccttggcagtgatccaaatgtcaaataactggcttcaagcaagagtacacagagtctgggctccccgaatccttatagtcagcaaagtccttgacaactttgcaaatggatatttcataaaatacactaaatcccaagttccctacccatggcccataataaacaataatagacaatgcagaaattcagcattggacaagtatatcctatactcgggttgccatgattactgggagtccctgcatagggcataaacaccagttgttatacctgaatgtaggagcgctctcttgactcttgatggattttcccacatcactctccttttgtctgtgttacttttctgagataaaaagttggatacaattggagctctgtctcttccctgagcacttcctgtgatgagaggctcctttcattcgccactaccattctaaataccagtcaggaagcctgcagctggcagtgctccactgctttggcaagggctgggccttcatcttctgggtcagattgctttgttatttataacttcccagtaaatgcaaaatattttactaaagtagttatttttgtatctctcagatactgtaagtacctaggctttcagaagagccccacaatcagaagggagaccagatgacaacctcatatagtcccatttgcattattatttaaaactgggattcctggccagacgtggtagctcacatctgtaatcccaacactttgagaggccaaggtgggaggaccacttgagcccaggagttggagatcagtctgaaccccgtctctacaaaaaatatagaaattagccaggcgtggtggtgtgtgcctgtagtgtcagctacccaggagactgaggtggaaggatcacctgagcccaggagattgaggctgcagtgagccatgattgcaccactgcactccagcctgggtgacagagacagaccccatctaaaaaataataataataatagatttccacaaatgttagcatgcatcatcagaaatgctctgtgttcatgattgcacattgctttcacttttccaggtgccgggagcaaagagatgattaagacaccatcccaggcctcaagccccacgaaacgcaggggaagcgccatgctatgcagccagcaatcgttttaccttttaagagctctgagagagacacccactggaaaggggtgcagaggaccccagaggatcaactaacccagtgtgggagggtcagggaaagcttcatagaggccgtgacccttagggcaaatcttgagaggaagatggccaggcagaggaaatgggaaagtctgttccagcaccatatttgctagattcttggcactttatgtatagcatctcctttaatcttcacaactaccctgctgcacagcattttagaggtgaggaaactaaggctgagagagattaagttacttgcccaagggtacacagagacaaagccaggactaactcataacaaagtgggtaggttttgtttattttgcatgtcagattgcttctagaaataacagcaggcttcctattaattccaggtgaggtcctgctattttataattgtggtttgttctttcaatgccaggagcatgtggtgtatggatccccccttacaccagtactgtgcactcctcctgatgatggagagattgggagggaccacctggctaggattgctggctctcctgacaccttctcgtggcatccatgtggtttatccagttttctgaaaagtaagtaatttttaaaatactgaaatttgacagtataagaacatgttgctttttaagggatatttacatgtttatatatttttatgaatttgaagactataaatatataaatgcagtttcaggtatcatttcctataaaatatagggcctttcttttcttttcttttctttttttgagacagagtctcactctgtcacccaggctggagttcagtggcgcgatcttggctcactgcaacctctgccttccaggttcaagtgattctcgtgcttcagccttccaagtagctgggattacaggcatgcaccaccatgcctggctaattttttgtattgtttttagtagagacgggggtttcaccatgttgcccaggctggtcttgaactcctggcctcatgtgatccacctgcttcagcctcccaaagtgctggcattacagatgtgagccaccataccccgccaaatatagggcctttctatcttcatgttctgcctgtatgatctaggaaaataacaatcaattatgaaaaaatagttatttagaatcctttgttaaattattgtaagtaccctcctggacagagagtcaaaaatagaattaaaattaatttgttggacatactcttgctttcttttaaaatgtaaatgagatacaaataggggtaggttccaagtagtcattaatctttttcaaatggtggcaaatttttttaaaaaatctaaaacaaccatggtaaagttacatatccaattaataagcaagttaaaacttcacccattcaaaaacttctttactttttatttttggaatataccatattcacttttgaaatgcaggtaaacagatacaggtagctccccggcagctacttttacaacttcagagtgatgtcataactcacgaaattcccctttgtagactgaaacaaaaaattcagaaatttccaaggtgccggtgaggccctgagtcatctggctggattccacctaacgcgcctatctgtgaatgattgaagacagagctgcaaaaccagtttcagtttgtttttttttctctaaccacagcacacccaggcacttgtccaacagtttcccacgtagctcttccccatggcgtgtgacttcatgtgcgtgtcagttgggaagagctaaaagtcaaagttcacccatgtctagcagaaaaggacttgaagattttacatggactgtgtgttggtgtttatgagtccaccaggccatcttgttttgtcttatcttttcagaccgaggatttctattccttcagttttgttttctttcagcagatgggcttttgtcccccagctttgtgaaatctcacgaattgctcagcagaaagtttccaaatgacttagtggatttttatgaacatttaaaaatgaggctgaatgcggcggctcaggtctgtaatcccagcactttgggaggctgaggcgggtggatcatctgaggtcaggagtttgagaccagcctgatcaacatggtgaaaccctgtctctattaaaaatacaaaaattagctgggcgtggtggtgcgcacctgtagtcccagctacctgggaggctgaggcacaagaattgcttgaatccgggaggcggatgttgcagtgagctgagatcgtgccactgcactccagcctgggtgacagagggagactctgtctcaaaacaaaaaggacatggggggttctttttgggggtgctaaaaatgttctaaaattggtggtggtgatggatgcacatgctaaacatcactgaattgtacactttaaatgagtgaattgtatagtataaataatatcaataaagctgttacccaaaaaaatcagatgaatggaaggaagaaattggagagagggtctctattggatatttatctcagtgagtcattctgaaccttagtcccaatttatacatgctcgtaatgacagtctttctcaaagggggctttctggaggccccagccacatcactgacagataaagagtgagtctcccaatgccttcaaagttgtcagggcggtttcctgggctctagcatttgcggttctgcataaaacctgctttcacacagctcacagggctcaacggggatcccaaatcatcggtccttgtgtttcttccccatttctcaagctacagatctgagctgaactatcaatgatattaaacccctggaaaataaaaaatcctctagaatcaaccccaaacagttgacattttcgttcccagtaagagttatactcagaaaagaattgtaataaccacaaatgaaatcagccctgcactctcgcccttcatattgaggccctgggatcaatggcatcagcatcacctgggagcaaataccaaaacaagggccgcatcccagacctactgaatcccaatctacatttttcaccaagtcctcagccatcaactgcatattaactgtccacagcagctggccctacgaagtctgccttcctgcttatacctttggatgaaatgcctgagttcctagcatggaaactaacatggatctctctgattgcctcggtcaccaatgacctccaccctctacgtcactaaattcaggggacagttctcagccttgaatcctatctacagcatttgacatgcttgcttccttcttgagaacattttcatgtggcttgcagtaggttacactctcattggttttccctgtcactggtcactctgtttcagtatcatttgctggttcatctttcctgactttttaactggaatgtcctggaatgtaatccttggaccccttctatctacattcactcctttggtgatcttctctagttccatggcttcctgcatcatctccatgctaaggacctccccgctgtctatcttcaggcttgcatctccccctcagaattccagatccagaaacctaacagtcaacttgacaactctacttgcatgtccagtgagcatctcaaacttaacatgtttaaaatcaagcttccaatcttctctccagcgcctccttctccactgaatggcaactccatccttgtgtaccttgagctaaagaaacatggagtcatcattaactcctctctttctttcatatcatacttccaatcagttggcaaatcatattggctctatttcagatatatatccagaagcccaacttaaaaatgggcaggagatttgaatagacgcttcaccaaagaagagcaaagaagatacaggagtggccaacgtgcacatgaaaagatgctcaacatggttagtccttagggaaatgcaaattaaacccaccacgagaaaccatttcacacccacttggatggccataattagaaaaaaacaaaacaaaacacacacacacacacacacacagaaaataacaagtgttggtgaggatgtggagaaattagaatttttgtacattactggcaggaatataaaatggtgcagccactttgggaaacagtttggcagttccttttttttgagacggagtctcgctctgtcgcccaggctggagtgcagtggcgcgatctcggctcactgcaagctctacctcccgggttcacgccattctcctgccccagcctctcgagtagctgggactacaggcgcccacgccacgcccggctaattttttttgtatttttagtagagacggggtttcaccacgttagccaggatggtctcgatctcctgacctcgtgatccgcctgcctcagcctcccaaactgctgggattacaggcgtgagccaccgcgcccagcctggcagtttcttaagaagttaagcatcatagtaaacataggactcagttaaaaataaaaataaaagaaattacgcataaatttaccatacatcccagcaattatacaccttggcgtgtacacaagagaaatgaacgcatacatttacacgaagactcatctgtgagcatccatagcagcactattcatagtagccaaaaagtggaaacaacccaaatgtccattaactggtgaatggatcaaaaagatatggtatagatattcaaagaaatactattccataataaaaaggagtgaagtaatgatacatgctgtagcacagatgaactttgaaagcatttgctaaatgtaagaagccaatcacaaaagaccacatattgaatgactccacttatgtgaagtgtctggaatatacaaatctacagagatggaaagtggattcacagttacctggggctggtgggagaaaagaggagtgactacagatgggcacaagggaccttattggagtaatggaaatgttctgaaattggattgtggtaatggctaaataactctgtaaatctgtttaaaaatcattgaattgtgtacttaaaacaagtgaattttatcatatgtaaattatacctcaataacactgtttacaaatatccagaatatgaccacatattatgttctctaccattgtcttgttctaagccagcatcatcctcacctggctgactgtcacctggatgaccaattgtcatacagataccacctgctaagtggttgcctgacttccactcttgtctcccaagtacgtctctaacacaacagccagagtgatcctggggaatatgcaaatcagatcaggttacctctctgctcaaaactctctgttggctcctgtctccaagagaaagacaaagttcttatagtggtctttaaagcttcactaatctggcccctccttgttacctttctgagctccctgcctgctattaatacttacccccttgctggagactgcattcagtcacactggcctccttgctgctctttggtcataccaggcacatttctgccacagggcctttgcactggctattgcttctgcctggaatgttcataccccagattccttttttttaaagacagggtctagctctgtcccccaggctttagtgcagtggcatgatctcagctcactgcaacctctgccttccaagctcaagagatcctcccacctcagcctcccaagtagctgggactacaggcacatgccatcatgctcggctaatttttaaattgtttttgtagagatgaggtcccaatgatattgcccatgctagtcttgaactcctgggttcaagcgatcctcccaccttcgcctcccaaagtgttgggattacaggcgtgaacaactgaacccagtctcccagattcctaatgacttaacttacctctctcaagccctagctcaaatgtcacctggggctgtgaggctttccctggcctcttcctacattccctagcaccctttctgatttttttctttcttttttttttttgagatggagtctcactctgtctgctgggttggagtgcagtggtatgatctcggctcactgcaacctctgccttccgggttcaagcaattctcctgcctcagcctcctgagtagctgggattacaggcacctgcaactacgcccagctaattttttgtatttttagtagagacgaggtttcaccatattggccaggctggtctccatatcctgacctcgtgattcacctgccttggcctcccaaagcgctgggattacaggagtgagccaccaccacgcctggcctctgattttttttttcttttattattatactttaagttttagggtacatgtgcacattgtgcaggttagttacatatgtatacatgtgccacgctggtgcgctgcacccactaactcgtcatctagcattaggtatatctcccaatgctatccctcccccctccccccaccccacaacagtccccagagtgtgatgttccccttcctgtggccatgtgatctcattgtttaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgagtagtgccgcaataaacatacgtgtgcatgtgtctttaaagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctccgcccactttttgatggtgttgtttgtttttttcttgtaaatttgtttgagttcattgtagattctggatattagccctttgtcagatgagtaggttgcaaaaattttctccaattttgtaggttgcctgttcactctgatggtagtttcttttgctgtacagaagctctttagtttaattagatcccatttgtcaattttgtcttttgttgccattgcttttggtgttttagacatgaagtccttgaccatgccttaatagagcttattcaccattgaaatacaatgccctggctgggcgtggtggctcacacctgtaatcccagcactggaggccgaggtgggtggatcacttgaggtcaggagtttgagaccagactggccaacatggtgaaacccagtctctactaaaaatacaaaaattagccaggcatggtggcatgtgcctgtaatcccagctacttgggagcccaaggccccggagaatggcttgaacccgggaggtggaggttgcagtgagccaagaccatgccactgcactacagtctgggtgacagagcaagaccatgtcaaaaaaaagaaagaaagaaagagagaaagagagagagggaaagaaagaaagaaagaaagaaagaaagaaagaaagaaagaaagaaagaaagaaaggaaagaaaggaaagaaaggaaagaaaggaaagaaaggaaagaaaggaaggaaagaaaggaaagaaagaaaagaaagaaaaagaaaagaaagaaagagaaagaaagaaatacaatgccttgctcttgctcacggggtcagagatttttgtctttttggttcacagcttatctccagcccctagaatagttctggcacacagagtgccctcaagaaatatttgttgaatgagtgcacctaagaaatttggaagagccaggaatatgacagatcaacacatacgcacatttaggtaaaagattaggccgggcacggtggctcacacctgtaatcccagcactttgggaggccgaggcgggcagatcatgaggtcaggagattgagacaatactgactaacacggtgaaaccctgtctctactaaaaatacaaaaaattagccaggcgtggtggcaggcgcctgtagtcccagctactcgggaggctgaggcaggagaatggcgtgaacccgggaggtggagcttgcagtgagccgagaccgcgccactgcactccagcctgggcgacagagcgagactccatctcaaaaaaataaaaaataaataaaaaatttttaaaaaagattgaaaacaagctcagagggagtgattgtagtttatgacaggcaaaacaatttgagagtggaaagaatgggcaattggaaaagagagagcattttttttccccagaacattttggagcttttcttctccatgtatgtagtatctttgagtaaacctcacatatactataaagtcttaggccatatatgctcaaactctattataaagctaattgttcaattgtcttataatccttccctttcttgtgtgttattttctgttttaatgttcaatagcattgttagaaagaaaaggagattaaaaaaattctatttgttcactgttttacttgccggaagaccctgcaggtacttaaggaatatagttgaaaaggttattaaaattgtttggtgattttgtggttgttgacttagttgtctgttagcatgcattacagactgtacttggctatatgttagtaattctagaagtgactctttgaaaataattttccccaaatcatatacataaacactatttgtaactcacgagttttttaaagtttatatgcatttatttttgttataattcagtggcttttagtatattcacaaagttgtgcgattatcatcattatctaattccagaatgttttcattaccccaagaaggaatccagtaccagttaatagccactctctattccaccctcttcccagcccccagccccccaaccgccacctactttctgtctctatggatctgcttatcctggacatttcacgcaaatgggaccatacaatatgtaggtttttgtgtctggcttctttcacatcatttcttttttcttaactcaagaagtaaaccatattttactaaccaaataaactatactgacctttacttaaagtacatctttagctgaatttgcataaataatttgacatttctacctgtcacaattatactccttccaacttttgtgtcaaaaattatttttgattaaccacatgcaaagcttgacattttgaaattcagatactcactgttatctacagatgaaggtcacaagatttttttttctttaaaaaaaaggaagcaaggatattttaccctagttttgtaacttatttggcaaaaaagaatttaatgaaatttcatcactagagccattgtgtttagtaaggacaaaatttaggaatgcttagaagttggatcaatttttttctcccctgtatgtctcctcccaaacatacatatcctgtggtataaaatatgtaggccgggcatggtggctcatgcctgtaatcccagcactttgggaggccaaggcaggtggattgctttgagctcaggagtttaagaccagcctgagcaaaatggtgaaaccctgtctctactaaaaatacaaaaattagctggtggctcatgcctgtagtcccaactacttgggaggctgaggccagagaattgcttgttgagctgagattgtgccactgcactctagcctgagagacagagtgagaccccatctcaaaaaatatacatatgtatgtgtgtgtatgtgcgcgtgtgtgtgggggtggtatacaattgtttgcattgcatgacttattgaaaagtaatctgttcctcacacaattccattatatctctaagctacagaattccatacttagcccatcctatgaacttcctttattccatctctgctctatcttatcactgctttatattatttgtgaacatgttttatttttttttctttaattgcccatcaagtttcctatgcaggtcttagtagtgagatttacatcccctcaaagccccaaggtttaactctaggtttggcagatgcttaatgcaattttgcaaaatagatttttacttcaaattacagtagaatttcaatatgccctcatctttgctttggttttgtacagtgatgtcacactttagaagccctgcatctaaccttaataaatgggatcaaatattactattactaatgtttcaaacccaatctccagaaaaatagatttttcaagataaattcatttcattcatgttatggaatttaaaatttaccagattaataacaaagccctgagttgggcaatcaggcaggagaaagaaaaaaagggtattcaattaggaaaagaggaagtcaaattgtccccgtttgcagatgacatgattttatatttggaaaaccccatcgtcttagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattgcttcaaagagaataaaatgcctaggaatccagcttacaagggatgtgaaggacctcttcaaggagaactacaaaccactgctcaacaaaataaaagaggacacaaacaaatggaagaacattccacgctcatggataggaagaatcaatattgtgaaaatggccatactgcccaaggtaatttatagattcaatgccatccccatcaagctaccaatgactttcttcacagaattggaaaaaaccactttaaagttcatatggaaacaaaaaagagcctgcattgccaaggcaatcctaagccaaaagaacaaagctggaggcatcacgctacctgacttcaaactatattacaaggctacagtgaccaaaacagcatggtactggtaccaaaacagagttatagaccaatggaacaggacagagccctcagaaataataccacacatctacaaccatccggtctttgacaaacctgacaaaaacgagaaatggggaaaggattccctatttaataaatggtgctgggaaaacgggctagccatatgtagaaacctgaaactggatcccttccttacaccttatacaaaattaattcaagatggattaaaggcttaaatgttagacctaaaaccataaaaaccctagaagaaaacctaggcaataccattcaggacataggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttccaatctacccatctgacaaagggccaacatccagaatctacaaagaacttaaacaaatttacaagaaaaaatcaaacaatcccatcaaaaagtgggcaaaggatatgaacagacacttctcaaaagaagacatttatgcagccaacagacacatgacaaaatgtgtatcatcactggccatcagagaaatgcaaattaaaaccacaacgagataccatctcacaccagttagaatggcggtcattaaaaagtcaggaaaccacaggtactggagaggatgtggagaaataggaacacttttacactgttggtaggactgtaaagtagttcaaccattgtggaagacagtgtggcaattcctcaaggatctagaactagaaataccattagacccagccatcccattactgggtatatacccacaggagtataaatcatgctgctataaagacacatgcacatgtatatttattgcagcactattcacaatagcaaagacttggaaccaacccaaatgtccatcaatgatagactagattaagaaaatgtcgcacatatacaccatggaatactatgcagccatgaaaaaggatgcgttcatgtcctttgtagggacatggatgaagctggaaaccatcattctgagccaactatcacaaggacagaaaaccaaacaccgcatgttctcactcataggtgggaattgaacaatgagaacacttggacagaggttggggaacatcatacaccagggcctgtcatggggtggggagagtggggagcgatagcattaggagatatacctaatgtaaatgaagagttaatgggtgcagcacaccaacatggcacatgtatacgtatgtaacaaacctgcgtgttgtgcacatgtaccctagaacttaaagtataatttaaaaaaaaaagccctgagtcataacagtctgtgttagattgtattcttgttcaaatatttgatgaccctcccggtgggaccattgtaggataccacatcactcagatcaggcttttccatgtgatttgcaatgtccctctctttaggaagattatacatcacgatgtgtgacttgctttggtgaacatcatatgaggggagatgatgaacatcacttctgtgtggaagcttcaagagccagcaggggttttatttttggtctcttttctctcaaccagtgatacctgcaatatatcagacagaagctgatccattagctcaggttcgtcaggtccagagggaagatgacatggacgggaaccacagctgacccataatggacattaaggtgagaaataaatctttgtttttataagccactgaggtttgtggaggtcattttttaccacagcgtaacttagcctaagctgacagataaataagttttaagagagatagaattccatttacctgcatttatattatgaatcccagtaagcttagactagataatctataagacatctacttcttctaacttagaaaaggaatttattcagggagatattaagtagctcttagaggcaaggctgaagtttggagtgtgggcaggcaccaaagggaatccacgaggctggagctgcagccatggccggaacgtgaatgacctgattaagatgctgtcactgttaggtactggaaactgccactggcattctggacactagcaccaatggtggtcactagatactagagggtaccactacctgtgccagaatgaaccctgaactaatgcagcatctctttgttgcttgcccaagactcagctcttcaaagagagtatctgattggctagtcttgggtctcgtttctgtatttttgttgtcagggtactggaagagcaagtgtctctccattgggacttttataatgaaaagactcacaagatagttggtttcttaagtgtcggaaggactttcagatgctaaccaaaccgcatcccctacaaaagacaaatatcccccacaaacttagaagataagcaaacttgactgggcgcagtggctcactcttataatcccagcgctttgggaggccgaggtgggcagatcacctgatgtcaggagttcaagaccagcctggccaacatggtgaaactctgtctctactaaaaatacaaaaattaaccagacgtggtggtgcacgcctgtaatcccagctactcgggaggctgaagcgggagaatcgcttgaaccctggaggcggacgttgcagtgagccgagatcgtgccacagcactctggcctgggcaacagagtcagactccatctaaaaaaaaaaaaaaaagaaagaagaaagaaaaaagaaaagaaaaagaagataagcaaactttacagctctcttctgcatttccattatgggtgttgatatggtttggctgtgtccccacgtaaatctcatcttgaattgtagctcccataatccccacatgtcgtggggggtaattgaatcgtgggggtgggtttttcccatgacagtgagtaagtcgtaggaggtctgatggttgtataaagggcagttcccccgcacactctctcttgcctgcccccacataagacatgccttcgctcctcctttgctttctgcgatgattgtgaggcctccccagccaagtggaactgtgagttcattaaatctctttttctttataaatt

SEQ ID NO: 5484 - DNA, 34648 bp, human
aggctatatttagcaggtttccggaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcaggtagacacacctgccccttctcgggcggaaataaagtcttgttttgtgttcgttaaactttcgccgctaggcctcttatggcttccccggaggccactggtctgttttcagacgttcacgttccctctgccccgcaggtaacctataaccattttgtcttttagtccaacatgtttaccgtggctgatgtgttgagtcaagatgaactgcgcaaaaagctataccagacgtttaaggatcggggtatactggatacactcaaggtatcggatttaggcgtatctgtgtcagcttttacaagtgtaacctgtaacaggtagttcaaattcaatcaaggtttaggttttaataatcgtatgatacatagattgtattggtgaattacatttttatattcccgaataactctgtatcctgaaacattacagtctcttgaaaatgtttgagaaaatgttgagtttgagtcgtcttaaaggagcatattcaaataattaattgaactgacaataagataggagaaggaaatatttgtataatgaacacagtaagattaggcttgttttataaatatggcttataggttcctaaattaataagtgggtttgtaatacatttggatgaaggacattgacaccatatagaaaatactagtgtactgcttaataatagtttgggaaatgaaaaattttatctttaaactatattgaaatgtatgaatgtttagtttgggcagaaaatacctattagtatgctttatatttggattaacagccaggagtaggattagctcaacgtgttttcattgaaatatgcatttcaaaagcatattttacgtttaaaatatgtagctatatcctgtgtatgtatccttttttaatttaaattatatggtgagcatttccctgtttccttaaaagttttttgaaatcttcattttcagtggcaacaggcttatctttggatatttttgtaatgtatatagcagtcccctgttgttgaatattttggttatattctccaacagtccacagaggtgtgatgaagtggcagaattttttcctatacttaatatcccaatcgtaagctgctgaaatgggcttctagggaagtgaagttatgagtctgcaagtggatctggctaaccacccgtttcatttggaagctggggaaagaaagctttttctagaacccactggactgcttgtctcacggggtaagacaaagtgtgcaggggaaggtttctaacttctggccatggatctagaaccattatggaaatagaaggaaggtttccaatgaatgtagctcatctgtgtatatctctaatgaaacagtcctgctgaaatttctttcccttgtgtttcttttttatttttgtttttattttatgctagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtaaagtctttccttttctgtttctgaagtttttattaacaggttcttcctctgctgacagtaaagtgctgtatgatagctaagtgctcctcgactaggtccatttctgtttcctctttgaattcacattgtacctgcacataatatatttgttatataacaagtgggtactaaatttgaaattaatttcttggcgtctcatttagtctcacataaaacagtgatgtatagaatctctaaatgtttcagacctataattgatctatctatcctctatcttgtctaataagactctgccaatctgctgaatgtctgctgtaagcttggcactgtgataggcacactgcagatgttttgtgtgttacggatgaggaaccagactctggagaggtgaatcaatttgcccaacatcaagtaacttttaagtgacaatgcagggtggtaaatctagatctctaacatgagctctttttttcctgcactagtttcttcagatgtttctctttgtaattagataagtgagaaatacgtaatttaaaaaatctgtaaagttctcaaatattaaaaacacttgttttttttttttactacttttctaattattttaactatatttcttcaccattactgttgaacattagtactactttattattttaaaggcagatacagcagactttccctgtggatatgtgcgtgtttttttttttttaatagactttattttttcagagcagttttgggttcacagcaaagttaagtgggaagtacagagaattcccatatacctgctgcccctacacactcatagcctcccccactgtcaacatcttgcatcaaggtggtacatttgctacaatctataagcctaccctgacatgtcattatcacccagaggccatagtttacagtgaaggttgcagtgagccgagatcatgccactgcactccagcctgggtgacagagcgagactgtctcaaaaataaaataaatttcactcttggtggtgttcatatgtttttactttctttgtgttttctgtaattatccaaaagtttcatattccaaagttttagtgacacaagcttagtacagtatttgaatgaaaacttaaataatttgcatttcttcataagcaaccaaattttatttgtcagcattaggaatttatttattaatttatgtttttgagacagagtcttgctctgttacccagtctggagtgcaatggcgcagtcttggctcactgcaacctctgcctcctgtgttcaagcaattctcctgcctcagcctcccaagtagctgggattacaggtgcccaccactacacctggctaacttttttatttttagtagagaggaggtttcaccatgttggccaggctggtctcgaatcctgaccccaggtgatctgcccacctcaatctcccaaagagctgggataacaagcatgagccctcgtgtctggcctggaattcatttttgatacatcattctctaactttctaatcactttatacttttacttattgtgtaatagtcaataatacaattatatagcaggaattaatcctattcatacaacttaacggtttctactaatgtaaaatgcccatgcagaatatttactttaaaggaaaaccaattgaaaacaaatatcagtgttctcagagcagacatagtgaatggtatatactgtagtagaaatatattttaatagctacccaaaatgtctgttaaacaatattttaagtacactttaattacggttttaaggacagtaaaaatctatttacatttttaaacaatgaatactttttaaaaaattgtaattgaatgacccaggaactcagtcatgtagtcattggttcatcagatatttcagtgtcatctgtaaggcattaaacatttaggcatatcatctttgatgtgaagtacttagaagttaattagatgataaagatattttatccttttgaccttgatatgtttatagtaatttatttaacagtgtaagaaagagcttgaaatttgctttattagcatagttataatcttatttaatctgaaggatgtttcttaatttcatattcagaaacatatcctaatttatcatttaaacactgatataaaaatatgtctacttagtaacctattttttcttaaggtatttactatgcaggatctattacaactcattaaaatcaaccctacttccagtctctacaaatcactggtaagatggcttagtttctgtaatctactttggtttgttaattataactgaatagctgaataaaagtgaaatattttcttttaacaggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaaaaaaaaaaaaactaataacttttaggccaagtgtctttgtatactaggtatccctctcaagtataattggtagggtattagatgtattaatatttccttaaagaatgagagttgtgttcagtaatgtgttatatatcttttgttcttaaatgtttatacaggccgggcgtggtggctcatgcctgtaatcccagcactttgggaggctgaggcgggtggatcacctgaggtcgggagttcgagatcagcctgaccaacctggagaaaccccgtttctactaaaaatacaaaaaaattagctaggcgtagtggcgcatgcttgtaatcacagctactcaggaggctgaggcaggagaatcgcttgaacccggaaggcagaggttgcggtgagctgagatcacgccattgcactcctgcctgggcaacaagagcaaaactccgtctcaaaaaaaaaaaaaatgtttatatagacctaataaattgccttaattttggccttgataatagccattcatagagtccataactactgtgggtttcaggccattggttagacttgatgatgggctttgtagcatgaacataagctggcaacttggctttgatgcatagttattctttaggtcttttaaaataatctgttagtaatagtccttttgtgttggtacacccttggattttgtctgttgcctgcactatcatccccacaaggacattcatttattcatccattcattcgccaattcatttagaacttaatcatttgaatacttattttctgccagccattaagtctgtgacttaatcgccaagtctcttggtagtaatgttagcagaatataaataaattggagcacaagatattctggactgcccgcaaactagaccatctctactgaagttcagtatggtaaatgatcctatattctgtactctaagtgtcgtccagtgtgactctctgtgattatggaaatgtctgtgtctatgctgtttaatgtggtagctgctatcctcatgtggcttttgagccttgaaatgtggctagtgtgactggataactgaatttttaatttacatttaattagctacacttgcatagtgactaccatattagcataattctgaggtatatagctagtatcttttgcttaactattacttcaaaaggaaatttgtggcttgaagggatattaagaaataatctatgggccaggcacggtggctcatgcttgtaatcccagcactttgggagggcaaacctggctgatcacttgaggtcaggggttcaagaccagcctggccaacatggtgaaaccccatctctactaaaaatacaaaaattagccaggcgtggtggtgagtgcctgtaatcccagctacttgggaggctgaggcaggagaatcgcttgaaccagagaggcgaaggttgcggtgagccaagatagcgccactgcactccagcctgggtgacagagctggactccatctcaaaaaaaaaaaaaaaatctatgtagttactatagatacattatccttaaaagtagtttttccatggccgggcgcagtggctcacgcctgtaatcccagcactttgggaggctgaggcgggcggatcacgaggtcgggagagcaagaccatcctggccaacatggtgaaaccccgtctctactaaaatacaaaaaaaagttagccaggcctggtggcgtgcacctgtagtcccagctatttgggaggctgaggcaggggaatcgcttgaacccaggaggcagaggttacagtgagccaagatcacgccactgcgctccagcctagcgacagagcaagactccgtctcaaaaaaaaaaaaatagtttttacacagtctctttaaatgcatctggttcagaaagacatctggccgacagcccttaccagcttcacctagcatcccagtaaaatttctggaagccagaaaaactatgagtagcagataggtcaggcatcctagtgccaaaatttggatagaactcttagctaacaaaatagctcctggtaagataaaatttttttaaaaattggtgtcttctaattaagtaacagaaaacatgtaggaagatattgtgtacttaaccgttgtctgtcccctgactcagacctatggtcttatcctaccatatctatgctcagggggtgctaagctgttgaatggccttggtacttttcctcctagattctagtcacccattcttcccactgctaattttcctttcagagataatgatatctgttatgcgtgtctgtgtgaagagaccaccaaacaggctttgtgtgaggaacaaggctgtttattcacttgggtgcaagtgggttgagtccgaaaagagagtcagtgaagggagataggagaggggcagctttatagggcttgagtaggcagtggaaagttacagttaaaggtggttatttattgttagcaggggagggggtcccaaggtgcatggtggagagatcttgggactcattgtccagaagaagaatgtcacaaggtcgattgatcagttggggcagggcagaacaagtcataatggtggaatgtcgtaaggttggtcagtcagttaaggcaggagctgtttcacttctgtggttttttagctggctcctgcaggccatctggacgtatatatgcaggttacgggggttacaatggctgagcttcggctcagaggcctgacaatatccagaaaatgatgtgcacaaaatttggatgagggaagaaaatttggacatcggccctttgctttttggaagtaaaaattcttatctgcaattggcaaaagaataagacatatacatcaatggggacagaattaggaagtccagaaatacatccacacaaatatagtcaattgattttttttttaacaaaggtgcaaaggcaattcaatagaggaaagatagtcttttcaacaagtggtgctgtaacagttggatattcatatgcgcaaaaatgaacctagacacagatcttatttattataccttacacaaaaactaactcaaaatgaaccatagacctaaatgtaaaatgcaaaactataaaacttccagatgagaacagtagaaagtctgtgatcttgggtttcgtgatgagatgtaacaccaagagcaagatacatgaaagaaaaaagtagatcagttagactttattaaaattaaaaacatctctgtgaaagacactgttctttttgttttgtttttgagacggagtttcactctgccacccaggctggagtgcagtggcgtgacctcggctcactgcagcctctgcctcctgggttcaagtgattctcctgtctcagcctcctgagtagctggaactacaggcgcctgccaccacgcctggctaatttttttgtgttttcaatagagatggggttcaccatgttgatcaggctggtctcgatcccctgacctcaggtgatcgcctgcctcagcctcccagagtgctgggatgacaagcgtgagccactgtaccctgccaaaagacgctgttaagagaatgaaagacccagtgtcgaaacccatagagctttacgtcatcaagagtgaaccttaatgtttgcaaatttaggtcaggtgatcccaggatggtatgcagactgtgacaaaatctaatccccttcctgaagggagtgggggtgggggaaaaggtgctgagctaactactgtttttagttccaagaaactaaacatttcttaagtaatttatgcttgtggtttaaaacagtttcaaactattcagaaggatataaagtgaaagcaaagtagcagtttctgcccatgttctctaatctcacgctccactgataactagaattaacagtttcactccactgataactagaattaacagtttcttgtttatcttctagaattgtttgaggttaaaactatgtatttgtaattaaaacacaatcaattgggattatatcgtagatactgtatgcaatttgctttttttaatccaccaatgtatctttctgtagcagtatagactaattatttttaaataatgtatttaaccccctattgatggagatctggttgttttattgtttgctttttgccattacaggtaacctatgtgcagtgtgcaccctttgtgcccttgtgaaagtatacctgtgtaaattcatagaagtggaatgactagattaaagggcacatgcatttcgaatatatataagcactgacaaatttctcttccaagtgaatgagtatagctatatatccactcccttgccaacacttagcattatacaagttttaatcttagcagtgttatagggaaaataatggtttctctgttgtattaatttgcatttatgattttgttcatgtttattcagcatctaaaaattgtgttcatctttgacaatgtagttttttctgcaaactacccatgtttttccccatttttctgattttttttttttaaactgatttgtaagagttctttgatgttatgaaaatgtcatcactttagtcttggttatgcctccatattattgcaactatttttcccagtgtgttatttttttattttatgccatatgtaagttttcagtttttatgtagttagattgataaatatttctccttattccttccaggttctgtatcatgcttgggaaggccttttctcagatttattaaaagatatgactgggcacagtggctcatgcttgtgatcccagcactttgggaggcccaggcaggaggattgcttgaggccatgagtttgagactagcctgggcaacatagcaagaccctgtttatacaaaaagtaaaattagctgggcgtggtgggtggtggtgtgcacctctagtcccagctacttgggagactgatgtaggaggattgcttgagcccaggaggtcgaggccgcagtgagccatgattacaccactgcactccagcctgggtgacagagcaagacttttgtctctaaaaaaaaggaaagatatataatgtaaaaaatgataatgtcctaaaactaagattgtaaaaacagtgactgagcagtggttgaaagttctgaaacaaaactgtatgcatatgttttttaggttttcttatgcattttttaaaagaattggcagaatatcatcaagctaaagagagttgtaatatggaaactcagacaagttcgacatttaacagagattctctgggtaattatagccttctttcttaatttcagttctgctgttttcattttgaatgaaggaaattatctgatttaccatattgtgtgattgctccttgaactggagggatgcagccggcaggcaacaagggaattcatttctggaatcatcttgggggaccaggaagtgctctccagtgtcattccctagcctcatgaatgccagggctacactggccaaatcatgcagggattcaaaggcccatattcttccttgtttgttgagtttgacttctcttaactgggaggttcttcctcgtgtcttgtctaactttacagccacccagttagaagattataaactacttgctttgcaaagtactagagaagtcagtgacttatcacttcattttatagttgaggaaaccgaggtcctcagaggaagagcaacttggaaacactcagtctgcatcagaactaatagtggagtccaagttctcccatccatgatctggagctttttgtactatccagctggtctgcagtaccatcctgtctgtcagtttcgtgctcagtagagatgggaaatagctgtttaaaacgatatgcttaatggatttcttggcccttccttactcttaaatggtaacttgcaagaagataagttcataattcataaaatgtattatatgactatgcctttaagtgtatttttaattcaattagaaacatattacttgctaattatcaagcagtgctgttcagtggtgtgagccacatacataattttaaattttctagtagccacgttgaaaaaagtaaaaagaaacgggtgaaatttgttttaataatatatttaacccaatacatgcaaaatattatttcagcatatattcaatataaaaaatactaagatatttcacatttattttttgcactgtctttgaaatctcatgtgttttttacatttaaagcacatctcagttgagtctggtcacatttgaagtgtcaatggccccatgtggctggagagtcctgtgttggacagcatctggaaaatacagaaaagtagatggaaaaacatgtctaaagtcatccctaccagagataaacactatcgatgttttaatctacttctgccagcctttttcccctctgtgcatactttttgggtgggcgttatacacggttgagattgtactctgggttcagatttgcactttgctatgtggttgattctgatccatagttggtttgagggccatggactaagggaagagtcagtagacctcactttaatcctggttatgctgtcatgtagtcacttattaagctatatcagcatttgttctttatgtgtaaaggggaggggttgatatacgtgatctttgattcttttaaagttattgttttgaatatgtaagtcagctttaaccagagtccaataaagagctctctgccttagcacttagagagtaggaagagactccagtattttctgacttaaactgtactcttggctttctttttcctctaacatttcatgatgaacattttcaaacatacagaaaagttgaaacaattttagcgaacacttgtatacccaccacctagatgtcactattacacttgtgttatacttgcttcatcatttttatctgtccatccattcatccaccttcctttttttgtatttcaaagtaagttgcagataatccctacactttcccctaagtatcctctttacttttgaaccagaggtctggcgtcttacgcacctgacgatgtttctatgtcctaatttgatgtgttattttttaatagctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaaggtaagctttatcttgttactgtaaacaagagtgatgtttttgtttgtcttctaaagtcttaaccataggtatatgggaaaatatctagaacttttaataacgaatgggatactgtactgttgtgcaaatttttttttatttctggtgacatttgtttatgccttttgagtgaatcctacaaatagagtgaatgagataaaactaacatgaaataaatatatttggacagagcattaatgttaaacctagatgtagagagagaacttgttcctgtttttatagtataatagttggtatttttaattttttgtgatcaatttgcagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagaggtggtatttacaaatattttatgggtggctatttcctgcagctattagtaggttggctcgagatccagcaacaggatggtacagttgatggaacaaggccccagaagagcaatagggactggggccaagagtgcaaatagaaggatggtccttgaaaaggatacacaaatttgcttcctctgagactgatggaaaggcgagaactgtggaggtgaacaatcaagttgggattatgagaaacacaccctaaataagctccatctcctcaggcagattagagggttagatcttgggttttaggagcagattggaggtgcagagtagttcctgtgggtaagggaagaacagccctttaaagcagagaggactgatcacctgtattgagggctcagctgtggttgggggagcctggaattgagagaggtcaaaccaggtgcttgtaagtgagttttctgttctagttctggggaggatttgtaagtatctctctgtccctttcagtgagggtggaaagatggagatgcttgggaagtagagcttttcagagccttatttgactagagaaaggcagcctacttaatcgaagattctggggctctcttgggtagtgaagggaagcagaggagagggcaggtggctgctaacctagggggaaaggaagggttgagtggcagtctcagtgatcaaggactcgatctggatagactggtaggtggaagaatgaggatggtccaagattacagaattgcaggatgaggtttcaggtggagactagaaaccaaatgcagtatgctgccattggagagagccatggaaatgagcaagggtgaaggtccctggggtaaaggagtcaccacaagggtcatccatgtgaccatttgatcttgtcaccccagaaagtaactggacaggagacagagagggtgaggagtgagagggagtccatgttggcaagcaggattggatctactcctttaaatcatattcctttcccaagggcgtgtcttagaccaaactagatttacagcactatttccaacatacatccagaactactgctgtcagatgttgaaagtaggaatgcttccccctagtgtccactctcgcctggggcttctcaataagacctagttgtttaatgctaagggcaccccctctaaaattttgtatagcatttctgggaattgggtttgcttcagctataaaaatgaatgtcagaagcacatatctttgagatgattggattgtgtttagactaataacttcaaccttcaagataggtgactgactagatccctgtttatttatctgatcatctgaaggctttgaagaagattgtcatcctcataagaagcaccatgtctttattccctcacctggactgtccatccccttctctccctgataaaaaccatagtgtctttcaagacccagcttggatgtcacctgggtgatgccgtccctgactcccactgagcgacccatttaggcctcattcctgcatcagtctttatgtacttcagttacaaaatcatcacatcttagtgtgattgtttctcactccctgactaaattgtgaggtctttagagatgaggactatatctgtctacctttttatatccagttcccagtatgctgcttgacatgtcataggtagttagtaaattctttctctgtgaacacacaaatggaaggatggcccattcttttaggagttcatatgagcttgctaactctgagtcagaatgacccgtgaactgaaacattcagacgacaccaccactaaaaaccatggggattcaattcttttggagttttactgctgaatgtacattttgcttaatttttctttctggggaacttgccaaaatttaggtaagggcgccaggtgtggtggctcatgcttgtagtcccagcaccttgggaagccaaggcaggcatatcgcttgagtccagaagttcgacaccagcctgggcagcatggcaaaaccccatctctacaaaaatacaaaaaatcagccggacttggtggcgtgtgcctgtagtgcctgcagctactcggtaggctggggtgggaggaccccttgagcttgggaggtggaggttgcagtgagccaagatcaccccactgcactccagcctgtgtgacagagtgagaccctgtctcaaaaaaaaaaaaaaaaaaatttttttagataagggactgagagatgttaaagaactaaatagcataaatttcacatggcatgttaggactgtagggtaatggtagtttaacagtcattgggggagtaaatttttatgcaactagaatacgcaaaaagtataccttgagtcggaatctcttgaaggtgaaattgttatcctaaatgtctgtactttgctttttggaatgtaggaagcagtatattcattcaaatctgttttgctttcattagcttgcttgctaaaaattaatgcttttctatacagattgaaacaaaagaaatttatgctcaaaggcaacttttactaaaagatatggatttgctaagaggaagagaagcagagctgaagcaaagagttgaagcttttgaattgtaagtaatgcatgttcattttggatattcagaatgatgagattaaaaagaattactaaatatatatctaaatattctaatgttcattgccaagtagagttcttatttgtaaaggggatatcacctagaaggtacaaattaagaggaacaaacactagggttttgtttttgaaatattaaacattaagatgaaaagacgaatgagatgctatcatcaggctacagtaagaccagacagattatttggagaagctgttaatactggaacagatcgtatgttttgcagttacattcagtccctcagatctgatagttccgtgtgtgtatgtatagtaactgaattccatatatccaggcctgcagcttttaccagctgtgtgctcagaaaaggaagtatggtggtccaacttgacttgtacttggtgaaaccatttctttgttactcactgtttctaagtgctcacaaatgtttcatccttgagatcttacctgggattgatggcaagttcacctgtctatagtttgtgcaataagccttctcttcctttgggaatctgctattgacacccatagatactccaggaatcttagttcattaaagaatttggctccattaatgtttttttctcacttctataggcttgatttgtttgatttcaactctctgtctaccttactctctttttggcaataatgaaaaggtaaattgatcaagagagaggaaataggcacaaaattggggcagagagagttcatcattcctttacctccattttctctactcttgttccctccttctcagcatataaactaaataaatgtagtttacctctccatggctttccagattaccagcagagggagctaatacctagagcctttacctgttcttagactagtcagcattttgtagcacttctcaggatggctggatctcaccacccatgaacctacctccctggctaaggagttggtgctatggttgatttaaagtctcactatgaagaccattctattcttcagtatttggaagccctgattgatccatctatcttttgccctctcttttggtacttttttcaatattcaatcaatagggttttttgtttgttttgttttgtttttaagacacagtgtctctctgtattgcccaggctggtctcaaacacttgggctcaagcaatcctcctgcctcagccttctgaaaagctgggattataggtgcgggccaccacacttggctaaagctgattggttattaaatgacaaaaacacatattgtaccttgaatatgtatggactaattaattaaatcccacagttagaaacagcattatagaagatttaagcacataagtacacttatttgttactttgtaactaataatatcattatttcatcccaggattgattttggctatttatcacctataaccattgtttgagtgtttattttcagtgagaaaccacttccctcttgagactctcccactcccctcagcccaaagcacagtcaattctgctagtttcaatatgctgtaactaggtcagttcataaaatacactgaggacttctggctctttccttctacttcccagtagtgatatcatgtagcagttttagtctgtggaactagacacatgtgattttttcctaaatttgttagctcagctatggtagtttatttactttttatatttttgttaatttcaggaaccagaagctccaggaagaaaaacataaaagcataactgaggcacttaggagacaggagcagaatataaagagttttgaggagacctatgaccgaaagctcaagaatgaacttctaaagtaattgtttagcatttttaaataactaatatgtttaaattaaattggtagaaacataacaaaaactgacaaagtagtctgtaacttaggcaaactttagtgtttgaaaaaaaaaaaacatagttttatcgatacagtcaatcctttcctgcatttgagttaggatagtttttaaaagataagggccgggtgtggtggctcatgcctataatcccagcactctgggaggctgaggtgggcggatcacctgaggtcaggagtgcaagaccagcctagccaacatggtgaaaccccatctctactaaaaatacaaaaattagctgggtgtggtggtgggcacttgtaatcccagctactggggaggctgaggcaggagaatcacttgaacccgggaggcagacgttgcagtgaactgaagttgtgctactgcactctactagcctgcgtgacagtgacaatccatctcaaaaattaacaacaataaaaaaatacagagaagcacatcctctgcgcttcttatggcttctctaacgtttattgtgggctgtgatttgctttaattttcaggacaccttgtgacttgcttagcttgcatagttgataagctgtaaaattggaattataaccacttttagttatcttttcctctacctcactcatacagtcagaaggatggggttatctgacaatatataaattatactagtggtcatagtatttgtcagtgaacatgtgccttgtattccttcaagattcagcaaagccagaatcaaaagagctaaaattaactatgtgaggcaaaaagtgatatagggaaaggaaaatatggacaactatggtaactttggcttttctgtagtctgagttttgtgtatcagtgaataatatctcagtgctacgacattatgcccatgtggtaacatttctcttcagtgtgtgggaaagcatctggcacataaaaagtgctcagttaatatttgttgtaaatgtgtcacgaggaaatgattcaactcaggtgctctgggcatttcttatttggcctcttttattgcctttctcataatttgtcatcgatattccattacataatattgcaaaggtttcttgaggtaatcctttaaacaaatcctatttttaaaaaatatggcagcttttttatctattgattttgaaatgatgtattttacccacatcttctatgtcagtttctatactaaaatagctaaaatggaagtgtctgtagttgctgaatttttaggaataaatgaattaaagtatgtgtgttaattttacatagttatggagctagtgaactatttggtgtcattgtgacagcttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaatccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaaggtgatgtttggggggaaaataagctgtatttttcagttctgctgtaggttattagcttcccaagttgggtcttttctatattctaaaaaatacagcttacacttcattgttcatacaaaattacacattttttgtaattttaattttataaattaaaaatcatggtcttcactgccttttgaggaaccttcatgtttaatagtttgtatattcacaaaggccagtgatttatcatggatattttatccaactttatttcatatattttgataaatctgcaattgtcaggaacgtagcagcaacttattgctgtcaagtacgtattactcctaaccatgagagactttatttttcacttacggaaaacttttaacttctctgtcctctgtgacctagtttcttatttcttttgcttctaatatatttttatgctttataatatttttacttgatgtataaccttctgaactcttgtgtacattggcctgagactatggaagttgaataatttttcaatcttcagatgttttacatttcagtgtatttttttttttttttgagacggagtctcgctctgtcacctaggctggagtgcagtggtgcgatctcggctcactacaagctccacctcccaggttcacgccattcttccacctcagcctccccagtagctgggactacaggcacccaccaacacgcccggctaattttttgtatttttagtagaggcggggtctcagcgtgttagccaggatgatctcgatctcctgacctcgtgatccgcccgcctcggcctcccaaagtgctgggattacaggcgtgagccaccacgcccgacccatttcaatgtatttctaggaaattgctgtaacaagaagttgaagttttggtggaaatttcaagtagattcctgggaggaaaccagggttagatagttgatgttgaccagatacccaatgtgtggctactgtctttttttttttttttttttaagagacggagtcttgctctgttgcccaggctggagtacagtggcacaatctcagctcactgcaacctctgcctcctgggttcaagtgattcttgtgcctcagcctcccaagtagctgggactacaggtgtgcgccaccatgcctggctaatttttgtagagagagagtttcaccatgttggccaggctggtctcgaactcgtgacctcaggtggtccgcctgacttggcctcccaaagtgctgggattacaggcgtgagccactgtgcccagccccttttactatcttgtggagactaatacttcttttatgcattaataccattacgtatgtaacaaattatggtttgatgatatatctacatagacttgtgttagatgaagtgaaaactacaaaatagtaactacaatatagtaacagacagatctttgtcttcaaggaagttaagagctgtgggtattagggccctgtgctttgagcacatggtataactctggttagcatgtatagcaagtggaatttcaccacatatatgacagttacagcttcacatcacctgttgggtaacagggtttatttcttacttgcccgctacatctgctatttggattgtgaaatagtggtcattaggtctgacatactggccataaatattaaatggcttttgtattcactaggaaaacattatggtgtttaattggtgggctcttttttcagaaaaagctgttcatttgcaagaggagctcatagctattaattcaaaaaaggaggaactcaatcaatctgtaaatcgtgtgaaagaacttgaggtaattgttaagcatgttggtttttgaaatagattttaagcaatatatgaaattttagtcatacataatttatcctaagtcatcctgttgagatgtttggactgccatttatatggctaagaaggtgttagctgaagttaattcaatagttcttaatttcagtcagtgtcacataggaaagtgtagatagagctttgggtcctggagtcctgcccacatcctgtctgtgtctctaactgcttgtgtgtcgctaggtaagttctgtgactgcaggttcctgagctgtaaactaggatgttttccacattatagggttgttgagggaattcagtaagctaacttatgtgcctagttcatagcaggtggccattactattagtttctacatcagcctgttatctccttccatcagcagcaggtaaacaaaattcctgtcattacattgttatcttacagattaaaacaaaatgaggtacatttttcacatatcattgcttctttacttttctgttcattcgtgtgcttgctgtctgaaggatgaagctggaactttaggtacttacaacatattttgtatatgaaatttattttagcaactgtgacttatgtgagaactttgtaggctttttactcaaatatgagatatactaagaaaagggaagcacttcacaacattttacagaatcttttttcctttctttcccttttttttttttttttttttttgagacagagtcttgttctttcgcccaggctggagtgcagtggtgtgatcttggctcactgcaaccaacctccacctcccgggttcaagtgattctcatgtctcagctcccaagtagctgggatttcagccatgtgccaccacacccagctaattgttgtatttttagtagagatggggtttcaccatgttgcccagggtggtctcgaactcctgagctcaagcaatcctcttgcctcagcctcccaaagtgctgcgattacgggcgtgagccaccatgctcagccatttttatcttacctttcatatttaaaaaatatatattgctatgatgtgtgattattgttgggttcttggttgcctctggaaaatgggatgataatcttagaaggacttgcttcatgggatgcggcctataaaagttctgccccaactgtagggcggaagataattttcgttattgtagttagagtcttattgtagagaatcagacttctgtctagtgaccttaattaaattgtgacaccatgcttaaaggagcctgccagcttttacttttgcagtactgtaaagtcattattcaaatgtaaattttcctttttgaattttagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgtatgtatttttcttttcttctgacttgcgtgttttagtaattcgcattaggtcagtattataaaactatgctttgtacttgtataaggtagggggcttacattgggaagatttataaaattaagattcttggattaaactctgcaaacctgcctataggtggtatcaaagcttcccttgccctctgactgctgattgggtttggccagtggggacaccagcctctacatacagtggccctaggctggccactgtgcctcatggccaagtgaggccatagtgcctgcgattacctcttccaagtgctctgcaccaccaccctgtctctagtgctgagaatttctccctcctctgattccccaggcccaaggagcgctaacagtatggccctgttactagcccacccagggaactccaccatcctttgtgcataccctgaataagtcaacctttattaaagggttcttagatgaccttgaccgtgagagccatctgccttctgcctggatcccaactgctgctgtcagatgcccagatcatattggatcccagggctgtcatcaacaggtagaccagatagagagctccttctgtgcacagtagaggagagaaacaggctttcaggttaatttgagaatttgaaagagttcttttacttggagtaggactccaagggtaataaagtttgcattaacatgcactaaattcttttgttgtgaaatttgagagtcaggattgctctgagctcatttaatagaattattatcatatttattgagtcagtacaaagcaaagaacactttaaaacccctttaactgtttttgttaagttaaataagaaaacttaaggttggtaatgactaggattttttttttttttttaccttcttaggcctagctcagccggctcctgaacttgcagtctttcagaaagaactacggaaagccgaaaaggctatagtggttgagcatgaggagttcgaaagctgcaggcaagctctgcacaaacaactgcaagacgaagtgagtattgctcttcttcagttctagtgtgataccagtacacttcatagttacgtaaacttggcacaagtcacactagtgtaaatcagatttattttaacatcaaacattactcccccaaatatgctaaaggtatcctttctcatctgagaaaattctgcagtgataacgtgactttatattcgtaatagtaataaaatggagaagaaagcaaactcacctaaacataaaattttctgagtgcctgatggtgcccactgttatctctcgattctcaccctgataagtattacaaacattcactgtcttctgatttctgcctgcatgccctagagttctttgatatgactgaaaaagatggtgaagaacttgtttgtgtgttctgcttgtgtttttttttaatagggaccctgttgtttactgtcataaagcttcttggaattggcagaacaaaaagagtacaaacatgataagagaacttttccttttgaagcaagctgtgatttgttttacattgatttcttttcctattctgaatcttttcagattgagcattctgcacagctgaaggcccagattctaggttacaaagcttctgtaaagagtttaactactcaggttgccgatttaaaattgcaactgaagcaaactcagacaggttagagacgttttaacccataaatatttttgtatgtataaagcttctggtgtctgtgaaaatgtaatgatcataatttattgaatattaattattgttttaggggaaaagccatagaaatatgtgtcatcttagaagtaaaactccctatccattttggtaataccatctggatcatcagcaaaagtattttgcttcataggtgcctcatggcttgggagagtctcatgccccaataggaaaggcgtggtggtaacatagaagtccccatattcattataggatttccttttttatttgttaccccaatgttaacaccaattcagtagttttacggattccttgatagatatataaatatacaggacaagcagggtggtttagcaaaaagaatattgccttcagaatcagaactgttcttcttttggacccgttttgaagttgtttgaccttgggcatgttactttaacttccttgggcctcagtctcctcatttgtaatggggataataatacctactgagccatgatgaaaaagatgaaatgggtttcagtccagtgcctgggacataaaagacactcaggaaatggttattggtatcattttattattgtgtcttcactgtggatgcatctctgccccttcctacttcgtaagaaggatattaaagttcagatactttattcttcagttgctttcaagttcaaagaaagtacgtatgtgttaccagttcaactgggtctgagccttccttgttcccacctgcattgtttcctcatcagctccttgctctcttctaccagcacttgttttatttttatctctactcgtttctgcttttttctgttcctcattttctttcagttctgtttgtgaaacttctcacagctgaaatcatagcagtctcctatcaataaaaaatagttgaatgaggatagaactctttcgcatgcatgtgttgccgagggcaagcttctttcttgtagcatcacggggaggcattgcaggagagaggggcaggtgcactggctttgcattaggaaagcccagtagctcttagacttgctaaccgtgtgacccagcctcagtaagctttagtccccccatctgtaaaatgggagcagtgagagtttcttgaccacagtgttgttgtgaatgcaggtcctcacttccttatatgaaactcgggccatatgctgtggatttcgcaatagccctgggagttctgaacagcatcctatagtaaagcacattaattattttgcagtcaactgtatgaatattcatgctgggataaataaagattataaatgggtttacatcagttcaggtcaaacttttcaaccaaatgagttcaagtctggttgggctttgccaccaaataaattatgaataaattttcagttctcagagccttgtggctttcaaaattgtgcataatggattctgaaattatatcatgttacaaaagacatacaaagctgtagctggtacaataagctctcagtaaatgttagtggttatcgttaccatggcttcagaaactgtatagtgcaagtttgtccttattactctcttccatttttcaaaaaaataatattctcaagtatattttcttctctgccttgtccacttacttctgaaattggctttttgtaccctgcagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtaagccacccgcacaaagggttgcggggtgctctggagttgggtagccaccctgcccacgacacagggttgccgtgagggtcagcgggccagagtggcaaggtctagtgtttggcacacagagctgtttagagagtgatagttgccttgcctttgctgcctgttggtttcctgcattttattattgccactgcaatttaatttaggtgcttgaatcattagttttctggatcttatgcatcataattggctatttgtgaggataacagtttattttcaaactagtagagctctttagaaaccacgttggtatcttctccgtgcaattggtaatattcttgccttggttctttctgcaccttaggtctgggcagatcacacattgcttcccccagtccttgtcctgacagaatgcccctaccatcacccactgagtctaggcacagcctctccatccctcctgtctccagccctccggagcagaaagtggggtaagtataacgttctgattgattagcttcagctgaataatgttacttgctctgtcagccttcacttgttttactgggattttttttttttgagataattattatagatcatgtggcagtatagaatttgcaatcagattgcaaaatgatatgtcatctttgagaatcatctaaattacctggagggaaaaagattgcttttagcaaataagtggataatgcttatttgctaaacttgatatatggaccatgcaatctggtattaataagcatcttcctagttctgtgaatagatttggtttattaagataaaaaacaaatgtacaaaatctgaaagcaaacaaatggaggttatttataaagttggaacaattttacacatcattaaaaagtcatttttaaaatattttggcattgaaatataaacagataaggttctgacctgcatatcattgaaataaattcaaacgtggtagcaggctctggtgtatgattgttgaaacaggaaggagtggatgtttttagaaactagtccactgggtcagccaggctatgatttgagtcatgagcagactcctacccatacctgggccccacagcagagggaactgactccttagctccaggctcgatctcgggcatctgcatgttaatgtagttctctgccacatgggcctgtcgtagtcctaaagctttttttttttttttttttttttgtgataagccaaaaggaaggataagacacacacatatgctgagttagggcgctttgctcactcaaggttgtggtgttgcatcttcatctggttcatgctgatagtgtgcagaattttttttcagaaatgttttatggttatttcctaggaatagcattcagagtacaacattattctttattaacaactgtagtacctacttcacagcatgaaatagttacaaggagtaactgattaaacaggtattaattgctgagaacaatgcctagtggtggtggtgaggtggagctatttacaagacaaagagaaagggaattttgtagagccttttcttgagtcacaaaaggctttttgtcaccttgtactctttggttttccattattgaaacttcacgagttttatccttccaatctagtctttatcgaagacaaactgaacttcaagacaaaagtgaattttcagatgtggacaagctagcttttaaggataatgaggagtttgaatcatcttttgaatgtaagttcaaatataaataccagtttttatatgttgaaaatctagaaagcttagttttggtgaaacgtatccattggtttaaaaagaaaagcagttacaaattgggtcattattattttgtgatacaaccacaagtacagatgtatcacctcatttttctaccatgatgattttcatgtgtgtgtttactttttaaaaatttcagtatgactaataatttcagagtttgagctaagcttataaatgaattattaacttatcagattttaaataagtgatttttatttattttttcctttgatggaatacaagaatgtttatttttatttttttgagatggagtctctctctgttgcccaggctggagtacagtggtccgatcttggctcactgcaatctccctcctcctcccaggtccaagtgattcatctgcctcagcctcccgagtagctgggaccaaccacaggtgcatgccatcacacccagctagtttttttgtatttttagtagagatggggtttcaccatattggccaggctggtcttgagctcctgacctcaagtgatccgcctgcatcggcctcccaaaatgctgggataacaggcatgagccactgcgcccggcctaaggatgttattttttaaatatactgattcagttgattgcctcagatttagaaaacctcatttttagtaaaagaatagagataaaagaatattaagagtccagaaactggtgtcctggctatggccctgccttagactgtcttactttgtagccactttgtaagtgtaaaataagcatgtagagcctatcatctctaaggttctttccagcttgagaaatctttatatttgcatataagctattggttagccttgtaaacttcatcttcaaatctgaaagtgttaatattttgaacagttaaatgagagggcttggtaaattttgtaaatatttgttaaagtctttgtgttaaatcattgatattttaatagaattcaaatgatgatcagcaagccaattgaattcttcactgtcactgggttgattttcctgttgggtaacgaatctcattttgtaaacaaagttaattctttcaactacgagaacactctgacaagcaaatacgttgccaagtggttatgttgggaacttcatagaatcctgttaggaaagggcgcacccagttactttggcttcagttcccgtgctccagtcagttgcccccacactgcactgcccttctttgtcttggtgttattattaaggactcatgggacaattgtgcctcatgcagctgcagggaacatgccaaggcagttggaaatgggcgggctttctcctgccggggatatgtctcatgtggacgctgctgcagctgctgtgcccctctcatatcagcacccaagtaagttctttttttgaactaacagtcagcagggtcgcatactaaataccagtccgtgtgctctgtgaattatttcatgtatcactgaagtcatcttgtaggtgtaaattagtcaaaatcttgggttgggggttataggtgtcattatattgttaatgacatttctgaagtaattcccatgtgaacatgtaaagacagtgctgagaaaggacacgttggaaggaaaggcttctcatttaggcttcccaggccagttgcttaaaaagtgttttcatttactcttcagtgcctggcatagtagttggacttttccccaagactcttctgcaaaaactgttccttgggaaccttaaagtttgggaaatcacagtgaaaaattgaaataataattaactcccagcatatatctttaatatgattgtaacatttaaatattatttatttttctatctacttgtttcctttgtgtcttaagaaattaggacagaaaaacttcgtatttcaatctttggaaaagctgtgacaccgagttagcgtagcactggaggaaaactggccatcagacttctcttctctggcccacttcctctttttcctcttctcctccagattacccacttccctccctgcgggtggagggagacgggaagagagccgtgggagctttgtgctttgttccagggctcagccaacagccaggtccttttcttcttggaccaagtgtttaatcctcaaatctgaaaggaattttctcaagtaaagccacctcttagtccctcccaaacgttggaaaaacatcatacccaaaacccctgttagcagtttcttggttttagtcatggtacccaggaacatataaaataactgaaagaggcaagagattttgagagggttgatgttgctgattccagagtaaatctgctttggaaagcattcagtgagacatgatctagagccttgtctctgctgggcactttgctcagcgctgagcatatagctcaagccctcgccttcctggatttctagcaggggaggcagatggtcagcaggccatcacccaggaccgcagcagggaggggctgcagcagctgagtaggggccgtggccacaagagggagtgtctacaggcactcatttggcacagacctgagcgagggaatacaaataatgtgataggataagggaaatcaactgagtaactaggtgttctgctgctgagatggaacatagattataatatttgctttaaaaattattaagcagcatggcgagtgacattttagttattgagaaattgttatatttgtcatttcatctcttcatctgggcacaaagggaattcaaaaaggttgaaatttggtgtctcggaggtgccccgtggacatgcttccttcctttccccttgtgtccaagagatttctgtataccaccctgcagctacaaaatatacaccagagtagagaagcagctcactcttcctctttattttgtaattggtgcttaaacaacattcctattttgagattactattccatataagaaagcaatcttgtttaggagtaactattttttcttctctagcaaggaggaagttgcatttctgcctgtggaaatgatcagctgtctcctctggtattttaatttcatgagaaggattcagaagagatgggggagagagagaagaaactgtgttgcttctctcctattagtaaaactcagttcctgctgatcactttagaacaaggcacagcaaaaaggttcaaagtcctctgctgaacctatgaatttttctacttattagcattgcttgggttgaaaaaaaaaatgtaggttatgggtcagagccagaagagaaaggtcagcataattgtctctgggattggggtctaattaaaacttttgagatatagggacctgtgccaagatgcagagggaacagacaagtaattaaagtatggaccttgcctggaaggaatagaagtggaagaaacaagtacatgtagtttttgacagatcaggtacaagatatcctgcaagtgagatgctggagtggttagttgtcacttcaggaataaggaggaggtggcatttcagttgggtcttgaatagcatttcagactttgtgagagcaagggagtgctacaggctgaggagacagtgaaggtgaatgtcaagcaaggaagatagagccacggccaggccccagtgagtgggttggtacagatgaaatatttctcgtacaaagttggtggtgatgtaggaaatcaatctgggaagaaaagggcaggttgtcagagcccagactaccatggcgtaggactcttatcagagcggagatgctgcacagcagatccacatcttcccctcaggaaatgcctggtgcagatgaccacaggttgttggaaggcagagactggcttcaggaagagccttgactgggctgtttcagtagtccagggagatggtgagaagggcccctgttgcagccacaggacagggagtgtgaacctgcaaacactggtggctgagtggatagagggtagaaagagcatgatcgaaggaccgggatgatcatgcctgggacgaagctagtgctgtggggtttccacatgcggatggcaaggaactatcagaaatgtggacgcgaggctagggagagagaccaggagtagaggaaaagatagggaaaggatccatatacaagtgatggctaaaaccccaggaagggctgccgtcagtttggaggaagtggggaatgaacagtgagatggctggaatggcggggggagggcagtggtgtgatttctgttctgttttgttggggtaggacagacttgagcatctttatgggagtaagacttctaaaactactgtgtacagaaatagggattaatggctcagtctgggtcctaaagataggggagggattataatcaaaggcagaggcagaaatgcagggtttgccttggaaaggagggaggagatctgtgaagaggatgagaacatgtgacatggaaggaggacagttggagttggttatggtgagggtgacgtatttgtctcagtcaagtgaagtagggtacagttcaaggagtggggtcgggagcttgaagtcggtgaaaatgaaatagtgacttgaagcaggtcacagagtcaactaaaagccaagcagagtctccgtgggtcttggcaagggctcctgcagactggtcctgcattcatttgaataatctgatactggaagctactctttattttctgtcctattaggtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaagggtaataagtatgacttgattctctgaactggttgctccattgtacacctttcgtaagtacattgagctcagggaggggagtcaattggtgtacaaagtcagaggtgcggcagatgccttaaaaggcatccctgtcctctccttgtcttaaaagcagtgggaaaggctgcacagaatgtgaagcttaggagttttgtagtaaaggatagtttttgaaggtaatttttgtacattctcatctgatccttaaaacaagcctgtaaaaaaggtagactgtgctttgctgcagaactttgctttgaaaacagggtttaaagaagagactgtcagtgccagctagctgggactagaacccaagggaggagtggctgccagttcacagttgcttccaggggcacacactccctccctccttcctctatttctcttcttgccttctgtgtcccaattctagtcctagcagatggattactctgtccacttaacacacctgctaagtcttgcttgaattactctaacatatgaatgttccttggactcttggttaattcaagtccaaagcacaggacacttgccaattaataccttccttcattgagatgacatatttgtcttcctttgatgatagcaatgacttcaattttaaaaattagtcctctggcatacaggctgtacttgaaggatcgggattaatattagtgcatttttaaaacacttaaaagttttacaaatgtatttgtgtattttctgttttggtgcctgttttatagaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataaggtgccagtgccatgggcagggcaatctgtgggtgggggacatccagggcttccgtggcttaacttcttgggacgggaatccgtcttctccattgaagacaaaaaggtgaaaagtatagaaaatccaaagttcaaatggaaccttgagtcttttaaatatactattcttttgacaaaaattcatagcttttttgcttaaggtaaaagatttaagagattttaatttgtaaaagttggggtggctcattaagaaagaaaagatctatcaaatgcattaatactgacattaatattttatgtaagtctgaagtattatgggtgttaaatgcataccctatagtttattttgatgtgcttgctaaatttcatgtttaaaagtcacctcttttttagacttttaaattacatatatatttcaaaaatggttcttaaagtatttcatgaaattaatgcatatctaatttcaaaattttccaccctctccatgtaatcagagctcaaaaaagatggtccaagaaggctccctagtggacacgctgcaatctagtgacaaagtcgaaaggtacctgttttccctacacactttcatacacaaactgttaattgcttattttgtcagccaagagaaacagatgtttgagattgcctgtaagaagttattgaatcagtcaaaattagtgactataaaaacaattgagttttttgacttgtgaaattgatcctgatataaattgtaaactagggcagaaaccccccagggaaggaattgagaacattatgaagatagcaaataaacttgacacaaatttttacattttaatttttatctttccctaatttagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctcctta

SEQ ID NO: 5485 - DNA, 18173 bp, human
tccggaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcaggtagacacacctgccccttctcgggcggaaataaagtcttgttttgtgttcgttaaactttcgccgctaggcctcttatggcttccccggaggccactggtctgttttcagacgttcacgttccctctgccccgcaggtaacctataaccattttgtcttttagtccaacatgtttaccgtggctgatgtgttgagtcaagatgaactgcgcaaaaagctataccagacgtttaaggatcggggtatactggatacactcaaggtatcggatttaggcgtatctgtgtcagcttttacaagtgtaacctgtaacaggtagttcaaattcaatcaaggtttaggttttaataatcgtatgatacatagattgtattggtgaattacatttttatattcccgaataactctgtatcctgaaacattacagtctcttgaaaatgtttgagaaaatgttgagtttgagtcgtcttaaaggagcatattcaaataattaattgaactgacaataagataggagaaggaaatatttgtataatgaacacagtaagattaggcttgttttataaatatggcttataggttcctaaattaataagtgggtttgtaatacatttggatgaaggacattgacaccatatagaaaatactagtgtactgcttaataatagtttgggaaatgaaaaattttatctttaaactatattgaaatgtatgaatgtttagtttgggcagaaaatacctattagtatgctttatatttggattaacagccaggagtaggattagctcaacgtgttttcattgaaatatgcatttcaaaagcatattttacgtttaaaatatgtagctatatcctgtgtatgtatccttttttaatttaaattatatggtgagcatttccctgtttccttaaaagttttttgaaatcttcattttcagtggcaacaggcttatctttggatatttttgtaatgtatatagcagtcccctgttgttgaatattttggttatattctccaacagtccacagaggtgtgatgaagtggcagaattttttcctatacttaatatcccaatcgtaagctgctgaaatgggcttctagggaagtgaagttatgagtctgcaagtggatctggctaaccacccgtttcatttggaagctggggaaagaaagctttttctagaacccactggactgcttgtctcacggggtaagacaaagtgtgcaggggaaggtttctaacttctggccatggatctagaaccattatggaaatagaaggaaggtttccaatgaatgtagctcatctgtgtatatctctaatgaaacagtcctgctgaaatttctttcccttgtgtttcttttttatttttgtttttattttatgctagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtaaagtctttccttttctgtttctgaagtttttattaacaggttcttcctctgctgacagtaaagtgctgtatgatagctaagtgctcctcgactaggtccatttctgtttcctctttgaattcacattgtacctgcacataatatatttgttatataacaagtgggtactaaatttgaaattaatttcttggcgtctcatttagtctcacataaaacagtgatgtatagaatctctaaatgtttcagacctataattgatctatctatcctctatcttgtctaataagactctgccaatctgctgaatgtctgctgtaagcttggcactgtgataggcacactgcagatgttttgtgtgttacggatgaggaaccagactctggagaggtgaatcaatttgcccaacatcaagtaacttttaagtgacaatgcagggtggtaaatctagatctctaacatgagctctttttttcctgcactagtttcttcagatgtttctctttgtaattagataagtgagaaatacgtaatttaaaaaatctgtaaagttctcaaatattaaaaacacttgttttttttttttactacttttctaattattttaactatatttcttcaccattactgttgaacattagtactactttattattttaaaggcagatacagcagactttccctgtggatatgtgcgtgtttttttttttttaatagactttattttttcagagcagttttgggttcacagcaaagttaagtgggaagtacagagaattcccatatacctgctgcccctacacactcatagcctcccccactgtcaacatcttgcatcaaggtggtacatttgctacaatctataagcctaccctgacatgtcattatcacccagaggccatagtttacagtgaaggttgcagtgagccgagatcatgccactgcactccagcctgggtgacagagcgagactgtctcaaaaataaaataaatttcactcttggtggtgttcatatgtttttactttctttgtgttttctgtaattatccaaaagtttcatattccaaagttttagtgacacaagcttagtacagtatttgaatgaaaacttaaataatttgcatttcttcataagcaaccaaattttatttgtcagcattaggaatttatttattaatttatgtttttgagacagagtcttgctctgttacccagtctggagtgcaatggcgcagtcttggctcactgcaacctctgcctcctgtgttcaagcaattctcctgcctcagcctcccaagtagctgggattacaggtgcccaccactacacctggctaacttttttatttttagtagagaggaggtttcaccatgttggccaggctggtctcgaatcctgaccccaggtgatctgcccacctcaatctcccaaagagctgggataacaagcatgagccctcgtgtctggcctggaattcatttttgatacatcattctctaactttctaatcactttatacttttacttattgtgtaatagtcaataatacaattatatagcaggaattaatcctattcatacaacttaacggtttctactaatgtaaaatgcccatgcagaatatttactttaaaggaaaaccaattgaaaacaaatatcagtgttctcagagcagacatagtgaatggtatatactgtagtagaaatatattttaatagctacccaaaatgtctgttaaacaatattttaagtacactttaattacggttttaaggacagtaaaaatctatttacatttttaaacaatgaatactttttaaaaaattgtaattgaatgacccaggaactcagtcatgtagtcattggttcatcagatatttcagtgtcatctgtaaggcattaaacatttaggcatatcatctttgatgtgaagtacttagaagttaattagatgataaagatattttatccttttgaccttgatatgtttatagtaatttatttaacagtgtaagaaagagcttgaaatttgctttattagcatagttataatcttatttaatctgaaggatgtttcttaatttcatattcagaaacatatcctaatttatcatttaaacactgatataaaaatatgtctacttagtaacctattttttcttaaggtatttactatgcaggatctattacaactcattaaaatcaaccctacttccagtctctacaaatcactggtaagatggcttagtttctgtaatctactttggtttgttaattataactgaatagctgaataaaagtgaaatattttcttttaacaggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaaaaaaaaaaaaactaataacttttaggccaagtgtctttgtatactaggtatccctctcaagtataattggtagggtattagatgtattaatatttccttaaagaatgagagttgtgttcagtaatgtgttatatatcttttgttcttaaatgtttatacaggccgggcgtggtggctcatgcctgtaatcccagcactttgggaggctgaggcgggtggatcacctgaggtcgggagttcgagatcagcctgaccaacctggagaaaccccgtttctactaaaaatacaaaaaaattagctaggcgtagtggcgcatgcttgtaatcacagctactcaggaggctgaggcaggagaatcgcttgaacccggaaggcagaggttgcggtgagctgagatcacgccattgcactcctgcctgggcaacaagagcaaaactccgtctcaaaaaaaaaaaaaatgtttatatagacctaataaattgccttaattttggccttgataatagccattcatagagtccataactactgtgggtttcaggccattggttagacttgatgatgggctttgtagcatgaacataagctggcaacttggctttgatgcatagttattctttaggtcttttaaaataatctgttagtaatagtccttttgtgttggtacacccttggattttgtctgttgcctgcactatcatccccacaaggacattcatttattcatccattcattcgccaattcatttagaacttaatcatttgaatacttattttctgccagccattaagtctgtgacttaatcgccaagtctcttggtagtaatgttagcagaatataaataaattggagcacaagatattctggactgcccgcaaactagaccatctctactgaagttcagtatggtaaatgatcctatattctgtactctaagtgtcgtccagtgtgactctctgtgattatggaaatgtctgtgtctatgctgtttaatgtggtagctgctatcctcatgtggcttttgagccttgaaatgtggctagtgtgactggataactgaatttttaatttacatttaattagctacacttgcatagtgactaccatattagcataattctgaggtatatagctagtatcttttgcttaactattacttcaaaaggaaatttgtggcttgaagggatattaagaaataatctatgggccaggcacggtggctcatgcttgtaatcccagcactttgggagggcaaacctggctgatcacttgaggtcaggggttcaagaccagcctggccaacatggtgaaaccccatctctactaaaaatacaaaaattagccaggcgtggtggtgagtgcctgtaatcccagctacttgggaggctgaggcaggagaatcgcttgaaccagagaggcgaaggttgcggtgagccaagatagcgccactgcactccagcctgggtgacagagctggactccatctcaaaaaaaaaaaaaaaatctatgtagttactatagatacattatccttaaaagtagtttttccatggccgggcgcagtggctcacgcctgtaatcccagcactttgggaggctgaggcgggcggatcacgaggtcgggagagcaagaccatcctggccaacatggtgaaaccccgtctctactaaaatacaaaaaaaagttagccaggcctggtggcgtgcacctgtagtcccagctatttgggaggctgaggcaggggaatcgcttgaacccaggaggcagaggttacagtgagccaagatcacgccactgcgctccagcctagcgacagagcaagactccgtctcaaaaaaaaaaaaatagtttttacacagtctctttaaatgcatctggttcagaaagacatctggccgacagcccttaccagcttcacctagcatcccagtaaaatttctggaagccagaaaaactatgagtagcagataggtcaggcatcctagtgccaaaatttggatagaactcttagctaacaaaatagctcctggtaagataaaatttttttaaaaattggtgtcttctaattaagtaacagaaaacatgtaggaagatattgtgtacttaaccgttgtctgtcccctgactcagacctatggtcttatcctaccatatctatgctcagggggtgctaagctgttgaatggccttggtacttttcctcctagattctagtcacccattcttcccactgctaattttcctttcagagataatgatatctgttatgcgtgtctgtgtgaagagaccaccaaacaggctttgtgtgaggaacaaggctgtttattcacttgggtgcaagtgggttgagtccgaaaagagagtcagtgaagggagataggagaggggcagctttatagggcttgagtaggcagtggaaagttacagttaaaggtggttatttattgttagcaggggagggggtcccaaggtgcatggtggagagatcttgggactcattgtccagaagaagaatgtcacaaggtcgattgatcagttggggcagggcagaacaagtcataatggtggaatgtcgtaaggttggtcagtcagttaaggcaggagctgtttcacttctgtggttttttagctggctcctgcaggccatctggacgtatatatgcaggttacgggggttacaatggctgagcttcggctcagaggcctgacaatatccagaaaatgatgtgcacaaaatttggatgagggaagaaaatttggacatcggccctttgctttttggaagtaaaaattcttatctgcaattggcaaaagaataagacatatacatcaatggggacagaattaggaagtccagaaatacatccacacaaatatagtcaattgattttttttttaacaaaggtgcaaaggcaattcaatagaggaaagatagtcttttcaacaagtggtgctgtaacagttggatattcatatgcgcaaaaatgaacctagacacagatcttatttattataccttacacaaaaactaactcaaaatgaaccatagacctaaatgtaaaatgcaaaactataaaacttccagatgagaacagtagaaagtctgtgatcttgggtttcgtgatgagatgtaacaccaagagcaagatacatgaaagaaaaaagtagatcagttagactttattaaaattaaaaacatctctgtgaaagacactgttctttttgttttgtttttgagacggagtttcactctgccacccaggctggagtgcagtggcgtgacctcggctcactgcagcctctgcctcctgggttcaagtgattctcctgtctcagcctcctgagtagctggaactacaggcgcctgccaccacgcctggctaatttttttgtgttttcaatagagatggggttcaccatgttgatcaggctggtctcgatcccctgacctcaggtgatcgcctgcctcagcctcccagagtgctgggatgacaagcgtgagccactgtaccctgccaaaagacgctgttaagagaatgaaagacccagtgtcgaaacccatagagctttacgtcatcaagagtgaaccttaatgtttgcaaatttaggtcaggtgatcccaggatggtatgcagactgtgacaaaatctaatccccttcctgaagggagtgggggtgggggaaaaggtgctgagctaactactgtttttagttccaagaaactaaacatttcttaagtaatttatgcttgtggtttaaaacagtttcaaactattcagaaggatataaagtgaaagcaaagtagcagtttctgcccatgttctctaatctcacgctccactgataactagaattaacagtttcactccactgataactagaattaacagtttcttgtttatcttctagaattgtttgaggttaaaactatgtatttgtaattaaaacacaatcaattgggattatatcgtagatactgtatgcaatttgctttttttaatccaccaatgtatctttctgtagcagtatagactaattatttttaaataatgtatttaaccccctattgatggagatctggttgttttattgtttgctttttgccattacaggtaacctatgtgcagtgtgcaccctttgtgcccttgtgaaagtatacctgtgtaaattcatagaagtggaatgactagattaaagggcacatgcatttcgaatatatataagcactgacaaatttctcttccaagtgaatgagtatagctatatatccactcccttgccaacacttagcattatacaagttttaatcttagcagtgttatagggaaaataatggtttctctgttgtattaatttgcatttatgattttgttcatgtttattcagcatctaaaaattgtgttcatctttgacaatgtagttttttctgcaaactacccatgtttttccccatttttctgattttttttttttaaactgatttgtaagagttctttgatgttatgaaaatgtcatcactttagtcttggttatgcctccatattattgcaactatttttcccagtgtgttatttttttattttatgccatatgtaagttttcagtttttatgtagttagattgataaatatttctccttattccttccaggttctgtatcatgcttgggaaggccttttctcagatttattaaaagatatgactgggcacagtggctcatgcttgtgatcccagcactttgggaggcccaggcaggaggattgcttgaggccatgagtttgagactagcctgggcaacatagcaagaccctgtttatacaaaaagtaaaattagctgggcgtggtgggtggtggtgtgcacctctagtcccagctacttgggagactgatgtaggaggattgcttgagcccaggaggtcgaggccgcagtgagccatgattacaccactgcactccagcctgggtgacagagcaagacttttgtctctaaaaaaaaggaaagatatataatgtaaaaaatgataatgtcctaaaactaagattgtaaaaacagtgactgagcagtggttgaaagttctgaaacaaaactgtatgcatatgttttttaggttttcttatgcattttttaaaagaattggcagaatatcatcaagctaaagagagttgtaatatggaaactcagacaagttcgacatttaacagagattctctgggtaattatagccttctttcttaatttcagttctgctgttttcattttgaatgaaggaaattatctgatttaccatattgtgtgattgctccttgaactggagggatgcagccggcaggcaacaagggaattcatttctggaatcatcttgggggaccaggaagtgctctccagtgtcattccctagcctcatgaatgccagggctacactggccaaatcatgcagggattcaaaggcccatattcttccttgtttgttgagtttgacttctcttaactgggaggttcttcctcgtgtcttgtctaactttacagccacccagttagaagattataaactacttgctttgcaaagtactagagaagtcagtgacttatcacttcattttatagttgaggaaaccgaggtcctcagaggaagagcaacttggaaacactcagtctgcatcagaactaatagtggagtccaagttctcccatccatgatctggagctttttgtactatccagctggtctgcagtaccatcctgtctgtcagtttcgtgctcagtagagatgggaaatagctgtttaaaacgatatgcttaatggatttcttggcccttccttactcttaaatggtaacttgcaagaagataagttcataattcataaaatgtattatatgactatgcctttaagtgtatttttaattcaattagaaacatattacttgctaattatcaagcagtgctgttcagtggtgtgagccacatacataattttaaattttctagtagccacgttgaaaaaagtaaaaagaaacgggtgaaatttgttttaataatatatttaacccaatacatgcaaaatattatttcagcatatattcaatataaaaaatactaagatatttcacatttattttttgcactgtctttgaaatctcatgtgttttttacatttaaagcacatctcagttgagtctggtcacatttgaagtgtcaatggccccatgtggctggagagtcctgtgttggacagcatctggaaaatacagaaaagtagatggaaaaacatgtctaaagtcatccctaccagagataaacactatcgatgttttaatctacttctgccagcctttttcccctctgtgcatactttttgggtgggcgttatacacggttgagattgtactctgggttcagatttgcactttgctatgtggttgattctgatccatagttggtttgagggccatggactaagggaagagtcagtagacctcactttaatcctggttatgctgtcatgtagtcacttattaagctatatcagcatttgttctttatgtgtaaaggggaggggttgatatacgtgatctttgattcttttaaagttattgttttgaatatgtaagtcagctttaaccagagtccaataaagagctctctgccttagcacttagagagtaggaagagactccagtattttctgacttaaactgtactcttggctttctttttcctctaacatttcatgatgaacattttcaaacatacagaaaagttgaaacaattttagcgaacacttgtatacccaccacctagatgtcactattacacttgtgttatacttgcttcatcatttttatctgtccatccattcatccaccttcctttttttgtatttcaaagtaagttgcagataatccctacactttcccctaagtatcctctttacttttgaaccagaggtctggcgtcttacgcacctgacgatgtttctatgtcctaatttgatgtgttattttttaatagctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaaggtaagctttatcttgttactgtaaacaagagtgatgtttttgtttgtcttctaaagtcttaaccataggtatatgggaaaatatctagaacttttaataacgaatgggatactgtactgttgtgcaaatttttttttatttctggtgacatttgtttatgccttttgagtgaatcctacaaatagagtgaatgagataaaactaacatgaaataaatatatttggacagagcattaatgttaaacctagatgtagagagagaacttgttcctgtttttatagtataatagttggtatttttaattttttgtgatcaatttgcagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagaggtggtatttacaaatattttatgggtggctatttcctgcagctattagtaggttggctcgagatccagcaacaggatggtacagttgatggaacaaggccccagaagagcaatagggactggggccaagagtgcaaatagaaggatggtccttgaaaaggatacacaaatttgcttcctctgagactgatggaaaggcgagaactgtggaggtgaacaatcaagttgggattatgagaaacacaccctaaataagctccatctcctcaggcagattagagggttagatcttgggttttaggagcagattggaggtgcagagtagttcctgtgggtaagggaagaacagccctttaaagcagagaggactgatcacctgtattgagggctcagctgtggttgggggagcctggaattgagagaggtcaaaccaggtgcttgtaagtgagttttctgttctagttctggggaggatttgtaagtatctctctgtccctttcagtgagggtggaaagatggagatgcttgggaagtagagcttttcagagccttatttgactagagaaaggcagcctacttaatcgaagattctggggctctcttgggtagtgaagggaagcagaggagagggcaggtggctgctaacctagggggaaaggaagggttgagtggcagtctcagtgatcaaggactcgatctggatagactggtaggtggaagaatgaggatggtccaagattacagaattgcaggatgaggtttcaggtggagactagaaaccaaatgcagtatgctgccattggagagagccatggaaatgagcaagggtgaaggtccctggggtaaaggagtcaccacaagggtcatccatgtgaccatttgatcttgtcaccccagaaagtaactggacaggagacagagagggtgaggagtgagagggagtccatgttggcaagcaggattggatctactcctttaaatcatattcctttcccaagggcgtgtcttagaccaaactagatttacagcactatttccaacatacatccagaactactgctgtcagatgttgaaagtaggaatgcttccccctagtgtccactctcgcctggggcttctcaataagacctagttgtttaatgctaagggcaccccctctaaaattttgtatagcatttctgggaattgggtttgcttcagctataaaaatgaatgtcagaagcacatatctttgagatgattggattgtgtttagactaataacttcaaccttcaagataggtgactgactagatccctgtttatttatctgatcatctgaaggctttgaagaagattgtcatcctcataagaagcaccatgtctttattccctcacctggactgtccatccccttctctccctgataaaaaccatagtgtctttcaagacccagcttggatgtcacctgggtgatgccgtccctgactcccactgagcgacccatttaggcctcattcctgcatcagtctttatgtacttcagttacaaaatcatcacatcttagtgtgattgtttctcactccctgactaaattgtgaggtctttagagatgaggactatatctgtctacctttttatatccagttcccagtatgctgcttgacatgtcataggtagttagtaaattctttctctgtgaacacacaaatggaaggatggcccattcttttaggagttcatatgagcttgctaactctgagtcagaatgacccgtgaactgaaacattcagacgacaccaccactaaaaaccatggggattcaattcttttggagttttactgctgaatgtacattttgcttaatttttctttctggggaacttgccaaaatttaggtaagggcgccaggtgtggtggctcatgcttgtagtcccagcaccttgggaagccaaggcaggcatatcgcttgagtccagaagttcgacaccagcctgggcagcatggcaaaaccccatctctacaaaaatacaaaaaatcagccggacttggtggcgtgtgcctgtagtgcctgcagctactcggtaggctggggtgggaggaccccttgagcttgggaggtggaggttgcagtgagccaagatcaccccactgcactccagcctgtgtgacagagtgagaccctgtctcaaaaaaaaaaaaaaaaaaatttttttagataagggactgagagatgttaaagaactaaatagcataaatttcacatggcatgttaggactgtagggtaatggtagtttaacagtcattgggggagtaaatttttatgcaactagaatacgcaaaaagtataccttgagtcggaatctcttgaaggtgaaattgttatcctaaatgtctgtactttgctttttggaatgtaggaagcagtatattcattcaaatctgttttgctttcattagcttgcttgctaaaaattaatgcttttctatacagattgaaacaaaagaaatttatgctcaaaggcaacttttactaaaagatatggatttgctaagaggaagagaagcagagctgaagcaaagagttgaagcttttgaattgtaagtaatgcatgttcattttggatattcagaatgatgagattaaaaagaattactaaatatatatctaaatattctaatgttcattgccaagtagagttcttatttgtaaaggggatatcacctagaaggtacaaattaagaggaacaaacactagggttttgtttttgaaatattaaacattaagatgaaaagacgaatgagatgctatcatcaggctacagtaagaccagacagattatttggagaagctgttaatactggaacagatcgtatgttttgcagttacattcagtccctcagatctgatagttccgtgtgtgtatgtatagtaactgaattccatatatccaggcctgcagcttttaccagctgtgtgctcagaaaaggaagtatggtggtccaacttgacttgtacttggtgaaaccatttctttgttactcactgtttctaagtgctcacaaatgtttcatccttgagatcttacctgggattgatggcaagttcacctgtctatagtttgtgcaataagccttctcttcctttgggaatctgctattgacacccatagatactccaggaatcttagttcattaaagaatttggctccattaatgtttttttctcacttctataggcttgatttgtttgatttcaactctctgtctaccttactctctttttggcaataatgaaaaggtaaattgatcaagagagaggaaataggcacaaaattggggcagagagagttcatcattcctttacctccattttctctactcttgttccctccttctcagcatataaactaaataaatgtagtttacctctccatggctttccagattaccagcagagggagctaatacctagagcctttacctgttcttagactagtcagcattttgtagcacttctcaggatggctggatctcaccacccatgaacctacctccctggctaaggagttggtgctatggttgatttaaagtctcactatgaagaccattctattcttcagtatttggaagccctgattgatccatctatcttttgccctctcttttggtacttttttcaatattcaatcaatagggttttttgtttgttttgttttgtttttaagacacagtgtctctctgtattgcccaggctggtctcaaacacttgggctcaagcaatcctcctgcctcagccttctgaaaagctgggattataggtgcgggccaccacacttggctaaagctgattggttattaaatgacaaaaacacatattgtaccttgaatatgtatggactaattaattaaatcccacagttagaaacagcattatagaagatttaagcacataagtacacttatttgttactttgtaactaataatatcattatttcatcccaggattgattttggctatttatcacctataaccattgtttgagtgtttattttcagtgagaaaccacttccctcttgagactctcccactcccctcagcccaaagcacagtcaattctgctagtttcaatatgctgtaactaggtcagttcataaaatacactgaggacttctggctctttccttctacttcccagtagtgatatcatgtagcagttttagtctgtggaactagacacatgtgattttttcctaaatttgttagctcagctatggtagtttatttactttttatatttttgttaatttcaggaaccagaagctccaggaagaaaaacataaaagcataactgaggcacttaggagacaggagcagaatataaagagttttgaggagacctatgaccgaaagctcaagaatgaacttctaaagtaattgtttagcatttttaaataactaatatgtttaaattaaattggtagaaacataacaaaaactgacaaagtagtctgtaacttaggcaaactttagtgtttgaaaaaaaaaaaacatagttttatcgatacagtcaatcctttcctgcatttgagttaggatagtttttaaaagataagggccgggtgtggtggctcatgcctataatcccagcactctgggaggctgaggtgggcggatcacctgaggtcaggagtgcaagaccagcctagccaacatggtgaaaccccatctctactaaaaatacaaaaattagctgggtgtggtggtgggcacttgtaatcccagctactggggaggctgaggcaggagaatcacttgaacccgggaggcagacgttgcagtgaactgaagttgtgctactgcactctactagcctgcgtgacagtgacaatccatctcaaaaattaacaacaataaaaaaatacagagaagcacatcctctgcgcttcttatggcttctctaacgtttattgtgggctgtgatttgctttaattttcaggacaccttgtgacttgcttagcttgcatagttgataagctgtaaaattggaattataaccacttttagttatcttttcctctacctcactcatacagtcagaaggatggggttatctgacaatatataaattatactagtggtcatagtatttgtcagtgaacatgtgccttgtattccttcaagattcagcaaagccagaatcaaaagagctaaaattaactatgtgaggcaaaaagtgatatagggaaaggaaaatatggacaactatggtaactttggcttttctgtagtctgagttttgtgtatcagtgaataatatctcagtgctacgacattatgcccatgtggtaacatttctcttcagtgtgtgggaaagcatctggcacataaaaagtgctcagttaatatttgttgtaaatgtgtcacgaggaaatgattcaactcaggtgctctgggcatttcttatttggcctcttttattgcctttctcataatttgtcatcgatattccattacataatattgcaaaggtttcttgaggtaatcctttaaacaaatcctatttttaaaaaatatggcagcttttttatctattgattttgaaatgatgtattttacccacatcttctatgtcagtttctatactaaaatagctaaaatggaagtgtctgtagttgctgaatttttaggaataaatgaattaaagtatgtgtgttaattttacatagttatggagctagtgaactatttggtgtcattgtgacagcttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaatccggatataatgctcttg

SEQ ID NO: 5486 - DNA, 34608 bp, human
ggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcaggtagacacacctgccccttctcgggcggaaataaagtcttgttttgtgttcgttaaactttcgccgctaggcctcttatggcttccccggaggccactggtctgttttcagacgttcacgttccctctgccccgcaggtaacctataaccattttgtcttttagtccaacatgtttaccgtggctgatgtgttgagtcaagatgaactgcgcaaaaagctataccagacgtttaaggatcggggtatactggatacactcaaggtatcggatttaggcgtatctgtgtcagcttttacaagtgtaacctgtaacaggtagttcaaattcaatcaaggtttaggttttaataatcgtatgatacatagattgtattggtgaattacatttttatattcccgaataactctgtatcctgaaacattacagtctcttgaaaatgtttgagaaaatgttgagtttgagtcgtcttaaaggagcatattcaaataattaattgaactgacaataagataggagaaggaaatatttgtataatgaacacagtaagattaggcttgttttataaatatggcttataggttcctaaattaataagtgggtttgtaatacatttggatgaaggacattgacaccatatagaaaatactagtgtactgcttaataatagtttgggaaatgaaaaattttatctttaaactatattgaaatgtatgaatgtttagtttgggcagaaaatacctattagtatgctttatatttggattaacagccaggagtaggattagctcaacgtgttttcattgaaatatgcatttcaaaagcatattttacgtttaaaatatgtagctatatcctgtgtatgtatccttttttaatttaaattatatggtgagcatttccctgtttccttaaaagttttttgaaatcttcattttcagtggcaacaggcttatctttggatatttttgtaatgtatatagcagtcccctgttgttgaatattttggttatattctccaacagtccacagaggtgtgatgaagtggcagaattttttcctatacttaatatcccaatcgtaagctgctgaaatgggcttctagggaagtgaagttatgagtctgcaagtggatctggctaaccacccgtttcatttggaagctggggaaagaaagctttttctagaacccactggactgcttgtctcacggggtaagacaaagtgtgcaggggaaggtttctaacttctggccatggatctagaaccattatggaaatagaaggaaggtttccaatgaatgtagctcatctgtgtatatctctaatgaaacagtcctgctgaaatttctttcccttgtgtttcttttttatttttgtttttattttatgctagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtaaagtctttccttttctgtttctgaagtttttattaacaggttcttcctctgctgacagtaaagtgctgtatgatagctaagtgctcctcgactaggtccatttctgtttcctctttgaattcacattgtacctgcacataatatatttgttatataacaagtgggtactaaatttgaaattaatttcttggcgtctcatttagtctcacataaaacagtgatgtatagaatctctaaatgtttcagacctataattgatctatctatcctctatcttgtctaataagactctgccaatctgctgaatgtctgctgtaagcttggcactgtgataggcacactgcagatgttttgtgtgttacggatgaggaaccagactctggagaggtgaatcaatttgcccaacatcaagtaacttttaagtgacaatgcagggtggtaaatctagatctctaacatgagctctttttttcctgcactagtttcttcagatgtttctctttgtaattagataagtgagaaatacgtaatttaaaaaatctgtaaagttctcaaatattaaaaacacttgttttttttttttactacttttctaattattttaactatatttcttcaccattactgttgaacattagtactactttattattttaaaggcagatacagcagactttccctgtggatatgtgcgtgtttttttttttttaatagactttattttttcagagcagttttgggttcacagcaaagttaagtgggaagtacagagaattcccatatacctgctgcccctacacactcatagcctcccccactgtcaacatcttgcatcaaggtggtacatttgctacaatctataagcctaccctgacatgtcattatcacccagaggccatagtttacagtgaaggttgcagtgagccgagatcatgccactgcactccagcctgggtgacagagcgagactgtctcaaaaataaaataaatttcactcttggtggtgttcatatgtttttactttctttgtgttttctgtaattatccaaaagtttcatattccaaagttttagtgacacaagcttagtacagtatttgaatgaaaacttaaataatttgcatttcttcataagcaaccaaattttatttgtcagcattaggaatttatttattaatttatgtttttgagacagagtcttgctctgttacccagtctggagtgcaatggcgcagtcttggctcactgcaacctctgcctcctgtgttcaagcaattctcctgcctcagcctcccaagtagctgggattacaggtgcccaccactacacctggctaacttttttatttttagtagagaggaggtttcaccatgttggccaggctggtctcgaatcctgaccccaggtgatctgcccacctcaatctcccaaagagctgggataacaagcatgagccctcgtgtctggcctggaattcatttttgatacatcattctctaactttctaatcactttatacttttacttattgtgtaatagtcaataatacaattatatagcaggaattaatcctattcatacaacttaacggtttctactaatgtaaaatgcccatgcagaatatttactttaaaggaaaaccaattgaaaacaaatatcagtgttctcagagcagacatagtgaatggtatatactgtagtagaaatatattttaatagctacccaaaatgtctgttaaacaatattttaagtacactttaattacggttttaaggacagtaaaaatctatttacatttttaaacaatgaatactttttaaaaaattgtaattgaatgacccaggaactcagtcatgtagtcattggttcatcagatatttcagtgtcatctgtaaggcattaaacatttaggcatatcatctttgatgtgaagtacttagaagttaattagatgataaagatattttatccttttgaccttgatatgtttatagtaatttatttaacagtgtaagaaagagcttgaaatttgctttattagcatagttataatcttatttaatctgaaggatgtttcttaatttcatattcagaaacatatcctaatttatcatttaaacactgatataaaaatatgtctacttagtaacctattttttcttaaggtatttactatgcaggatctattacaactcattaaaatcaaccctacttccagtctctacaaatcactggtaagatggcttagtttctgtaatctactttggtttgttaattataactgaatagctgaataaaagtgaaatattttcttttaacaggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaaaaaaaaaaaaactaataacttttaggccaagtgtctttgtatactaggtatccctctcaagtataattggtagggtattagatgtattaatatttccttaaagaatgagagttgtgttcagtaatgtgttatatatcttttgttcttaaatgtttatacaggccgggcgtggtggctcatgcctgtaatcccagcactttgggaggctgaggcgggtggatcacctgaggtcgggagttcgagatcagcctgaccaacctggagaaaccccgtttctactaaaaatacaaaaaaattagctaggcgtagtggcgcatgcttgtaatcacagctactcaggaggctgaggcaggagaatcgcttgaacccggaaggcagaggttgcggtgagctgagatcacgccattgcactcctgcctgggcaacaagagcaaaactccgtctcaaaaaaaaaaaaaatgtttatatagacctaataaattgccttaattttggccttgataatagccattcatagagtccataactactgtgggtttcaggccattggttagacttgatgatgggctttgtagcatgaacataagctggcaacttggctttgatgcatagttattctttaggtcttttaaaataatctgttagtaatagtccttttgtgttggtacacccttggattttgtctgttgcctgcactatcatccccacaaggacattcatttattcatccattcattcgccaattcatttagaacttaatcatttgaatacttattttctgccagccattaagtctgtgacttaatcgccaagtctcttggtagtaatgttagcagaatataaataaattggagcacaagatattctggactgcccgcaaactagaccatctctactgaagttcagtatggtaaatgatcctatattctgtactctaagtgtcgtccagtgtgactctctgtgattatggaaatgtctgtgtctatgctgtttaatgtggtagctgctatcctcatgtggcttttgagccttgaaatgtggctagtgtgactggataactgaatttttaatttacatttaattagctacacttgcatagtgactaccatattagcataattctgaggtatatagctagtatcttttgcttaactattacttcaaaaggaaatttgtggcttgaagggatattaagaaataatctatgggccaggcacggtggctcatgcttgtaatcccagcactttgggagggcaaacctggctgatcacttgaggtcaggggttcaagaccagcctggccaacatggtgaaaccccatctctactaaaaatacaaaaattagccaggcgtggtggtgagtgcctgtaatcccagctacttgggaggctgaggcaggagaatcgcttgaaccagagaggcgaaggttgcggtgagccaagatagcgccactgcactccagcctgggtgacagagctggactccatctcaaaaaaaaaaaaaaaatctatgtagttactatagatacattatccttaaaagtagtttttccatggccgggcgcagtggctcacgcctgtaatcccagcactttgggaggctgaggcgggcggatcacgaggtcgggagagcaagaccatcctggccaacatggtgaaaccccgtctctactaaaatacaaaaaaaagttagccaggcctggtggcgtgcacctgtagtcccagctatttgggaggctgaggcaggggaatcgcttgaacccaggaggcagaggttacagtgagccaagatcacgccactgcgctccagcctagcgacagagcaagactccgtctcaaaaaaaaaaaaatagtttttacacagtctctttaaatgcatctggttcagaaagacatctggccgacagcccttaccagcttcacctagcatcccagtaaaatttctggaagccagaaaaactatgagtagcagataggtcaggcatcctagtgccaaaatttggatagaactcttagctaacaaaatagctcctggtaagataaaatttttttaaaaattggtgtcttctaattaagtaacagaaaacatgtaggaagatattgtgtacttaaccgttgtctgtcccctgactcagacctatggtcttatcctaccatatctatgctcagggggtgctaagctgttgaatggccttggtacttttcctcctagattctagtcacccattcttcccactgctaattttcctttcagagataatgatatctgttatgcgtgtctgtgtgaagagaccaccaaacaggctttgtgtgaggaacaaggctgtttattcacttgggtgcaagtgggttgagtccgaaaagagagtcagtgaagggagataggagaggggcagctttatagggcttgagtaggcagtggaaagttacagttaaaggtggttatttattgttagcaggggagggggtcccaaggtgcatggtggagagatcttgggactcattgtccagaagaagaatgtcacaaggtcgattgatcagttggggcagggcagaacaagtcataatggtggaatgtcgtaaggttggtcagtcagttaaggcaggagctgtttcacttctgtggttttttagctggctcctgcaggccatctggacgtatatatgcaggttacgggggttacaatggctgagcttcggctcagaggcctgacaatatccagaaaatgatgtgcacaaaatttggatgagggaagaaaatttggacatcggccctttgctttttggaagtaaaaattcttatctgcaattggcaaaagaataagacatatacatcaatggggacagaattaggaagtccagaaatacatccacacaaatatagtcaattgattttttttttaacaaaggtgcaaaggcaattcaatagaggaaagatagtcttttcaacaagtggtgctgtaacagttggatattcatatgcgcaaaaatgaacctagacacagatcttatttattataccttacacaaaaactaactcaaaatgaaccatagacctaaatgtaaaatgcaaaactataaaacttccagatgagaacagtagaaagtctgtgatcttgggtttcgtgatgagatgtaacaccaagagcaagatacatgaaagaaaaaagtagatcagttagactttattaaaattaaaaacatctctgtgaaagacactgttctttttgttttgtttttgagacggagtttcactctgccacccaggctggagtgcagtggcgtgacctcggctcactgcagcctctgcctcctgggttcaagtgattctcctgtctcagcctcctgagtagctggaactacaggcgcctgccaccacgcctggctaatttttttgtgttttcaatagagatggggttcaccatgttgatcaggctggtctcgatcccctgacctcaggtgatcgcctgcctcagcctcccagagtgctgggatgacaagcgtgagccactgtaccctgccaaaagacgctgttaagagaatgaaagacccagtgtcgaaacccatagagctttacgtcatcaagagtgaaccttaatgtttgcaaatttaggtcaggtgatcccaggatggtatgcagactgtgacaaaatctaatccccttcctgaagggagtgggggtgggggaaaaggtgctgagctaactactgtttttagttccaagaaactaaacatttcttaagtaatttatgcttgtggtttaaaacagtttcaaactattcagaaggatataaagtgaaagcaaagtagcagtttctgcccatgttctctaatctcacgctccactgataactagaattaacagtttcactccactgataactagaattaacagtttcttgtttatcttctagaattgtttgaggttaaaactatgtatttgtaattaaaacacaatcaattgggattatatcgtagatactgtatgcaatttgctttttttaatccaccaatgtatctttctgtagcagtatagactaattatttttaaataatgtatttaaccccctattgatggagatctggttgttttattgtttgctttttgccattacaggtaacctatgtgcagtgtgcaccctttgtgcccttgtgaaagtatacctgtgtaaattcatagaagtggaatgactagattaaagggcacatgcatttcgaatatatataagcactgacaaatttctcttccaagtgaatgagtatagctatatatccactcccttgccaacacttagcattatacaagttttaatcttagcagtgttatagggaaaataatggtttctctgttgtattaatttgcatttatgattttgttcatgtttattcagcatctaaaaattgtgttcatctttgacaatgtagttttttctgcaaactacccatgtttttccccatttttctgattttttttttttaaactgatttgtaagagttctttgatgttatgaaaatgtcatcactttagtcttggttatgcctccatattattgcaactatttttcccagtgtgttatttttttattttatgccatatgtaagttttcagtttttatgtagttagattgataaatatttctccttattccttccaggttctgtatcatgcttgggaaggccttttctcagatttattaaaagatatgactgggcacagtggctcatgcttgtgatcccagcactttgggaggcccaggcaggaggattgcttgaggccatgagtttgagactagcctgggcaacatagcaagaccctgtttatacaaaaagtaaaattagctgggcgtggtgggtggtggtgtgcacctctagtcccagctacttgggagactgatgtaggaggattgcttgagcccaggaggtcgaggccgcagtgagccatgattacaccactgcactccagcctgggtgacagagcaagacttttgtctctaaaaaaaaggaaagatatataatgtaaaaaatgataatgtcctaaaactaagattgtaaaaacagtgactgagcagtggttgaaagttctgaaacaaaactgtatgcatatgttttttaggttttcttatgcattttttaaaagaattggcagaatatcatcaagctaaagagagttgtaatatggaaactcagacaagttcgacatttaacagagattctctgggtaattatagccttctttcttaatttcagttctgctgttttcattttgaatgaaggaaattatctgatttaccatattgtgtgattgctccttgaactggagggatgcagccggcaggcaacaagggaattcatttctggaatcatcttgggggaccaggaagtgctctccagtgtcattccctagcctcatgaatgccagggctacactggccaaatcatgcagggattcaaaggcccatattcttccttgtttgttgagtttgacttctcttaactgggaggttcttcctcgtgtcttgtctaactttacagccacccagttagaagattataaactacttgctttgcaaagtactagagaagtcagtgacttatcacttcattttatagttgaggaaaccgaggtcctcagaggaagagcaacttggaaacactcagtctgcatcagaactaatagtggagtccaagttctcccatccatgatctggagctttttgtactatccagctggtctgcagtaccatcctgtctgtcagtttcgtgctcagtagagatgggaaatagctgtttaaaacgatatgcttaatggatttcttggcccttccttactcttaaatggtaacttgcaagaagataagttcataattcataaaatgtattatatgactatgcctttaagtgtatttttaattcaattagaaacatattacttgctaattatcaagcagtgctgttcagtggtgtgagccacatacataattttaaattttctagtagccacgttgaaaaaagtaaaaagaaacgggtgaaatttgttttaataatatatttaacccaatacatgcaaaatattatttcagcatatattcaatataaaaaatactaagatatttcacatttattttttgcactgtctttgaaatctcatgtgttttttacatttaaagcacatctcagttgagtctggtcacatttgaagtgtcaatggccccatgtggctggagagtcctgtgttggacagcatctggaaaatacagaaaagtagatggaaaaacatgtctaaagtcatccctaccagagataaacactatcgatgttttaatctacttctgccagcctttttcccctctgtgcatactttttgggtgggcgttatacacggttgagattgtactctgggttcagatttgcactttgctatgtggttgattctgatccatagttggtttgagggccatggactaagggaagagtcagtagacctcactttaatcctggttatgctgtcatgtagtcacttattaagctatatcagcatttgttctttatgtgtaaaggggaggggttgatatacgtgatctttgattcttttaaagttattgttttgaatatgtaagtcagctttaaccagagtccaataaagagctctctgccttagcacttagagagtaggaagagactccagtattttctgacttaaactgtactcttggctttctttttcctctaacatttcatgatgaacattttcaaacatacagaaaagttgaaacaattttagcgaacacttgtatacccaccacctagatgtcactattacacttgtgttatacttgcttcatcatttttatctgtccatccattcatccaccttcctttttttgtatttcaaagtaagttgcagataatccctacactttcccctaagtatcctctttacttttgaaccagaggtctggcgtcttacgcacctgacgatgtttctatgtcctaatttgatgtgttattttttaatagctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaaggtaagctttatcttgttactgtaaacaagagtgatgtttttgtttgtcttctaaagtcttaaccataggtatatgggaaaatatctagaacttttaataacgaatgggatactgtactgttgtgcaaatttttttttatttctggtgacatttgtttatgccttttgagtgaatcctacaaatagagtgaatgagataaaactaacatgaaataaatatatttggacagagcattaatgttaaacctagatgtagagagagaacttgttcctgtttttatagtataatagttggtatttttaattttttgtgatcaatttgcagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagaggtggtatttacaaatattttatgggtggctatttcctgcagctattagtaggttggctcgagatccagcaacaggatggtacagttgatggaacaaggccccagaagagcaatagggactggggccaagagtgcaaatagaaggatggtccttgaaaaggatacacaaatttgcttcctctgagactgatggaaaggcgagaactgtggaggtgaacaatcaagttgggattatgagaaacacaccctaaataagctccatctcctcaggcagattagagggttagatcttgggttttaggagcagattggaggtgcagagtagttcctgtgggtaagggaagaacagccctttaaagcagagaggactgatcacctgtattgagggctcagctgtggttgggggagcctggaattgagagaggtcaaaccaggtgcttgtaagtgagttttctgttctagttctggggaggatttgtaagtatctctctgtccctttcagtgagggtggaaagatggagatgcttgggaagtagagcttttcagagccttatttgactagagaaaggcagcctacttaatcgaagattctggggctctcttgggtagtgaagggaagcagaggagagggcaggtggctgctaacctagggggaaaggaagggttgagtggcagtctcagtgatcaaggactcgatctggatagactggtaggtggaagaatgaggatggtccaagattacagaattgcaggatgaggtttcaggtggagactagaaaccaaatgcagtatgctgccattggagagagccatggaaatgagcaagggtgaaggtccctggggtaaaggagtcaccacaagggtcatccatgtgaccatttgatcttgtcaccccagaaagtaactggacaggagacagagagggtgaggagtgagagggagtccatgttggcaagcaggattggatctactcctttaaatcatattcctttcccaagggcgtgtcttagaccaaactagatttacagcactatttccaacatacatccagaactactgctgtcagatgttgaaagtaggaatgcttccccctagtgtccactctcgcctggggcttctcaataagacctagttgtttaatgctaagggcaccccctctaaaattttgtatagcatttctgggaattgggtttgcttcagctataaaaatgaatgtcagaagcacatatctttgagatgattggattgtgtttagactaataacttcaaccttcaagataggtgactgactagatccctgtttatttatctgatcatctgaaggctttgaagaagattgtcatcctcataagaagcaccatgtctttattccctcacctggactgtccatccccttctctccctgataaaaaccatagtgtctttcaagacccagcttggatgtcacctgggtgatgccgtccctgactcccactgagcgacccatttaggcctcattcctgcatcagtctttatgtacttcagttacaaaatcatcacatcttagtgtgattgtttctcactccctgactaaattgtgaggtctttagagatgaggactatatctgtctacctttttatatccagttcccagtatgctgcttgacatgtcataggtagttagtaaattctttctctgtgaacacacaaatggaaggatggcccattcttttaggagttcatatgagcttgctaactctgagtcagaatgacccgtgaactgaaacattcagacgacaccaccactaaaaaccatggggattcaattcttttggagttttactgctgaatgtacattttgcttaatttttctttctggggaacttgccaaaatttaggtaagggcgccaggtgtggtggctcatgcttgtagtcccagcaccttgggaagccaaggcaggcatatcgcttgagtccagaagttcgacaccagcctgggcagcatggcaaaaccccatctctacaaaaatacaaaaaatcagccggacttggtggcgtgtgcctgtagtgcctgcagctactcggtaggctggggtgggaggaccccttgagcttgggaggtggaggttgcagtgagccaagatcaccccactgcactccagcctgtgtgacagagtgagaccctgtctcaaaaaaaaaaaaaaaaaaatttttttagataagggactgagagatgttaaagaactaaatagcataaatttcacatggcatgttaggactgtagggtaatggtagtttaacagtcattgggggagtaaatttttatgcaactagaatacgcaaaaagtataccttgagtcggaatctcttgaaggtgaaattgttatcctaaatgtctgtactttgctttttggaatgtaggaagcagtatattcattcaaatctgttttgctttcattagcttgcttgctaaaaattaatgcttttctatacagattgaaacaaaagaaatttatgctcaaaggcaacttttactaaaagatatggatttgctaagaggaagagaagcagagctgaagcaaagagttgaagcttttgaattgtaagtaatgcatgttcattttggatattcagaatgatgagattaaaaagaattactaaatatatatctaaatattctaatgttcattgccaagtagagttcttatttgtaaaggggatatcacctagaaggtacaaattaagaggaacaaacactagggttttgtttttgaaatattaaacattaagatgaaaagacgaatgagatgctatcatcaggctacagtaagaccagacagattatttggagaagctgttaatactggaacagatcgtatgttttgcagttacattcagtccctcagatctgatagttccgtgtgtgtatgtatagtaactgaattccatatatccaggcctgcagcttttaccagctgtgtgctcagaaaaggaagtatggtggtccaacttgacttgtacttggtgaaaccatttctttgttactcactgtttctaagtgctcacaaatgtttcatccttgagatcttacctgggattgatggcaagttcacctgtctatagtttgtgcaataagccttctcttcctttgggaatctgctattgacacccatagatactccaggaatcttagttcattaaagaatttggctccattaatgtttttttctcacttctataggcttgatttgtttgatttcaactctctgtctaccttactctctttttggcaataatgaaaaggtaaattgatcaagagagaggaaataggcacaaaattggggcagagagagttcatcattcctttacctccattttctctactcttgttccctccttctcagcatataaactaaataaatgtagtttacctctccatggctttccagattaccagcagagggagctaatacctagagcctttacctgttcttagactagtcagcattttgtagcacttctcaggatggctggatctcaccacccatgaacctacctccctggctaaggagttggtgctatggttgatttaaagtctcactatgaagaccattctattcttcagtatttggaagccctgattgatccatctatcttttgccctctcttttggtacttttttcaatattcaatcaatagggttttttgtttgttttgttttgtttttaagacacagtgtctctctgtattgcccaggctggtctcaaacacttgggctcaagcaatcctcctgcctcagccttctgaaaagctgggattataggtgcgggccaccacacttggctaaagctgattggttattaaatgacaaaaacacatattgtaccttgaatatgtatggactaattaattaaatcccacagttagaaacagcattatagaagatttaagcacataagtacacttatttgttactttgtaactaataatatcattatttcatcccaggattgattttggctatttatcacctataaccattgtttgagtgtttattttcagtgagaaaccacttccctcttgagactctcccactcccctcagcccaaagcacagtcaattctgctagtttcaatatgctgtaactaggtcagttcataaaatacactgaggacttctggctctttccttctacttcccagtagtgatatcatgtagcagttttagtctgtggaactagacacatgtgattttttcctaaatttgttagctcagctatggtagtttatttactttttatatttttgttaatttcaggaaccagaagctccaggaagaaaaacataaaagcataactgaggcacttaggagacaggagcagaatataaagagttttgaggagacctatgaccgaaagctcaagaatgaacttctaaagtaattgtttagcatttttaaataactaatatgtttaaattaaattggtagaaacataacaaaaactgacaaagtagtctgtaacttaggcaaactttagtgtttgaaaaaaaaaaaacatagttttatcgatacagtcaatcctttcctgcatttgagttaggatagtttttaaaagataagggccgggtgtggtggctcatgcctataatcccagcactctgggaggctgaggtgggcggatcacctgaggtcaggagtgcaagaccagcctagccaacatggtgaaaccccatctctactaaaaatacaaaaattagctgggtgtggtggtgggcacttgtaatcccagctactggggaggctgaggcaggagaatcacttgaacccgggaggcagacgttgcagtgaactgaagttgtgctactgcactctactagcctgcgtgacagtgacaatccatctcaaaaattaacaacaataaaaaaatacagagaagcacatcctctgcgcttcttatggcttctctaacgtttattgtgggctgtgatttgctttaattttcaggacaccttgtgacttgcttagcttgcatagttgataagctgtaaaattggaattataaccacttttagttatcttttcctctacctcactcatacagtcagaaggatggggttatctgacaatatataaattatactagtggtcatagtatttgtcagtgaacatgtgccttgtattccttcaagattcagcaaagccagaatcaaaagagctaaaattaactatgtgaggcaaaaagtgatatagggaaaggaaaatatggacaactatggtaactttggcttttctgtagtctgagttttgtgtatcagtgaataatatctcagtgctacgacattatgcccatgtggtaacatttctcttcagtgtgtgggaaagcatctggcacataaaaagtgctcagttaatatttgttgtaaatgtgtcacgaggaaatgattcaactcaggtgctctgggcatttcttatttggcctcttttattgcctttctcataatttgtcatcgatattccattacataatattgcaaaggtttcttgaggtaatcctttaaacaaatcctatttttaaaaaatatggcagcttttttatctattgattttgaaatgatgtattttacccacatcttctatgtcagtttctatactaaaatagctaaaatggaagtgtctgtagttgctgaatttttaggaataaatgaattaaagtatgtgtgttaattttacatagttatggagctagtgaactatttggtgtcattgtgacagcttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaatccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaaggtgatgtttggggggaaaataagctgtatttttcagttctgctgtaggttattagcttcccaagttgggtcttttctatattctaaaaaatacagcttacacttcattgttcatacaaaattacacattttttgtaattttaattttataaattaaaaatcatggtcttcactgccttttgaggaaccttcatgtttaatagtttgtatattcacaaaggccagtgatttatcatggatattttatccaactttatttcatatattttgataaatctgcaattgtcaggaacgtagcagcaacttattgctgtcaagtacgtattactcctaaccatgagagactttatttttcacttacggaaaacttttaacttctctgtcctctgtgacctagtttcttatttcttttgcttctaatatatttttatgctttataatatttttacttgatgtataaccttctgaactcttgtgtacattggcctgagactatggaagttgaataatttttcaatcttcagatgttttacatttcagtgtatttttttttttttttgagacggagtctcgctctgtcacctaggctggagtgcagtggtgcgatctcggctcactacaagctccacctcccaggttcacgccattcttccacctcagcctccccagtagctgggactacaggcacccaccaacacgcccggctaattttttgtatttttagtagaggcggggtctcagcgtgttagccaggatgatctcgatctcctgacctcgtgatccgcccgcctcggcctcccaaagtgctgggattacaggcgtgagccaccacgcccgacccatttcaatgtatttctaggaaattgctgtaacaagaagttgaagttttggtggaaatttcaagtagattcctgggaggaaaccagggttagatagttgatgttgaccagatacccaatgtgtggctactgtctttttttttttttttttttaagagacggagtcttgctctgttgcccaggctggagtacagtggcacaatctcagctcactgcaacctctgcctcctgggttcaagtgattcttgtgcctcagcctcccaagtagctgggactacaggtgtgcgccaccatgcctggctaatttttgtagagagagagtttcaccatgttggccaggctggtctcgaactcgtgacctcaggtggtccgcctgacttggcctcccaaagtgctgggattacaggcgtgagccactgtgcccagccccttttactatcttgtggagactaatacttcttttatgcattaataccattacgtatgtaacaaattatggtttgatgatatatctacatagacttgtgttagatgaagtgaaaactacaaaatagtaactacaatatagtaacagacagatctttgtcttcaaggaagttaagagctgtgggtattagggccctgtgctttgagcacatggtataactctggttagcatgtatagcaagtggaatttcaccacatatatgacagttacagcttcacatcacctgttgggtaacagggtttatttcttacttgcccgctacatctgctatttggattgtgaaatagtggtcattaggtctgacatactggccataaatattaaatggcttttgtattcactaggaaaacattatggtgtttaattggtgggctcttttttcagaaaaagctgttcatttgcaagaggagctcatagctattaattcaaaaaaggaggaactcaatcaatctgtaaatcgtgtgaaagaacttgaggtaattgttaagcatgttggtttttgaaatagattttaagcaatatatgaaattttagtcatacataatttatcctaagtcatcctgttgagatgtttggactgccatttatatggctaagaaggtgttagctgaagttaattcaatagttcttaatttcagtcagtgtcacataggaaagtgtagatagagctttgggtcctggagtcctgcccacatcctgtctgtgtctctaactgcttgtgtgtcgctaggtaagttctgtgactgcaggttcctgagctgtaaactaggatgttttccacattatagggttgttgagggaattcagtaagctaacttatgtgcctagttcatagcaggtggccattactattagtttctacatcagcctgttatctccttccatcagcagcaggtaaacaaaattcctgtcattacattgttatcttacagattaaaacaaaatgaggtacatttttcacatatcattgcttctttacttttctgttcattcgtgtgcttgctgtctgaaggatgaagctggaactttaggtacttacaacatattttgtatatgaaatttattttagcaactgtgacttatgtgagaactttgtaggctttttactcaaatatgagatatactaagaaaagggaagcacttcacaacattttacagaatcttttttcctttctttcccttttttttttttttttttttttgagacagagtcttgttctttcgcccaggctggagtgcagtggtgtgatcttggctcactgcaaccaacctccacctcccgggttcaagtgattctcatgtctcagctcccaagtagctgggatttcagccatgtgccaccacacccagctaattgttgtatttttagtagagatggggtttcaccatgttgcccagggtggtctcgaactcctgagctcaagcaatcctcttgcctcagcctcccaaagtgctgcgattacgggcgtgagccaccatgctcagccatttttatcttacctttcatatttaaaaaatatatattgctatgatgtgtgattattgttgggttcttggttgcctctggaaaatgggatgataatcttagaaggacttgcttcatgggatgcggcctataaaagttctgccccaactgtagggcggaagataattttcgttattgtagttagagtcttattgtagagaatcagacttctgtctagtgaccttaattaaattgtgacaccatgcttaaaggagcctgccagcttttacttttgcagtactgtaaagtcattattcaaatgtaaattttcctttttgaattttagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgtatgtatttttcttttcttctgacttgcgtgttttagtaattcgcattaggtcagtattataaaactatgctttgtacttgtataaggtagggggcttacattgggaagatttataaaattaagattcttggattaaactctgcaaacctgcctataggtggtatcaaagcttcccttgccctctgactgctgattgggtttggccagtggggacaccagcctctacatacagtggccctaggctggccactgtgcctcatggccaagtgaggccatagtgcctgcgattacctcttccaagtgctctgcaccaccaccctgtctctagtgctgagaatttctccctcctctgattccccaggcccaaggagcgctaacagtatggccctgttactagcccacccagggaactccaccatcctttgtgcataccctgaataagtcaacctttattaaagggttcttagatgaccttgaccgtgagagccatctgccttctgcctggatcccaactgctgctgtcagatgcccagatcatattggatcccagggctgtcatcaacaggtagaccagatagagagctccttctgtgcacagtagaggagagaaacaggctttcaggttaatttgagaatttgaaagagttcttttacttggagtaggactccaagggtaataaagtttgcattaacatgcactaaattcttttgttgtgaaatttgagagtcaggattgctctgagctcatttaatagaattattatcatatttattgagtcagtacaaagcaaagaacactttaaaacccctttaactgtttttgttaagttaaataagaaaacttaaggttggtaatgactaggattttttttttttttttaccttcttaggcctagctcagccggctcctgaacttgcagtctttcagaaagaactacggaaagccgaaaaggctatagtggttgagcatgaggagttcgaaagctgcaggcaagctctgcacaaacaactgcaagacgaagtgagtattgctcttcttcagttctagtgtgataccagtacacttcatagttacgtaaacttggcacaagtcacactagtgtaaatcagatttattttaacatcaaacattactcccccaaatatgctaaaggtatcctttctcatctgagaaaattctgcagtgataacgtgactttatattcgtaatagtaataaaatggagaagaaagcaaactcacctaaacataaaattttctgagtgcctgatggtgcccactgttatctctcgattctcaccctgataagtattacaaacattcactgtcttctgatttctgcctgcatgccctagagttctttgatatgactgaaaaagatggtgaagaacttgtttgtgtgttctgcttgtgtttttttttaatagggaccctgttgtttactgtcataaagcttcttggaattggcagaacaaaaagagtacaaacatgataagagaacttttccttttgaagcaagctgtgatttgttttacattgatttcttttcctattctgaatcttttcagattgagcattctgcacagctgaaggcccagattctaggttacaaagcttctgtaaagagtttaactactcaggttgccgatttaaaattgcaactgaagcaaactcagacaggttagagacgttttaacccataaatatttttgtatgtataaagcttctggtgtctgtgaaaatgtaatgatcataatttattgaatattaattattgttttaggggaaaagccatagaaatatgtgtcatcttagaagtaaaactccctatccattttggtaataccatctggatcatcagcaaaagtattttgcttcataggtgcctcatggcttgggagagtctcatgccccaataggaaaggcgtggtggtaacatagaagtccccatattcattataggatttccttttttatttgttaccccaatgttaacaccaattcagtagttttacggattccttgatagatatataaatatacaggacaagcagggtggtttagcaaaaagaatattgccttcagaatcagaactgttcttcttttggacccgttttgaagttgtttgaccttgggcatgttactttaacttccttgggcctcagtctcctcatttgtaatggggataataatacctactgagccatgatgaaaaagatgaaatgggtttcagtccagtgcctgggacataaaagacactcaggaaatggttattggtatcattttattattgtgtcttcactgtggatgcatctctgccccttcctacttcgtaagaaggatattaaagttcagatactttattcttcagttgctttcaagttcaaagaaagtacgtatgtgttaccagttcaactgggtctgagccttccttgttcccacctgcattgtttcctcatcagctccttgctctcttctaccagcacttgttttatttttatctctactcgtttctgcttttttctgttcctcattttctttcagttctgtttgtgaaacttctcacagctgaaatcatagcagtctcctatcaataaaaaatagttgaatgaggatagaactctttcgcatgcatgtgttgccgagggcaagcttctttcttgtagcatcacggggaggcattgcaggagagaggggcaggtgcactggctttgcattaggaaagcccagtagctcttagacttgctaaccgtgtgacccagcctcagtaagctttagtccccccatctgtaaaatgggagcagtgagagtttcttgaccacagtgttgttgtgaatgcaggtcctcacttccttatatgaaactcgggccatatgctgtggatttcgcaatagccctgggagttctgaacagcatcctatagtaaagcacattaattattttgcagtcaactgtatgaatattcatgctgggataaataaagattataaatgggtttacatcagttcaggtcaaacttttcaaccaaatgagttcaagtctggttgggctttgccaccaaataaattatgaataaattttcagttctcagagccttgtggctttcaaaattgtgcataatggattctgaaattatatcatgttacaaaagacatacaaagctgtagctggtacaataagctctcagtaaatgttagtggttatcgttaccatggcttcagaaactgtatagtgcaagtttgtccttattactctcttccatttttcaaaaaaataatattctcaagtatattttcttctctgccttgtccacttacttctgaaattggctttttgtaccctgcagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtaagccacccgcacaaagggttgcggggtgctctggagttgggtagccaccctgcccacgacacagggttgccgtgagggtcagcgggccagagtggcaaggtctagtgtttggcacacagagctgtttagagagtgatagttgccttgcctttgctgcctgttggtttcctgcattttattattgccactgcaatttaatttaggtgcttgaatcattagttttctggatcttatgcatcataattggctatttgtgaggataacagtttattttcaaactagtagagctctttagaaaccacgttggtatcttctccgtgcaattggtaatattcttgccttggttctttctgcaccttaggtctgggcagatcacacattgcttcccccagtccttgtcctgacagaatgcccctaccatcacccactgagtctaggcacagcctctccatccctcctgtctccagccctccggagcagaaagtggggtaagtataacgttctgattgattagcttcagctgaataatgttacttgctctgtcagccttcacttgttttactgggattttttttttttgagataattattatagatcatgtggcagtatagaatttgcaatcagattgcaaaatgatatgtcatctttgagaatcatctaaattacctggagggaaaaagattgcttttagcaaataagtggataatgcttatttgctaaacttgatatatggaccatgcaatctggtattaataagcatcttcctagttctgtgaatagatttggtttattaagataaaaaacaaatgtacaaaatctgaaagcaaacaaatggaggttatttataaagttggaacaattttacacatcattaaaaagtcatttttaaaatattttggcattgaaatataaacagataaggttctgacctgcatatcattgaaataaattcaaacgtggtagcaggctctggtgtatgattgttgaaacaggaaggagtggatgtttttagaaactagtccactgggtcagccaggctatgatttgagtcatgagcagactcctacccatacctgggccccacagcagagggaactgactccttagctccaggctcgatctcgggcatctgcatgttaatgtagttctctgccacatgggcctgtcgtagtcctaaagctttttttttttttttttttttttgtgataagccaaaaggaaggataagacacacacatatgctgagttagggcgctttgctcactcaaggttgtggtgttgcatcttcatctggttcatgctgatagtgtgcagaattttttttcagaaatgttttatggttatttcctaggaatagcattcagagtacaacattattctttattaacaactgtagtacctacttcacagcatgaaatagttacaaggagtaactgattaaacaggtattaattgctgagaacaatgcctagtggtggtggtgaggtggagctatttacaagacaaagagaaagggaattttgtagagccttttcttgagtcacaaaaggctttttgtcaccttgtactctttggttttccattattgaaacttcacgagttttatccttccaatctagtctttatcgaagacaaactgaacttcaagacaaaagtgaattttcagatgtggacaagctagcttttaaggataatgaggagtttgaatcatcttttgaatgtaagttcaaatataaataccagtttttatatgttgaaaatctagaaagcttagttttggtgaaacgtatccattggtttaaaaagaaaagcagttacaaattgggtcattattattttgtgatacaaccacaagtacagatgtatcacctcatttttctaccatgatgattttcatgtgtgtgtttactttttaaaaatttcagtatgactaataatttcagagtttgagctaagcttataaatgaattattaacttatcagattttaaataagtgatttttatttattttttcctttgatggaatacaagaatgtttatttttatttttttgagatggagtctctctctgttgcccaggctggagtacagtggtccgatcttggctcactgcaatctccctcctcctcccaggtccaagtgattcatctgcctcagcctcccgagtagctgggaccaaccacaggtgcatgccatcacacccagctagtttttttgtatttttagtagagatggggtttcaccatattggccaggctggtcttgagctcctgacctcaagtgatccgcctgcatcggcctcccaaaatgctgggataacaggcatgagccactgcgcccggcctaaggatgttattttttaaatatactgattcagttgattgcctcagatttagaaaacctcatttttagtaaaagaatagagataaaagaatattaagagtccagaaactggtgtcctggctatggccctgccttagactgtcttactttgtagccactttgtaagtgtaaaataagcatgtagagcctatcatctctaaggttctttccagcttgagaaatctttatatttgcatataagctattggttagccttgtaaacttcatcttcaaatctgaaagtgttaatattttgaacagttaaatgagagggcttggtaaattttgtaaatatttgttaaagtctttgtgttaaatcattgatattttaatagaattcaaatgatgatcagcaagccaattgaattcttcactgtcactgggttgattttcctgttgggtaacgaatctcattttgtaaacaaagttaattctttcaactacgagaacactctgacaagcaaatacgttgccaagtggttatgttgggaacttcatagaatcctgttaggaaagggcgcacccagttactttggcttcagttcccgtgctccagtcagttgcccccacactgcactgcccttctttgtcttggtgttattattaaggactcatgggacaattgtgcctcatgcagctgcagggaacatgccaaggcagttggaaatgggcgggctttctcctgccggggatatgtctcatgtggacgctgctgcagctgctgtgcccctctcatatcagcacccaagtaagttctttttttgaactaacagtcagcagggtcgcatactaaataccagtccgtgtgctctgtgaattatttcatgtatcactgaagtcatcttgtaggtgtaaattagtcaaaatcttgggttgggggttataggtgtcattatattgttaatgacatttctgaagtaattcccatgtgaacatgtaaagacagtgctgagaaaggacacgttggaaggaaaggcttctcatttaggcttcccaggccagttgcttaaaaagtgttttcatttactcttcagtgcctggcatagtagttggacttttccccaagactcttctgcaaaaactgttccttgggaaccttaaagtttgggaaatcacagtgaaaaattgaaataataattaactcccagcatatatctttaatatgattgtaacatttaaatattatttatttttctatctacttgtttcctttgtgtcttaagaaattaggacagaaaaacttcgtatttcaatctttggaaaagctgtgacaccgagttagcgtagcactggaggaaaactggccatcagacttctcttctctggcccacttcctctttttcctcttctcctccagattacccacttccctccctgcgggtggagggagacgggaagagagccgtgggagctttgtgctttgttccagggctcagccaacagccaggtccttttcttcttggaccaagtgtttaatcctcaaatctgaaaggaattttctcaagtaaagccacctcttagtccctcccaaacgttggaaaaacatcatacccaaaacccctgttagcagtttcttggttttagtcatggtacccaggaacatataaaataactgaaagaggcaagagattttgagagggttgatgttgctgattccagagtaaatctgctttggaaagcattcagtgagacatgatctagagccttgtctctgctgggcactttgctcagcgctgagcatatagctcaagccctcgccttcctggatttctagcaggggaggcagatggtcagcaggccatcacccaggaccgcagcagggaggggctgcagcagctgagtaggggccgtggccacaagagggagtgtctacaggcactcatttggcacagacctgagcgagggaatacaaataatgtgataggataagggaaatcaactgagtaactaggtgttctgctgctgagatggaacatagattataatatttgctttaaaaattattaagcagcatggcgagtgacattttagttattgagaaattgttatatttgtcatttcatctcttcatctgggcacaaagggaattcaaaaaggttgaaatttggtgtctcggaggtgccccgtggacatgcttccttcctttccccttgtgtccaagagatttctgtataccaccctgcagctacaaaatatacaccagagtagagaagcagctcactcttcctctttattttgtaattggtgcttaaacaacattcctattttgagattactattccatataagaaagcaatcttgtttaggagtaactattttttcttctctagcaaggaggaagttgcatttctgcctgtggaaatgatcagctgtctcctctggtattttaatttcatgagaaggattcagaagagatgggggagagagagaagaaactgtgttgcttctctcctattagtaaaactcagttcctgctgatcactttagaacaaggcacagcaaaaaggttcaaagtcctctgctgaacctatgaatttttctacttattagcattgcttgggttgaaaaaaaaaatgtaggttatgggtcagagccagaagagaaaggtcagcataattgtctctgggattggggtctaattaaaacttttgagatatagggacctgtgccaagatgcagagggaacagacaagtaattaaagtatggaccttgcctggaaggaatagaagtggaagaaacaagtacatgtagtttttgacagatcaggtacaagatatcctgcaagtgagatgctggagtggttagttgtcacttcaggaataaggaggaggtggcatttcagttgggtcttgaatagcatttcagactttgtgagagcaagggagtgctacaggctgaggagacagtgaaggtgaatgtcaagcaaggaagatagagccacggccaggccccagtgagtgggttggtacagatgaaatatttctcgtacaaagttggtggtgatgtaggaaatcaatctgggaagaaaagggcaggttgtcagagcccagactaccatggcgtaggactcttatcagagcggagatgctgcacagcagatccacatcttcccctcaggaaatgcctggtgcagatgaccacaggttgttggaaggcagagactggcttcaggaagagccttgactgggctgtttcagtagtccagggagatggtgagaagggcccctgttgcagccacaggacagggagtgtgaacctgcaaacactggtggctgagtggatagagggtagaaagagcatgatcgaaggaccgggatgatcatgcctgggacgaagctagtgctgtggggtttccacatgcggatggcaaggaactatcagaaatgtggacgcgaggctagggagagagaccaggagtagaggaaaagatagggaaaggatccatatacaagtgatggctaaaaccccaggaagggctgccgtcagtttggaggaagtggggaatgaacagtgagatggctggaatggcggggggagggcagtggtgtgatttctgttctgttttgttggggtaggacagacttgagcatctttatgggagtaagacttctaaaactactgtgtacagaaatagggattaatggctcagtctgggtcctaaagataggggagggattataatcaaaggcagaggcagaaatgcagggtttgccttggaaaggagggaggagatctgtgaagaggatgagaacatgtgacatggaaggaggacagttggagttggttatggtgagggtgacgtatttgtctcagtcaagtgaagtagggtacagttcaaggagtggggtcgggagcttgaagtcggtgaaaatgaaatagtgacttgaagcaggtcacagagtcaactaaaagccaagcagagtctccgtgggtcttggcaagggctcctgcagactggtcctgcattcatttgaataatctgatactggaagctactctttattttctgtcctattaggtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaagggtaataagtatgacttgattctctgaactggttgctccattgtacacctttcgtaagtacattgagctcagggaggggagtcaattggtgtacaaagtcagaggtgcggcagatgccttaaaaggcatccctgtcctctccttgtcttaaaagcagtgggaaaggctgcacagaatgtgaagcttaggagttttgtagtaaaggatagtttttgaaggtaatttttgtacattctcatctgatccttaaaacaagcctgtaaaaaaggtagactgtgctttgctgcagaactttgctttgaaaacagggtttaaagaagagactgtcagtgccagctagctgggactagaacccaagggaggagtggctgccagttcacagttgcttccaggggcacacactccctccctccttcctctatttctcttcttgccttctgtgtcccaattctagtcctagcagatggattactctgtccacttaacacacctgctaagtcttgcttgaattactctaacatatgaatgttccttggactcttggttaattcaagtccaaagcacaggacacttgccaattaataccttccttcattgagatgacatatttgtcttcctttgatgatagcaatgacttcaattttaaaaattagtcctctggcatacaggctgtacttgaaggatcgggattaatattagtgcatttttaaaacacttaaaagttttacaaatgtatttgtgtattttctgttttggtgcctgttttatagaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataaggtgccagtgccatgggcagggcaatctgtgggtgggggacatccagggcttccgtggcttaacttcttgggacgggaatccgtcttctccattgaagacaaaaaggtgaaaagtatagaaaatccaaagttcaaatggaaccttgagtcttttaaatatactattcttttgacaaaaattcatagcttttttgcttaaggtaaaagatttaagagattttaatttgtaaaagttggggtggctcattaagaaagaaaagatctatcaaatgcattaatactgacattaatattttatgtaagtctgaagtattatgggtgttaaatgcataccctatagtttattttgatgtgcttgctaaatttcatgtttaaaagtcacctcttttttagacttttaaattacatatatatttcaaaaatggttcttaaagtatttcatgaaattaatgcatatctaatttcaaaattttccaccctctccatgtaatcagagctcaaaaaagatggtccaagaaggctccctagtggacacgctgcaatctagtgacaaagtcgaaaggtacctgttttccctacacactttcatacacaaactgttaattgcttattttgtcagccaagagaaacagatgtttgagattgcctgtaagaagttattgaatcagtcaaaattagtgactataaaaacaattgagttttttgacttgtgaaattgatcctgatataaattgtaaactagggcagaaaccccccagggaaggaattgagaacattatgaagatagcaaataaacttgacacaaatttttacattttaatttttatctttccctaatttagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaa

SEQ ID NO: 5487 - DNA, 34608 bp, human; identical to SEQ ID NO: 5486

SEQ ID NO: 5488 - DNA, 34592 bp, human
ggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcaggtagacacacctgccccttctcgggcggaaataaagtcttgttttgtgttcgttaaactttcgccgctaggcctcttatggcttccccggaggccactggtctgttttcagacgttcacgttccctctgccccgcaggtaacctataaccattttgtcttttagtccaacatgtttaccgtggctgatgtgttgagtcaagatgaactgcgcaaaaagctataccagacgtttaaggatcggggtatactggatacactcaaggtatcggatttaggcgtatctgtgtcagcttttacaagtgtaacctgtaacaggtagttcaaattcaatcaaggtttaggttttaataatcgtatgatacatagattgtattggtgaattacatttttatattcccgaataactctgtatcctgaaacattacagtctcttgaaaatgtttgagaaaatgttgagtttgagtcgtcttaaaggagcatattcaaataattaattgaactgacaataagataggagaaggaaatatttgtataatgaacacagtaagattaggcttgttttataaatatggcttataggttcctaaattaataagtgggtttgtaatacatttggatgaaggacattgacaccatatagaaaatactagtgtactgcttaataatagtttgggaaatgaaaaattttatctttaaactatattgaaatgtatgaatgtttagtttgggcagaaaatacctattagtatgctttatatttggattaacagccaggagtaggattagctcaacgtgttttcattgaaatatgcatttcaaaagcatattttacgtttaaaatatgtagctatatcctgtgtatgtatccttttttaatttaaattatatggtgagcatttccctgtttccttaaaagttttttgaaatcttcattttcagtggcaacaggcttatctttggatatttttgtaatgtatatagcagtcccctgttgttgaatattttggttatattctccaacagtccacagaggtgtgatgaagtggcagaattttttcctatacttaatatcccaatcgtaagctgctgaaatgggcttctagggaagtgaagttatgagtctgcaagtggatctggctaaccacccgtttcatttggaagctggggaaagaaagctttttctagaacccactggactgcttgtctcacggggtaagacaaagtgtgcaggggaaggtttctaacttctggccatggatctagaaccattatggaaatagaaggaaggtttccaatgaatgtagctcatctgtgtatatctctaatgaaacagtcctgctgaaatttctttcccttgtgtttcttttttatttttgtttttattttatgctagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtaaagtctttccttttctgtttctgaagtttttattaacaggttcttcctctgctgacagtaaagtgctgtatgatagctaagtgctcctcgactaggtccatttctgtttcctctttgaattcacattgtacctgcacataatatatttgttatataacaagtgggtactaaatttgaaattaatttcttggcgtctcatttagtctcacataaaacagtgatgtatagaatctctaaatgtttcagacctataattgatctatctatcctctatcttgtctaataagactctgccaatctgctgaatgtctgctgtaagcttggcactgtgataggcacactgcagatgttttgtgtgttacggatgaggaaccagactctggagaggtgaatcaatttgcccaacatcaagtaacttttaagtgacaatgcagggtggtaaatctagatctctaacatgagctctttttttcctgcactagtttcttcagatgtttctctttgtaattagataagtgagaaatacgtaatttaaaaaatctgtaaagttctcaaatattaaaaacacttgttttttttttttactacttttctaattattttaactatatttcttcaccattactgttgaacattagtactactttattattttaaaggcagatacagcagactttccctgtggatatgtgcgtgtttttttttttttaatagactttattttttcagagcagttttgggttcacagcaaagttaagtgggaagtacagagaattcccatatacctgctgcccctacacactcatagcctcccccactgtcaacatcttgcatcaaggtggtacatttgctacaatctataagcctaccctgacatgtcattatcacccagaggccatagtttacagtgaaggttgcagtgagccgagatcatgccactgcactccagcctgggtgacagagcgagactgtctcaaaaataaaataaatttcactcttggtggtgttcatatgtttttactttctttgtgttttctgtaattatccaaaagtttcatattccaaagttttagtgacacaagcttagtacagtatttgaatgaaaacttaaataatttgcatttcttcataagcaaccaaattttatttgtcagcattaggaatttatttattaatttatgtttttgagacagagtcttgctctgttacccagtctggagtgcaatggcgcagtcttggctcactgcaacctctgcctcctgtgttcaagcaattctcctgcctcagcctcccaagtagctgggattacaggtgcccaccactacacctggctaacttttttatttttagtagagaggaggtttcaccatgttggccaggctggtctcgaatcctgaccccaggtgatctgcccacctcaatctcccaaagagctgggataacaagcatgagccctcgtgtctggcctggaattcatttttgatacatcattctctaactttctaatcactttatacttttacttattgtgtaatagtcaataatacaattatatagcaggaattaatcctattcatacaacttaacggtttctactaatgtaaaatgcccatgcagaatatttactttaaaggaaaaccaattgaaaacaaatatcagtgttctcagagcagacatagtgaatggtatatactgtagtagaaatatattttaatagctacccaaaatgtctgttaaacaatattttaagtacactttaattacggttttaaggacagtaaaaatctatttacatttttaaacaatgaatactttttaaaaaattgtaattgaatgacccaggaactcagtcatgtagtcattggttcatcagatatttcagtgtcatctgtaaggcattaaacatttaggcatatcatctttgatgtgaagtacttagaagttaattagatgataaagatattttatccttttgaccttgatatgtttatagtaatttatttaacagtgtaagaaagagcttgaaatttgctttattagcatagttataatcttatttaatctgaaggatgtttcttaatttcatattcagaaacatatcctaatttatcatttaaacactgatataaaaatatgtctacttagtaacctattttttcttaaggtatttactatgcaggatctattacaactcattaaaatcaaccctacttccagtctctacaaatcactggtaagatggcttagtttctgtaatctactttggtttgttaattataactgaatagctgaataaaagtgaaatattttcttttaacaggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaaaaaaaaaaaaactaataacttttaggccaagtgtctttgtatactaggtatccctctcaagtataattggtagggtattagatgtattaatatttccttaaagaatgagagttgtgttcagtaatgtgttatatatcttttgttcttaaatgtttatacaggccgggcgtggtggctcatgcctgtaatcccagcactttgggaggctgaggcgggtggatcacctgaggtcgggagttcgagatcagcctgaccaacctggagaaaccccgtttctactaaaaatacaaaaaaattagctaggcgtagtggcgcatgcttgtaatcacagctactcaggaggctgaggcaggagaatcgcttgaacccggaaggcagaggttgcggtgagctgagatcacgccattgcactcctgcctgggcaacaagagcaaaactccgtctcaaaaaaaaaaaaaatgtttatatagacctaataaattgccttaattttggccttgataatagccattcatagagtccataactactgtgggtttcaggccattggttagacttgatgatgggctttgtagcatgaacataagctggcaacttggctttgatgcatagttattctttaggtcttttaaaataatctgttagtaatagtccttttgtgttggtacacccttggattttgtctgttgcctgcactatcatccccacaaggacattcatttattcatccattcattcgccaattcatttagaacttaatcatttgaatacttattttctgccagccattaagtctgtgacttaatcgccaagtctcttggtagtaatgttagcagaatataaataaattggagcacaagatattctggactgcccgcaaactagaccatctctactgaagttcagtatggtaaatgatcctatattctgtactctaagtgtcgtccagtgtgactctctgtgattatggaaatgtctgtgtctatgctgtttaatgtggtagctgctatcctcatgtggcttttgagccttgaaatgtggctagtgtgactggataactgaatttttaatttacatttaattagctacacttgcatagtgactaccatattagcataattctgaggtatatagctagtatcttttgcttaactattacttcaaaaggaaatttgtggcttgaagggatattaagaaataatctatgggccaggcacggtggctcatgcttgtaatcccagcactttgggagggcaaacctggctgatcacttgaggtcaggggttcaagaccagcctggccaacatggtgaaaccccatctctactaaaaatacaaaaattagccaggcgtggtggtgagtgcctgtaatcccagctacttgggaggctgaggcaggagaatcgcttgaaccagagaggcgaaggttgcggtgagccaagatagcgccactgcactccagcctgggtgacagagctggactccatctcaaaaaaaaaaaaaaaatctatgtagttactatagatacattatccttaaaagtagtttttccatggccgggcgcagtggctcacgcctgtaatcccagcactttgggaggctgaggcgggcggatcacgaggtcgggagagcaagaccatcctggccaacatggtgaaaccccgtctctactaaaatacaaaaaaaagttagccaggcctggtggcgtgcacctgtagtcccagctatttgggaggctgaggcaggggaatcgcttgaacccaggaggcagaggttacagtgagccaagatcacgccactgcgctccagcctagcgacagagcaagactccgtctcaaaaaaaaaaaaatagtttttacacagtctctttaaatgcatctggttcagaaagacatctggccgacagcccttaccagcttcacctagcatcccagtaaaatttctggaagccagaaaaactatgagtagcagataggtcaggcatcctagtgccaaaatttggatagaactcttagctaacaaaatagctcctggtaagataaaatttttttaaaaattggtgtcttctaattaagtaacagaaaacatgtaggaagatattgtgtacttaaccgttgtctgtcccctgactcagacctatggtcttatcctaccatatctatgctcagggggtgctaagctgttgaatggccttggtacttttcctcctagattctagtcacccattcttcccactgctaattttcctttcagagataatgatatctgttatgcgtgtctgtgtgaagagaccaccaaacaggctttgtgtgaggaacaaggctgtttattcacttgggtgcaagtgggttgagtccgaaaagagagtcagtgaagggagataggagaggggcagctttatagggcttgagtaggcagtggaaagttacagttaaaggtggttatttattgttagcaggggagggggtcccaaggtgcatggtggagagatcttgggactcattgtccagaagaagaatgtcacaaggtcgattgatcagttggggcagggcagaacaagtcataatggtggaatgtcgtaaggttggtcagtcagttaaggcaggagctgtttcacttctgtggttttttagctggctcctgcaggccatctggacgtatatatgcaggttacgggggttacaatggctgagcttcggctcagaggcctgacaatatccagaaaatgatgtgcacaaaatttggatgagggaagaaaatttggacatcggccctttgctttttggaagtaaaaattcttatctgcaattggcaaaagaataagacatatacatcaatggggacagaattaggaagtccagaaatacatccacacaaatatagtcaattgattttttttttaacaaaggtgcaaaggcaattcaatagaggaaagatagtcttttcaacaagtggtgctgtaacagttggatattcatatgcgcaaaaatgaacctagacacagatcttatttattataccttacacaaaaactaactcaaaatgaaccatagacctaaatgtaaaatgcaaaactataaaacttccagatgagaacagtagaaagtctgtgatcttgggtttcgtgatgagatgtaacaccaagagcaagatacatgaaagaaaaaagtagatcagttagactttattaaaattaaaaacatctctgtgaaagacactgttctttttgttttgtttttgagacggagtttcactctgccacccaggctggagtgcagtggcgtgacctcggctcactgcagcctctgcctcctgggttcaagtgattctcctgtctcagcctcctgagtagctggaactacaggcgcctgccaccacgcctggctaatttttttgtgttttcaatagagatggggttcaccatgttgatcaggctggtctcgatcccctgacctcaggtgatcgcctgcctcagcctcccagagtgctgggatgacaagcgtgagccactgtaccctgccaaaagacgctgttaagagaatgaaagacccagtgtcgaaacccatagagctttacgtcatcaagagtgaaccttaatgtttgcaaatttaggtcaggtgatcccaggatggtatgcagactgtgacaaaatctaatccccttcctgaagggagtgggggtgggggaaaaggtgctgagctaactactgtttttagttccaagaaactaaacatttcttaagtaatttatgcttgtggtttaaaacagtttcaaactattcagaaggatataaagtgaaagcaaagtagcagtttctgcccatgttctctaatctcacgctccactgataactagaattaacagtttcactccactgataactagaattaacagtttcttgtttatcttctagaattgtttgaggttaaaactatgtatttgtaattaaaacacaatcaattgggattatatcgtagatactgtatgcaatttgctttttttaatccaccaatgtatctttctgtagcagtatagactaattatttttaaataatgtatttaaccccctattgatggagatctggttgttttattgtttgctttttgccattacaggtaacctatgtgcagtgtgcaccctttgtgcccttgtgaaagtatacctgtgtaaattcatagaagtggaatgactagattaaagggcacatgcatttcgaatatatataagcactgacaaatttctcttccaagtgaatgagtatagctatatatccactcccttgccaacacttagcattatacaagttttaatcttagcagtgttatagggaaaataatggtttctctgttgtattaatttgcatttatgattttgttcatgtttattcagcatctaaaaattgtgttcatctttgacaatgtagttttttctgcaaactacccatgtttttccccatttttctgattttttttttttaaactgatttgtaagagttctttgatgttatgaaaatgtcatcactttagtcttggttatgcctccatattattgcaactatttttcccagtgtgttatttttttattttatgccatatgtaagttttcagtttttatgtagttagattgataaatatttctccttattccttccaggttctgtatcatgcttgggaaggccttttctcagatttattaaaagatatgactgggcacagtggctcatgcttgtgatcccagcactttgggaggcccaggcaggaggattgcttgaggccatgagtttgagactagcctgggcaacatagcaagaccctgtttatacaaaaagtaaaattagctgggcgtggtgggtggtggtgtgcacctctagtcccagctacttgggagactgatgtaggaggattgcttgagcccaggaggtcgaggccgcagtgagccatgattacaccactgcactccagcctgggtgacagagcaagacttttgtctctaaaaaaaaggaaagatatataatgtaaaaaatgataatgtcctaaaactaagattgtaaaaacagtgactgagcagtggttgaaagttctgaaacaaaactgtatgcatatgttttttaggttttcttatgcattttttaaaagaattggcagaatatcatcaagctaaagagagttgtaatatggaaactcagacaagttcgacatttaacagagattctctgggtaattatagccttctttcttaatttcagttctgctgttttcattttgaatgaaggaaattatctgatttaccatattgtgtgattgctccttgaactggagggatgcagccggcaggcaacaagggaattcatttctggaatcatcttgggggaccaggaagtgctctccagtgtcattccctagcctcatgaatgccagggctacactggccaaatcatgcagggattcaaaggcccatattcttccttgtttgttgagtttgacttctcttaactgggaggttcttcctcgtgtcttgtctaactttacagccacccagttagaagattataaactacttgctttgcaaagtactagagaagtcagtgacttatcacttcattttatagttgaggaaaccgaggtcctcagaggaagagcaacttggaaacactcagtctgcatcagaactaatagtggagtccaagttctcccatccatgatctggagctttttgtactatccagctggtctgcagtaccatcctgtctgtcagtttcgtgctcagtagagatgggaaatagctgtttaaaacgatatgcttaatggatttcttggcccttccttactcttaaatggtaacttgcaagaagataagttcataattcataaaatgtattatatgactatgcctttaagtgtatttttaattcaattagaaacatattacttgctaattatcaagcagtgctgttcagtggtgtgagccacatacataattttaaattttctagtagccacgttgaaaaaagtaaaaagaaacgggtgaaatttgttttaataatatatttaacccaatacatgcaaaatattatttcagcatatattcaatataaaaaatactaagatatttcacatttattttttgcactgtctttgaaatctcatgtgttttttacatttaaagcacatctcagttgagtctggtcacatttgaagtgtcaatggccccatgtggctggagagtcctgtgttggacagcatctggaaaatacagaaaagtagatggaaaaacatgtctaaagtcatccctaccagagataaacactatcgatgttttaatctacttctgccagcctttttcccctctgtgcatactttttgggtgggcgttatacacggttgagattgtactctgggttcagatttgcactttgctatgtggttgattctgatccatagttggtttgagggccatggactaagggaagagtcagtagacctcactttaatcctggttatgctgtcatgtagtcacttattaagctatatcagcatttgttctttatgtgtaaaggggaggggttgatatacgtgatctttgattcttttaaagttattgttttgaatatgtaagtcagctttaaccagagtccaataaagagctctctgccttagcacttagagagtaggaagagactccagtattttctgacttaaactgtactcttggctttctttttcctctaacatttcatgatgaacattttcaaacatacagaaaagttgaaacaattttagcgaacacttgtatacccaccacctagatgtcactattacacttgtgttatacttgcttcatcatttttatctgtccatccattcatccaccttcctttttttgtatttcaaagtaagttgcagataatccctacactttcccctaagtatcctctttacttttgaaccagaggtctggcgtcttacgcacctgacgatgtttctatgtcctaatttgatgtgttattttttaatagctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaaggtaagctttatcttgttactgtaaacaagagtgatgtttttgtttgtcttctaaagtcttaaccataggtatatgggaaaatatctagaacttttaataacgaatgggatactgtactgttgtgcaaatttttttttatttctggtgacatttgtttatgccttttgagtgaatcctacaaatagagtgaatgagataaaactaacatgaaataaatatatttggacagagcattaatgttaaacctagatgtagagagagaacttgttcctgtttttatagtataatagttggtatttttaattttttgtgatcaatttgcagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagaggtggtatttacaaatattttatgggtggctatttcctgcagctattagtaggttggctcgagatccagcaacaggatggtacagttgatggaacaaggccccagaagagcaatagggactggggccaagagtgcaaatagaaggatggtccttgaaaaggatacacaaatttgcttcctctgagactgatggaaaggcgagaactgtggaggtgaacaatcaagttgggattatgagaaacacaccctaaataagctccatctcctcaggcagattagagggttagatcttgggttttaggagcagattggaggtgcagagtagttcctgtgggtaagggaagaacagccctttaaagcagagaggactgatcacctgtattgagggctcagctgtggttgggggagcctggaattgagagaggtcaaaccaggtgcttgtaagtgagttttctgttctagttctggggaggatttgtaagtatctctctgtccctttcagtgagggtggaaagatggagatgcttgggaagtagagcttttcagagccttatttgactagagaaaggcagcctacttaatcgaagattctggggctctcttgggtagtgaagggaagcagaggagagggcaggtggctgctaacctagggggaaaggaagggttgagtggcagtctcagtgatcaaggactcgatctggatagactggtaggtggaagaatgaggatggtccaagattacagaattgcaggatgaggtttcaggtggagactagaaaccaaatgcagtatgctgccattggagagagccatggaaatgagcaagggtgaaggtccctggggtaaaggagtcaccacaagggtcatccatgtgaccatttgatcttgtcaccccagaaagtaactggacaggagacagagagggtgaggagtgagagggagtccatgttggcaagcaggattggatctactcctttaaatcatattcctttcccaagggcgtgtcttagaccaaactagatttacagcactatttccaacatacatccagaactactgctgtcagatgttgaaagtaggaatgcttccccctagtgtccactctcgcctggggcttctcaataagacctagttgtttaatgctaagggcaccccctctaaaattttgtatagcatttctgggaattgggtttgcttcagctataaaaatgaatgtcagaagcacatatctttgagatgattggattgtgtttagactaataacttcaaccttcaagataggtgactgactagatccctgtttatttatctgatcatctgaaggctttgaagaagattgtcatcctcataagaagcaccatgtctttattccctcacctggactgtccatccccttctctccctgataaaaaccatagtgtctttcaagacccagcttggatgtcacctgggtgatgccgtccctgactcccactgagcgacccatttaggcctcattcctgcatcagtctttatgtacttcagttacaaaatcatcacatcttagtgtgattgtttctcactccctgactaaattgtgaggtctttagagatgaggactatatctgtctacctttttatatccagttcccagtatgctgcttgacatgtcataggtagttagtaaattctttctctgtgaacacacaaatggaaggatggcccattcttttaggagttcatatgagcttgctaactctgagtcagaatgacccgtgaactgaaacattcagacgacaccaccactaaaaaccatggggattcaattcttttggagttttactgctgaatgtacattttgcttaatttttctttctggggaacttgccaaaatttaggtaagggcgccaggtgtggtggctcatgcttgtagtcccagcaccttgggaagccaaggcaggcatatcgcttgagtccagaagttcgacaccagcctgggcagcatggcaaaaccccatctctacaaaaatacaaaaaatcagccggacttggtggcgtgtgcctgtagtgcctgcagctactcggtaggctggggtgggaggaccccttgagcttgggaggtggaggttgcagtgagccaagatcaccccactgcactccagcctgtgtgacagagtgagaccctgtctcaaaaaaaaaaaaaaaaaaatttttttagataagggactgagagatgttaaagaactaaatagcataaatttcacatggcatgttaggactgtagggtaatggtagtttaacagtcattgggggagtaaatttttatgcaactagaatacgcaaaaagtataccttgagtcggaatctcttgaaggtgaaattgttatcctaaatgtctgtactttgctttttggaatgtaggaagcagtatattcattcaaatctgttttgctttcattagcttgcttgctaaaaattaatgcttttctatacagattgaaacaaaagaaatttatgctcaaaggcaacttttactaaaagatatggatttgctaagaggaagagaagcagagctgaagcaaagagttgaagcttttgaattgtaagtaatgcatgttcattttggatattcagaatgatgagattaaaaagaattactaaatatatatctaaatattctaatgttcattgccaagtagagttcttatttgtaaaggggatatcacctagaaggtacaaattaagaggaacaaacactagggttttgtttttgaaatattaaacattaagatgaaaagacgaatgagatgctatcatcaggctacagtaagaccagacagattatttggagaagctgttaatactggaacagatcgtatgttttgcagttacattcagtccctcagatctgatagttccgtgtgtgtatgtatagtaactgaattccatatatccaggcctgcagcttttaccagctgtgtgctcagaaaaggaagtatggtggtccaacttgacttgtacttggtgaaaccatttctttgttactcactgtttctaagtgctcacaaatgtttcatccttgagatcttacctgggattgatggcaagttcacctgtctatagtttgtgcaataagccttctcttcctttgggaatctgctattgacacccatagatactccaggaatcttagttcattaaagaatttggctccattaatgtttttttctcacttctataggcttgatttgtttgatttcaactctctgtctaccttactctctttttggcaataatgaaaaggtaaattgatcaagagagaggaaataggcacaaaattggggcagagagagttcatcattcctttacctccattttctctactcttgttccctccttctcagcatataaactaaataaatgtagtttacctctccatggctttccagattaccagcagagggagctaatacctagagcctttacctgttcttagactagtcagcattttgtagcacttctcaggatggctggatctcaccacccatgaacctacctccctggctaaggagttggtgctatggttgatttaaagtctcactatgaagaccattctattcttcagtatttggaagccctgattgatccatctatcttttgccctctcttttggtacttttttcaatattcaatcaatagggttttttgtttgttttgttttgtttttaagacacagtgtctctctgtattgcccaggctggtctcaaacacttgggctcaagcaatcctcctgcctcagccttctgaaaagctgggattataggtgcgggccaccacacttggctaaagctgattggttattaaatgacaaaaacacatattgtaccttgaatatgtatggactaattaattaaatcccacagttagaaacagcattatagaagatttaagcacataagtacacttatttgttactttgtaactaataatatcattatttcatcccaggattgattttggctatttatcacctataaccattgtttgagtgtttattttcagtgagaaaccacttccctcttgagactctcccactcccctcagcccaaagcacagtcaattctgctagtttcaatatgctgtaactaggtcagttcataaaatacactgaggacttctggctctttccttctacttcccagtagtgatatcatgtagcagttttagtctgtggaactagacacatgtgattttttcctaaatttgttagctcagctatggtagtttatttactttttatatttttgttaatttcaggaaccagaagctccaggaagaaaaacataaaagcataactgaggcacttaggagacaggagcagaatataaagagttttgaggagacctatgaccgaaagctcaagaatgaacttctaaagtaattgtttagcatttttaaataactaatatgtttaaattaaattggtagaaacataacaaaaactgacaaagtagtctgtaacttaggcaaactttagtgtttgaaaaaaaaaaaacatagttttatcgatacagtcaatcctttcctgcatttgagttaggatagtttttaaaagataagggccgggtgtggtggctcatgcctataatcccagcactctgggaggctgaggtgggcggatcacctgaggtcaggagtgcaagaccagcctagccaacatggtgaaaccccatctctactaaaaatacaaaaattagctgggtgtggtggtgggcacttgtaatcccagctactggggaggctgaggcaggagaatcacttgaacccgggaggcagacgttgcagtgaactgaagttgtgctactgcactctactagcctgcgtgacagtgacaatccatctcaaaaattaacaacaataaaaaaatacagagaagcacatcctctgcgcttcttatggcttctctaacgtttattgtgggctgtgatttgctttaattttcaggacaccttgtgacttgcttagcttgcatagttgataagctgtaaaattggaattataaccacttttagttatcttttcctctacctcactcatacagtcagaaggatggggttatctgacaatatataaattatactagtggtcatagtatttgtcagtgaacatgtgccttgtattccttcaagattcagcaaagccagaatcaaaagagctaaaattaactatgtgaggcaaaaagtgatatagggaaaggaaaatatggacaactatggtaactttggcttttctgtagtctgagttttgtgtatcagtgaataatatctcagtgctacgacattatgcccatgtggtaacatttctcttcagtgtgtgggaaagcatctggcacataaaaagtgctcagttaatatttgttgtaaatgtgtcacgaggaaatgattcaactcaggtgctctgggcatttcttatttggcctcttttattgcctttctcataatttgtcatcgatattccattacataatattgcaaaggtttcttgaggtaatcctttaaacaaatcctatttttaaaaaatatggcagcttttttatctattgattttgaaatgatgtattttacccacatcttctatgtcagtttctatactaaaatagctaaaatggaagtgtctgtagttgctgaatttttaggaataaatgaattaaagtatgtgtgttaattttacatagttatggagctagtgaactatttggtgtcattgtgacagcttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaatccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaaggtgatgtttggggggaaaataagctgtatttttcagttctgctgtaggttattagcttcccaagttgggtcttttctatattctaaaaaatacagcttacacttcattgttcatacaaaattacacattttttgtaattttaattttataaattaaaaatcatggtcttcactgccttttgaggaaccttcatgtttaatagtttgtatattcacaaaggccagtgatttatcatggatattttatccaactttatttcatatattttgataaatctgcaattgtcaggaacgtagcagcaacttattgctgtcaagtacgtattactcctaaccatgagagactttatttttcacttacggaaaacttttaacttctctgtcctctgtgacctagtttcttatttcttttgcttctaatatatttttatgctttataatatttttacttgatgtataaccttctgaactcttgtgtacattggcctgagactatggaagttgaataatttttcaatcttcagatgttttacatttcagtgtatttttttttttttttgagacggagtctcgctctgtcacctaggctggagtgcagtggtgcgatctcggctcactacaagctccacctcccaggttcacgccattcttccacctcagcctccccagtagctgggactacaggcacccaccaacacgcccggctaattttttgtatttttagtagaggcggggtctcagcgtgttagccaggatgatctcgatctcctgacctcgtgatccgcccgcctcggcctcccaaagtgctgggattacaggcgtgagccaccacgcccgacccatttcaatgtatttctaggaaattgctgtaacaagaagttgaagttttggtggaaatttcaagtagattcctgggaggaaaccagggttagatagttgatgttgaccagatacccaatgtgtggctactgtctttttttttttttttttttaagagacggagtcttgctctgttgcccaggctggagtacagtggcacaatctcagctcactgcaacctctgcctcctgggttcaagtgattcttgtgcctcagcctcccaagtagctgggactacaggtgtgcgccaccatgcctggctaatttttgtagagagagagtttcaccatgttggccaggctggtctcgaactcgtgacctcaggtggtccgcctgacttggcctcccaaagtgctgggattacaggcgtgagccactgtgcccagccccttttactatcttgtggagactaatacttcttttatgcattaataccattacgtatgtaacaaattatggtttgatgatatatctacatagacttgtgttagatgaagtgaaaactacaaaatagtaactacaatatagtaacagacagatctttgtcttcaaggaagttaagagctgtgggtattagggccctgtgctttgagcacatggtataactctggttagcatgtatagcaagtggaatttcaccacatatatgacagttacagcttcacatcacctgttgggtaacagggtttatttcttacttgcccgctacatctgctatttggattgtgaaatagtggtcattaggtctgacatactggccataaatattaaatggcttttgtattcactaggaaaacattatggtgtttaattggtgggctcttttttcagaaaaagctgttcatttgcaagaggagctcatagctattaattcaaaaaaggaggaactcaatcaatctgtaaatcgtgtgaaagaacttgaggtaattgttaagcatgttggtttttgaaatagattttaagcaatatatgaaattttagtcatacataatttatcctaagtcatcctgttgagatgtttggactgccatttatatggctaagaaggtgttagctgaagttaattcaatagttcttaatttcagtcagtgtcacataggaaagtgtagatagagctttgggtcctggagtcctgcccacatcctgtctgtgtctctaactgcttgtgtgtcgctaggtaagttctgtgactgcaggttcctgagctgtaaactaggatgttttccacattatagggttgttgagggaattcagtaagctaacttatgtgcctagttcatagcaggtggccattactattagtttctacatcagcctgttatctccttccatcagcagcaggtaaacaaaattcctgtcattacattgttatcttacagattaaaacaaaatgaggtacatttttcacatatcattgcttctttacttttctgttcattcgtgtgcttgctgtctgaaggatgaagctggaactttaggtacttacaacatattttgtatatgaaatttattttagcaactgtgacttatgtgagaactttgtaggctttttactcaaatatgagatatactaagaaaagggaagcacttcacaacattttacagaatcttttttcctttctttcccttttttttttttttttttttttgagacagagtcttgttctttcgcccaggctggagtgcagtggtgtgatcttggctcactgcaaccaacctccacctcccgggttcaagtgattctcatgtctcagctcccaagtagctgggatttcagccatgtgccaccacacccagctaattgttgtatttttagtagagatggggtttcaccatgttgcccagggtggtctcgaactcctgagctcaagcaatcctcttgcctcagcctcccaaagtgctgcgattacgggcgtgagccaccatgctcagccatttttatcttacctttcatatttaaaaaatatatattgctatgatgtgtgattattgttgggttcttggttgcctctggaaaatgggatgataatcttagaaggacttgcttcatgggatgcggcctataaaagttctgccccaactgtagggcggaagataattttcgttattgtagttagagtcttattgtagagaatcagacttctgtctagtgaccttaattaaattgtgacaccatgcttaaaggagcctgccagcttttacttttgcagtactgtaaagtcattattcaaatgtaaattttcctttttgaattttagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgtatgtatttttcttttcttctgacttgcgtgttttagtaattcgcattaggtcagtattataaaactatgctttgtacttgtataaggtagggggcttacattgggaagatttataaaattaagattcttggattaaactctgcaaacctgcctataggtggtatcaaagcttcccttgccctctgactgctgattgggtttggccagtggggacaccagcctctacatacagtggccctaggctggccactgtgcctcatggccaagtgaggccatagtgcctgcgattacctcttccaagtgctctgcaccaccaccctgtctctagtgctgagaatttctccctcctctgattccccaggcccaaggagcgctaacagtatggccctgttactagcccacccagggaactccaccatcctttgtgcataccctgaataagtcaacctttattaaagggttcttagatgaccttgaccgtgagagccatctgccttctgcctggatcccaactgctgctgtcagatgcccagatcatattggatcccagggctgtcatcaacaggtagaccagatagagagctccttctgtgcacagtagaggagagaaacaggctttcaggttaatttgagaatttgaaagagttcttttacttggagtaggactccaagggtaataaagtttgcattaacatgcactaaattcttttgttgtgaaatttgagagtcaggattgctctgagctcatttaatagaattattatcatatttattgagtcagtacaaagcaaagaacactttaaaacccctttaactgtttttgttaagttaaataagaaaacttaaggttggtaatgactaggattttttttttttttttaccttcttaggcctagctcagccggctcctgaacttgcagtctttcagaaagaactacggaaagccgaaaaggctatagtggttgagcatgaggagttcgaaagctgcaggcaagctctgcacaaacaactgcaagacgaagtgagtattgctcttcttcagttctagtgtgataccagtacacttcatagttacgtaaacttggcacaagtcacactagtgtaaatcagatttattttaacatcaaacattactcccccaaatatgctaaaggtatcctttctcatctgagaaaattctgcagtgataacgtgactttatattcgtaatagtaataaaatggagaagaaagcaaactcacctaaacataaaattttctgagtgcctgatggtgcccactgttatctctcgattctcaccctgataagtattacaaacattcactgtcttctgatttctgcctgcatgccctagagttctttgatatgactgaaaaagatggtgaagaacttgtttgtgtgttctgcttgtgtttttttttaatagggaccctgttgtttactgtcataaagcttcttggaattggcagaacaaaaagagtacaaacatgataagagaacttttccttttgaagcaagctgtgatttgttttacattgatttcttttcctattctgaatcttttcagattgagcattctgcacagctgaaggcccagattctaggttacaaagcttctgtaaagagtttaactactcaggttgccgatttaaaattgcaactgaagcaaactcagacaggttagagacgttttaacccataaatatttttgtatgtataaagcttctggtgtctgtgaaaatgtaatgatcataatttattgaatattaattattgttttaggggaaaagccatagaaatatgtgtcatcttagaagtaaaactccctatccattttggtaataccatctggatcatcagcaaaagtattttgcttcataggtgcctcatggcttgggagagtctcatgccccaataggaaaggcgtggtggtaacatagaagtccccatattcattataggatttccttttttatttgttaccccaatgttaacaccaattcagtagttttacggattccttgatagatatataaatatacaggacaagcagggtggtttagcaaaaagaatattgccttcagaatcagaactgttcttcttttggacccgttttgaagttgtttgaccttgggcatgttactttaacttccttgggcctcagtctcctcatttgtaatggggataataatacctactgagccatgatgaaaaagatgaaatgggtttcagtccagtgcctgggacataaaagacactcaggaaatggttattggtatcattttattattgtgtcttcactgtggatgcatctctgccccttcctacttcgtaagaaggatattaaagttcagatactttattcttcagttgctttcaagttcaaagaaagtacgtatgtgttaccagttcaactgggtctgagccttccttgttcccacctgcattgtttcctcatcagctccttgctctcttctaccagcacttgttttatttttatctctactcgtttctgcttttttctgttcctcattttctttcagttctgtttgtgaaacttctcacagctgaaatcatagcagtctcctatcaataaaaaatagttgaatgaggatagaactctttcgcatgcatgtgttgccgagggcaagcttctttcttgtagcatcacggggaggcattgcaggagagaggggcaggtgcactggctttgcattaggaaagcccagtagctcttagacttgctaaccgtgtgacccagcctcagtaagctttagtccccccatctgtaaaatgggagcagtgagagtttcttgaccacagtgttgttgtgaatgcaggtcctcacttccttatatgaaactcgggccatatgctgtggatttcgcaatagccctgggagttctgaacagcatcctatagtaaagcacattaattattttgcagtcaactgtatgaatattcatgctgggataaataaagattataaatgggtttacatcagttcaggtcaaacttttcaaccaaatgagttcaagtctggttgggctttgccaccaaataaattatgaataaattttcagttctcagagccttgtggctttcaaaattgtgcataatggattctgaaattatatcatgttacaaaagacatacaaagctgtagctggtacaataagctctcagtaaatgttagtggttatcgttaccatggcttcagaaactgtatagtgcaagtttgtccttattactctcttccatttttcaaaaaaataatattctcaagtatattttcttctctgccttgtccacttacttctgaaattggctttttgtaccctgcagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtaagccacccgcacaaagggttgcggggtgctctggagttgggtagccaccctgcccacgacacagggttgccgtgagggtcagcgggccagagtggcaaggtctagtgtttggcacacagagctgtttagagagtgatagttgccttgcctttgctgcctgttggtttcctgcattttattattgccactgcaatttaatttaggtgcttgaatcattagttttctggatcttatgcatcataattggctatttgtgaggataacagtttattttcaaactagtagagctctttagaaaccacgttggtatcttctccgtgcaattggtaatattcttgccttggttctttctgcaccttaggtctgggcagatcacacattgcttcccccagtccttgtcctgacagaatgcccctaccatcacccactgagtctaggcacagcctctccatccctcctgtctccagccctccggagcagaaagtggggtaagtataacgttctgattgattagcttcagctgaataatgttacttgctctgtcagccttcacttgttttactgggattttttttttttgagataattattatagatcatgtggcagtatagaatttgcaatcagattgcaaaatgatatgtcatctttgagaatcatctaaattacctggagggaaaaagattgcttttagcaaataagtggataatgcttatttgctaaacttgatatatggaccatgcaatctggtattaataagcatcttcctagttctgtgaatagatttggtttattaagataaaaaacaaatgtacaaaatctgaaagcaaacaaatggaggttatttataaagttggaacaattttacacatcattaaaaagtcatttttaaaatattttggcattgaaatataaacagataaggttctgacctgcatatcattgaaataaattcaaacgtggtagcaggctctggtgtatgattgttgaaacaggaaggagtggatgtttttagaaactagtccactgggtcagccaggctatgatttgagtcatgagcagactcctacccatacctgggccccacagcagagggaactgactccttagctccaggctcgatctcgggcatctgcatgttaatgtagttctctgccacatgggcctgtcgtagtcctaaagctttttttttttttttttttttttgtgataagccaaaaggaaggataagacacacacatatgctgagttagggcgctttgctcactcaaggttgtggtgttgcatcttcatctggttcatgctgatagtgtgcagaattttttttcagaaatgttttatggttatttcctaggaatagcattcagagtacaacattattctttattaacaactgtagtacctacttcacagcatgaaatagttacaaggagtaactgattaaacaggtattaattgctgagaacaatgcctagtggtggtggtgaggtggagctatttacaagacaaagagaaagggaattttgtagagccttttcttgagtcacaaaaggctttttgtcaccttgtactctttggttttccattattgaaacttcacgagttttatccttccaatctagtctttatcgaagacaaactgaacttcaagacaaaagtgaattttcagatgtggacaagctagcttttaaggataatgaggagtttgaatcatcttttgaatgtaagttcaaatataaataccagtttttatatgttgaaaatctagaaagcttagttttggtgaaacgtatccattggtttaaaaagaaaagcagttacaaattgggtcattattattttgtgatacaaccacaagtacagatgtatcacctcatttttctaccatgatgattttcatgtgtgtgtttactttttaaaaatttcagtatgactaataatttcagagtttgagctaagcttataaatgaattattaacttatcagattttaaataagtgatttttatttattttttcctttgatggaatacaagaatgtttatttttatttttttgagatggagtctctctctgttgcccaggctggagtacagtggtccgatcttggctcactgcaatctccctcctcctcccaggtccaagtgattcatctgcctcagcctcccgagtagctgggaccaaccacaggtgcatgccatcacacccagctagtttttttgtatttttagtagagatggggtttcaccatattggccaggctggtcttgagctcctgacctcaagtgatccgcctgcatcggcctcccaaaatgctgggataacaggcatgagccactgcgcccggcctaaggatgttattttttaaatatactgattcagttgattgcctcagatttagaaaacctcatttttagtaaaagaatagagataaaagaatattaagagtccagaaactggtgtcctggctatggccctgccttagactgtcttactttgtagccactttgtaagtgtaaaataagcatgtagagcctatcatctctaaggttctttccagcttgagaaatctttatatttgcatataagctattggttagccttgtaaacttcatcttcaaatctgaaagtgttaatattttgaacagttaaatgagagggcttggtaaattttgtaaatatttgttaaagtctttgtgttaaatcattgatattttaatagaattcaaatgatgatcagcaagccaattgaattcttcactgtcactgggttgattttcctgttgggtaacgaatctcattttgtaaacaaagttaattctttcaactacgagaacactctgacaagcaaatacgttgccaagtggttatgttgggaacttcatagaatcctgttaggaaagggcgcacccagttactttggcttcagttcccgtgctccagtcagttgcccccacactgcactgcccttctttgtcttggtgttattattaaggactcatgggacaattgtgcctcatgcagctgcagggaacatgccaaggcagttggaaatgggcgggctttctcctgccggggatatgtctcatgtggacgctgctgcagctgctgtgcccctctcatatcagcacccaagtaagttctttttttgaactaacagtcagcagggtcgcatactaaataccagtccgtgtgctctgtgaattatttcatgtatcactgaagtcatcttgtaggtgtaaattagtcaaaatcttgggttgggggttataggtgtcattatattgttaatgacatttctgaagtaattcccatgtgaacatgtaaagacagtgctgagaaaggacacgttggaaggaaaggcttctcatttaggcttcccaggccagttgcttaaaaagtgttttcatttactcttcagtgcctggcatagtagttggacttttccccaagactcttctgcaaaaactgttccttgggaaccttaaagtttgggaaatcacagtgaaaaattgaaataataattaactcccagcatatatctttaatatgattgtaacatttaaatattatttatttttctatctacttgtttcctttgtgtcttaagaaattaggacagaaaaacttcgtatttcaatctttggaaaagctgtgacaccgagttagcgtagcactggaggaaaactggccatcagacttctcttctctggcccacttcctctttttcctcttctcctccagattacccacttccctccctgcgggtggagggagacgggaagagagccgtgggagctttgtgctttgttccagggctcagccaacagccaggtccttttcttcttggaccaagtgtttaatcctcaaatctgaaaggaattttctcaagtaaagccacctcttagtccctcccaaacgttggaaaaacatcatacccaaaacccctgttagcagtttcttggttttagtcatggtacccaggaacatataaaataactgaaagaggcaagagattttgagagggttgatgttgctgattccagagtaaatctgctttggaaagcattcagtgagacatgatctagagccttgtctctgctgggcactttgctcagcgctgagcatatagctcaagccctcgccttcctggatttctagcaggggaggcagatggtcagcaggccatcacccaggaccgcagcagggaggggctgcagcagctgagtaggggccgtggccacaagagggagtgtctacaggcactcatttggcacagacctgagcgagggaatacaaataatgtgataggataagggaaatcaactgagtaactaggtgttctgctgctgagatggaacatagattataatatttgctttaaaaattattaagcagcatggcgagtgacattttagttattgagaaattgttatatttgtcatttcatctcttcatctgggcacaaagggaattcaaaaaggttgaaatttggtgtctcggaggtgccccgtggacatgcttccttcctttccccttgtgtccaagagatttctgtataccaccctgcagctacaaaatatacaccagagtagagaagcagctcactcttcctctttattttgtaattggtgcttaaacaacattcctattttgagattactattccatataagaaagcaatcttgtttaggagtaactattttttcttctctagcaaggaggaagttgcatttctgcctgtggaaatgatcagctgtctcctctggtattttaatttcatgagaaggattcagaagagatgggggagagagagaagaaactgtgttgcttctctcctattagtaaaactcagttcctgctgatcactttagaacaaggcacagcaaaaaggttcaaagtcctctgctgaacctatgaatttttctacttattagcattgcttgggttgaaaaaaaaaatgtaggttatgggtcagagccagaagagaaaggtcagcataattgtctctgggattggggtctaattaaaacttttgagatatagggacctgtgccaagatgcagagggaacagacaagtaattaaagtatggaccttgcctggaaggaatagaagtggaagaaacaagtacatgtagtttttgacagatcaggtacaagatatcctgcaagtgagatgctggagtggttagttgtcacttcaggaataaggaggaggtggcatttcagttgggtcttgaatagcatttcagactttgtgagagcaagggagtgctacaggctgaggagacagtgaaggtgaatgtcaagcaaggaagatagagccacggccaggccccagtgagtgggttggtacagatgaaatatttctcgtacaaagttggtggtgatgtaggaaatcaatctgggaagaaaagggcaggttgtcagagcccagactaccatggcgtaggactcttatcagagcggagatgctgcacagcagatccacatcttcccctcaggaaatgcctggtgcagatgaccacaggttgttggaaggcagagactggcttcaggaagagccttgactgggctgtttcagtagtccagggagatggtgagaagggcccctgttgcagccacaggacagggagtgtgaacctgcaaacactggtggctgagtggatagagggtagaaagagcatgatcgaaggaccgggatgatcatgcctgggacgaagctagtgctgtggggtttccacatgcggatggcaaggaactatcagaaatgtggacgcgaggctagggagagagaccaggagtagaggaaaagatagggaaaggatccatatacaagtgatggctaaaaccccaggaagggctgccgtcagtttggaggaagtggggaatgaacagtgagatggctggaatggcggggggagggcagtggtgtgatttctgttctgttttgttggggtaggacagacttgagcatctttatgggagtaagacttctaaaactactgtgtacagaaatagggattaatggctcagtctgggtcctaaagataggggagggattataatcaaaggcagaggcagaaatgcagggtttgccttggaaaggagggaggagatctgtgaagaggatgagaacatgtgacatggaaggaggacagttggagttggttatggtgagggtgacgtatttgtctcagtcaagtgaagtagggtacagttcaaggagtggggtcgggagcttgaagtcggtgaaaatgaaatagtgacttgaagcaggtcacagagtcaactaaaagccaagcagagtctccgtgggtcttggcaagggctcctgcagactggtcctgcattcatttgaataatctgatactggaagctactctttattttctgtcctattaggtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaagggtaataagtatgacttgattctctgaactggttgctccattgtacacctttcgtaagtacattgagctcagggaggggagtcaattggtgtacaaagtcagaggtgcggcagatgccttaaaaggcatccctgtcctctccttgtcttaaaagcagtgggaaaggctgcacagaatgtgaagcttaggagttttgtagtaaaggatagtttttgaaggtaatttttgtacattctcatctgatccttaaaacaagcctgtaaaaaaggtagactgtgctttgctgcagaactttgctttgaaaacagggtttaaagaagagactgtcagtgccagctagctgggactagaacccaagggaggagtggctgccagttcacagttgcttccaggggcacacactccctccctccttcctctatttctcttcttgccttctgtgtcccaattctagtcctagcagatggattactctgtccacttaacacacctgctaagtcttgcttgaattactctaacatatgaatgttccttggactcttggttaattcaagtccaaagcacaggacacttgccaattaataccttccttcattgagatgacatatttgtcttcctttgatgatagcaatgacttcaattttaaaaattagtcctctggcatacaggctgtacttgaaggatcgggattaatattagtgcatttttaaaacacttaaaagttttacaaatgtatttgtgtattttctgttttggtgcctgttttatagaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataaggtgccagtgccatgggcagggcaatctgtgggtgggggacatccagggcttccgtggcttaacttcttgggacgggaatccgtcttctccattgaagacaaaaaggtgaaaagtatagaaaatccaaagttcaaatggaaccttgagtcttttaaatatactattcttttgacaaaaattcatagcttttttgcttaaggtaaaagatttaagagattttaatttgtaaaagttggggtggctcattaagaaagaaaagatctatcaaatgcattaatactgacattaatattttatgtaagtctgaagtattatgggtgttaaatgcataccctatagtttattttgatgtgcttgctaaatttcatgtttaaaagtcacctcttttttagacttttaaattacatatatatttcaaaaatggttcttaaagtatttcatgaaattaatgcatatctaatttcaaaattttccaccctctccatgtaatcagagctcaaaaaagatggtccaagaaggctccctagtggacacgctgcaatctagtgacaaagtcgaaaggtacctgttttccctacacactttcatacacaaactgttaattgcttattttgtcagccaagagaaacagatgtttgagattgcctgtaagaagttattgaatcagtcaaaattagtgactataaaaacaattgagttttttgacttgtgaaattgatcctgatataaattgtaaactagggcagaaaccccccagggaaggaattgagaacattatgaagatagcaaataaacttgacacaaatttttacattttaatttttatctttccctaatttagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaa

SEQ ID NO: 5489 - DNA, 34413 bp, human
ggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcaggtagacacacctgccccttctcgggcggaaataaagtcttgttttgtgttcgttaaactttcgccgctaggcctcttatggcttccccggaggccactggtctgttttcagacgttcacgttccctctgccccgcaggtaacctataaccattttgtcttttagtccaacatgtttaccgtggctgatgtgttgagtcaagatgaactgcgcaaaaagctataccagacgtttaaggatcggggtatactggatacactcaaggtatcggatttaggcgtatctgtgtcagcttttacaagtgtaacctgtaacaggtagttcaaattcaatcaaggtttaggttttaataatcgtatgatacatagattgtattggtgaattacatttttatattcccgaataactctgtatcctgaaacattacagtctcttgaaaatgtttgagaaaatgttgagtttgagtcgtcttaaaggagcatattcaaataattaattgaactgacaataagataggagaaggaaatatttgtataatgaacacagtaagattaggcttgttttataaatatggcttataggttcctaaattaataagtgggtttgtaatacatttggatgaaggacattgacaccatatagaaaatactagtgtactgcttaataatagtttgggaaatgaaaaattttatctttaaactatattgaaatgtatgaatgtttagtttgggcagaaaatacctattagtatgctttatatttggattaacagccaggagtaggattagctcaacgtgttttcattgaaatatgcatttcaaaagcatattttacgtttaaaatatgtagctatatcctgtgtatgtatccttttttaatttaaattatatggtgagcatttccctgtttccttaaaagttttttgaaatcttcattttcagtggcaacaggcttatctttggatatttttgtaatgtatatagcagtcccctgttgttgaatattttggttatattctccaacagtccacagaggtgtgatgaagtggcagaattttttcctatacttaatatcccaatcgtaagctgctgaaatgggcttctagggaagtgaagttatgagtctgcaagtggatctggctaaccacccgtttcatttggaagctggggaaagaaagctttttctagaacccactggactgcttgtctcacggggtaagacaaagtgtgcaggggaaggtttctaacttctggccatggatctagaaccattatggaaatagaaggaaggtttccaatgaatgtagctcatctgtgtatatctctaatgaaacagtcctgctgaaatttctttcccttgtgtttcttttttatttttgtttttattttatgctagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtaaagtctttccttttctgtttctgaagtttttattaacaggttcttcctctgctgacagtaaagtgctgtatgatagctaagtgctcctcgactaggtccatttctgtttcctctttgaattcacattgtacctgcacataatatatttgttatataacaagtgggtactaaatttgaaattaatttcttggcgtctcatttagtctcacataaaacagtgatgtatagaatctctaaatgtttcagacctataattgatctatctatcctctatcttgtctaataagactctgccaatctgctgaatgtctgctgtaagcttggcactgtgataggcacactgcagatgttttgtgtgttacggatgaggaaccagactctggagaggtgaatcaatttgcccaacatcaagtaacttttaagtgacaatgcagggtggtaaatctagatctctaacatgagctctttttttcctgcactagtttcttcagatgtttctctttgtaattagataagtgagaaatacgtaatttaaaaaatctgtaaagttctcaaatattaaaaacacttgttttttttttttactacttttctaattattttaactatatttcttcaccattactgttgaacattagtactactttattattttaaaggcagatacagcagactttccctgtggatatgtgcgtgtttttttttttttaatagactttattttttcagagcagttttgggttcacagcaaagttaagtgggaagtacagagaattcccatatacctgctgcccctacacactcatagcctcccccactgtcaacatcttgcatcaaggtggtacatttgctacaatctataagcctaccctgacatgtcattatcacccagaggccatagtttacagtgaaggttgcagtgagccgagatcatgccactgcactccagcctgggtgacagagcgagactgtctcaaaaataaaataaatttcactcttggtggtgttcatatgtttttactttctttgtgttttctgtaattatccaaaagtttcatattccaaagttttagtgacacaagcttagtacagtatttgaatgaaaacttaaataatttgcatttcttcataagcaaccaaattttatttgtcagcattaggaatttatttattaatttatgtttttgagacagagtcttgctctgttacccagtctggagtgcaatggcgcagtcttggctcactgcaacctctgcctcctgtgttcaagcaattctcctgcctcagcctcccaagtagctgggattacaggtgcccaccactacacctggctaacttttttatttttagtagagaggaggtttcaccatgttggccaggctggtctcgaatcctgaccccaggtgatctgcccacctcaatctcccaaagagctgggataacaagcatgagccctcgtgtctggcctggaattcatttttgatacatcattctctaactttctaatcactttatacttttacttattgtgtaatagtcaataatacaattatatagcaggaattaatcctattcatacaacttaacggtttctactaatgtaaaatgcccatgcagaatatttactttaaaggaaaaccaattgaaaacaaatatcagtgttctcagagcagacatagtgaatggtatatactgtagtagaaatatattttaatagctacccaaaatgtctgttaaacaatattttaagtacactttaattacggttttaaggacagtaaaaatctatttacatttttaaacaatgaatactttttaaaaaattgtaattgaatgacccaggaactcagtcatgtagtcattggttcatcagatatttcagtgtcatctgtaaggcattaaacatttaggcatatcatctttgatgtgaagtacttagaagttaattagatgataaagatattttatccttttgaccttgatatgtttatagtaatttatttaacagtgtaagaaagagcttgaaatttgctttattagcatagttataatcttatttaatctgaaggatgtttcttaatttcatattcagaaacatatcctaatttatcatttaaacactgatataaaaatatgtctacttagtaacctattttttcttaaggtatttactatgcaggatctattacaactcattaaaatcaaccctacttccagtctctacaaatcactggtaagatggcttagtttctgtaatctactttggtttgttaattataactgaatagctgaataaaagtgaaatattttcttttaacaggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaaaaaaaaaaaaactaataacttttaggccaagtgtctttgtatactaggtatccctctcaagtataattggtagggtattagatgtattaatatttccttaaagaatgagagttgtgttcagtaatgtgttatatatcttttgttcttaaatgtttatacaggccgggcgtggtggctcatgcctgtaatcccagcactttgggaggctgaggcgggtggatcacctgaggtcgggagttcgagatcagcctgaccaacctggagaaaccccgtttctactaaaaatacaaaaaaattagctaggcgtagtggcgcatgcttgtaatcacagctactcaggaggctgaggcaggagaatcgcttgaacccggaaggcagaggttgcggtgagctgagatcacgccattgcactcctgcctgggcaacaagagcaaaactccgtctcaaaaaaaaaaaaaatgtttatatagacctaataaattgccttaattttggccttgataatagccattcatagagtccataactactgtgggtttcaggccattggttagacttgatgatgggctttgtagcatgaacataagctggcaacttggctttgatgcatagttattctttaggtcttttaaaataatctgttagtaatagtccttttgtgttggtacacccttggattttgtctgttgcctgcactatcatccccacaaggacattcatttattcatccattcattcgccaattcatttagaacttaatcatttgaatacttattttctgccagccattaagtctgtgacttaatcgccaagtctcttggtagtaatgttagcagaatataaataaattggagcacaagatattctggactgcccgcaaactagaccatctctactgaagttcagtatggtaaatgatcctatattctgtactctaagtgtcgtccagtgtgactctctgtgattatggaaatgtctgtgtctatgctgtttaatgtggtagctgctatcctcatgtggcttttgagccttgaaatgtggctagtgtgactggataactgaatttttaatttacatttaattagctacacttgcatagtgactaccatattagcataattctgaggtatatagctagtatcttttgcttaactattacttcaaaaggaaatttgtggcttgaagggatattaagaaataatctatgggccaggcacggtggctcatgcttgtaatcccagcactttgggagggcaaacctggctgatcacttgaggtcaggggttcaagaccagcctggccaacatggtgaaaccccatctctactaaaaatacaaaaattagccaggcgtggtggtgagtgcctgtaatcccagctacttgggaggctgaggcaggagaatcgcttgaaccagagaggcgaaggttgcggtgagccaagatagcgccactgcactccagcctgggtgacagagctggactccatctcaaaaaaaaaaaaaaaatctatgtagttactatagatacattatccttaaaagtagtttttccatggccgggcgcagtggctcacgcctgtaatcccagcactttgggaggctgaggcgggcggatcacgaggtcgggagagcaagaccatcctggccaacatggtgaaaccccgtctctactaaaatacaaaaaaaagttagccaggcctggtggcgtgcacctgtagtcccagctatttgggaggctgaggcaggggaatcgcttgaacccaggaggcagaggttacagtgagccaagatcacgccactgcgctccagcctagcgacagagcaagactccgtctcaaaaaaaaaaaaatagtttttacacagtctctttaaatgcatctggttcagaaagacatctggccgacagcccttaccagcttcacctagcatcccagtaaaatttctggaagccagaaaaactatgagtagcagataggtcaggcatcctagtgccaaaatttggatagaactcttagctaacaaaatagctcctggtaagataaaatttttttaaaaattggtgtcttctaattaagtaacagaaaacatgtaggaagatattgtgtacttaaccgttgtctgtcccctgactcagacctatggtcttatcctaccatatctatgctcagggggtgctaagctgttgaatggccttggtacttttcctcctagattctagtcacccattcttcccactgctaattttcctttcagagataatgatatctgttatgcgtgtctgtgtgaagagaccaccaaacaggctttgtgtgaggaacaaggctgtttattcacttgggtgcaagtgggttgagtccgaaaagagagtcagtgaagggagataggagaggggcagctttatagggcttgagtaggcagtggaaagttacagttaaaggtggttatttattgttagcaggggagggggtcccaaggtgcatggtggagagatcttgggactcattgtccagaagaagaatgtcacaaggtcgattgatcagttggggcagggcagaacaagtcataatggtggaatgtcgtaaggttggtcagtcagttaaggcaggagctgtttcacttctgtggttttttagctggctcctgcaggccatctggacgtatatatgcaggttacgggggttacaatggctgagcttcggctcagaggcctgacaatatccagaaaatgatgtgcacaaaatttggatgagggaagaaaatttggacatcggccctttgctttttggaagtaaaaattcttatctgcaattggcaaaagaataagacatatacatcaatggggacagaattaggaagtccagaaatacatccacacaaatatagtcaattgattttttttttaacaaaggtgcaaaggcaattcaatagaggaaagatagtcttttcaacaagtggtgctgtaacagttggatattcatatgcgcaaaaatgaacctagacacagatcttatttattataccttacacaaaaactaactcaaaatgaaccatagacctaaatgtaaaatgcaaaactataaaacttccagatgagaacagtagaaagtctgtgatcttgggtttcgtgatgagatgtaacaccaagagcaagatacatgaaagaaaaaagtagatcagttagactttattaaaattaaaaacatctctgtgaaagacactgttctttttgttttgtttttgagacggagtttcactctgccacccaggctggagtgcagtggcgtgacctcggctcactgcagcctctgcctcctgggttcaagtgattctcctgtctcagcctcctgagtagctggaactacaggcgcctgccaccacgcctggctaatttttttgtgttttcaatagagatggggttcaccatgttgatcaggctggtctcgatcccctgacctcaggtgatcgcctgcctcagcctcccagagtgctgggatgacaagcgtgagccactgtaccctgccaaaagacgctgttaagagaatgaaagacccagtgtcgaaacccatagagctttacgtcatcaagagtgaaccttaatgtttgcaaatttaggtcaggtgatcccaggatggtatgcagactgtgacaaaatctaatccccttcctgaagggagtgggggtgggggaaaaggtgctgagctaactactgtttttagttccaagaaactaaacatttcttaagtaatttatgcttgtggtttaaaacagtttcaaactattcagaaggatataaagtgaaagcaaagtagcagtttctgcccatgttctctaatctcacgctccactgataactagaattaacagtttcactccactgataactagaattaacagtttcttgtttatcttctagaattgtttgaggttaaaactatgtatttgtaattaaaacacaatcaattgggattatatcgtagatactgtatgcaatttgctttttttaatccaccaatgtatctttctgtagcagtatagactaattatttttaaataatgtatttaaccccctattgatggagatctggttgttttattgtttgctttttgccattacaggtaacctatgtgcagtgtgcaccctttgtgcccttgtgaaagtatacctgtgtaaattcatagaagtggaatgactagattaaagggcacatgcatttcgaatatatataagcactgacaaatttctcttccaagtgaatgagtatagctatatatccactcccttgccaacacttagcattatacaagttttaatcttagcagtgttatagggaaaataatggtttctctgttgtattaatttgcatttatgattttgttcatgtttattcagcatctaaaaattgtgttcatctttgacaatgtagttttttctgcaaactacccatgtttttccccatttttctgattttttttttttaaactgatttgtaagagttctttgatgttatgaaaatgtcatcactttagtcttggttatgcctccatattattgcaactatttttcccagtgtgttatttttttattttatgccatatgtaagttttcagtttttatgtagttagattgataaatatttctccttattccttccaggttctgtatcatgcttgggaaggccttttctcagatttattaaaagatatgactgggcacagtggctcatgcttgtgatcccagcactttgggaggcccaggcaggaggattgcttgaggccatgagtttgagactagcctgggcaacatagcaagaccctgtttatacaaaaagtaaaattagctgggcgtggtgggtggtggtgtgcacctctagtcccagctacttgggagactgatgtaggaggattgcttgagcccaggaggtcgaggccgcagtgagccatgattacaccactgcactccagcctgggtgacagagcaagacttttgtctctaaaaaaaaggaaagatatataatgtaaaaaatgataatgtcctaaaactaagattgtaaaaacagtgactgagcagtggttgaaagttctgaaacaaaactgtatgcatatgttttttaggttttcttatgcattttttaaaagaattggcagaatatcatcaagctaaagagagttgtaatatggaaactcagacaagttcgacatttaacagagattctctgggtaattatagccttctttcttaatttcagttctgctgttttcattttgaatgaaggaaattatctgatttaccatattgtgtgattgctccttgaactggagggatgcagccggcaggcaacaagggaattcatttctggaatcatcttgggggaccaggaagtgctctccagtgtcattccctagcctcatgaatgccagggctacactggccaaatcatgcagggattcaaaggcccatattcttccttgtttgttgagtttgacttctcttaactgggaggttcttcctcgtgtcttgtctaactttacagccacccagttagaagattataaactacttgctttgcaaagtactagagaagtcagtgacttatcacttcattttatagttgaggaaaccgaggtcctcagaggaagagcaacttggaaacactcagtctgcatcagaactaatagtggagtccaagttctcccatccatgatctggagctttttgtactatccagctggtctgcagtaccatcctgtctgtcagtttcgtgctcagtagagatgggaaatagctgtttaaaacgatatgcttaatggatttcttggcccttccttactcttaaatggtaacttgcaagaagataagttcataattcataaaatgtattatatgactatgcctttaagtgtatttttaattcaattagaaacatattacttgctaattatcaagcagtgctgttcagtggtgtgagccacatacataattttaaattttctagtagccacgttgaaaaaagtaaaaagaaacgggtgaaatttgttttaataatatatttaacccaatacatgcaaaatattatttcagcatatattcaatataaaaaatactaagatatttcacatttattttttgcactgtctttgaaatctcatgtgttttttacatttaaagcacatctcagttgagtctggtcacatttgaagtgtcaatggccccatgtggctggagagtcctgtgttggacagcatctggaaaatacagaaaagtagatggaaaaacatgtctaaagtcatccctaccagagataaacactatcgatgttttaatctacttctgccagcctttttcccctctgtgcatactttttgggtgggcgttatacacggttgagattgtactctgggttcagatttgcactttgctatgtggttgattctgatccatagttggtttgagggccatggactaagggaagagtcagtagacctcactttaatcctggttatgctgtcatgtagtcacttattaagctatatcagcatttgttctttatgtgtaaaggggaggggttgatatacgtgatctttgattcttttaaagttattgttttgaatatgtaagtcagctttaaccagagtccaataaagagctctctgccttagcacttagagagtaggaagagactccagtattttctgacttaaactgtactcttggctttctttttcctctaacatttcatgatgaacattttcaaacatacagaaaagttgaaacaattttagcgaacacttgtatacccaccacctagatgtcactattacacttgtgttatacttgcttcatcatttttatctgtccatccattcatccaccttcctttttttgtatttcaaagtaagttgcagataatccctacactttcccctaagtatcctctttacttttgaaccagaggtctggcgtcttacgcacctgacgatgtttctatgtcctaatttgatgtgttattttttaatagctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaaggtaagctttatcttgttactgtaaacaagagtgatgtttttgtttgtcttctaaagtcttaaccataggtatatgggaaaatatctagaacttttaataacgaatgggatactgtactgttgtgcaaatttttttttatttctggtgacatttgtttatgccttttgagtgaatcctacaaatagagtgaatgagataaaactaacatgaaataaatatatttggacagagcattaatgttaaacctagatgtagagagagaacttgttcctgtttttatagtataatagttggtatttttaattttttgtgatcaatttgcagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagaggtggtatttacaaatattttatgggtggctatttcctgcagctattagtaggttggctcgagatccagcaacaggatggtacagttgatggaacaaggccccagaagagcaatagggactggggccaagagtgcaaatagaaggatggtccttgaaaaggatacacaaatttgcttcctctgagactgatggaaaggcgagaactgtggaggtgaacaatcaagttgggattatgagaaacacaccctaaataagctccatctcctcaggcagattagagggttagatcttgggttttaggagcagattggaggtgcagagtagttcctgtgggtaagggaagaacagccctttaaagcagagaggactgatcacctgtattgagggctcagctgtggttgggggagcctggaattgagagaggtcaaaccaggtgcttgtaagtgagttttctgttctagttctggggaggatttgtaagtatctctctgtccctttcagtgagggtggaaagatggagatgcttgggaagtagagcttttcagagccttatttgactagagaaaggcagcctacttaatcgaagattctggggctctcttgggtagtgaagggaagcagaggagagggcaggtggctgctaacctagggggaaaggaagggttgagtggcagtctcagtgatcaaggactcgatctggatagactggtaggtggaagaatgaggatggtccaagattacagaattgcaggatgaggtttcaggtggagactagaaaccaaatgcagtatgctgccattggagagagccatggaaatgagcaagggtgaaggtccctggggtaaaggagtcaccacaagggtcatccatgtgaccatttgatcttgtcaccccagaaagtaactggacaggagacagagagggtgaggagtgagagggagtccatgttggcaagcaggattggatctactcctttaaatcatattcctttcccaagggcgtgtcttagaccaaactagatttacagcactatttccaacatacatccagaactactgctgtcagatgttgaaagtaggaatgcttccccctagtgtccactctcgcctggggcttctcaataagacctagttgtttaatgctaagggcaccccctctaaaattttgtatagcatttctgggaattgggtttgcttcagctataaaaatgaatgtcagaagcacatatctttgagatgattggattgtgtttagactaataacttcaaccttcaagataggtgactgactagatccctgtttatttatctgatcatctgaaggctttgaagaagattgtcatcctcataagaagcaccatgtctttattccctcacctggactgtccatccccttctctccctgataaaaaccatagtgtctttcaagacccagcttggatgtcacctgggtgatgccgtccctgactcccactgagcgacccatttaggcctcattcctgcatcagtctttatgtacttcagttacaaaatcatcacatcttagtgtgattgtttctcactccctgactaaattgtgaggtctttagagatgaggactatatctgtctacctttttatatccagttcccagtatgctgcttgacatgtcataggtagttagtaaattctttctctgtgaacacacaaatggaaggatggcccattcttttaggagttcatatgagcttgctaactctgagtcagaatgacccgtgaactgaaacattcagacgacaccaccactaaaaaccatggggattcaattcttttggagttttactgctgaatgtacattttgcttaatttttctttctggggaacttgccaaaatttaggtaagggcgccaggtgtggtggctcatgcttgtagtcccagcaccttgggaagccaaggcaggcatatcgcttgagtccagaagttcgacaccagcctgggcagcatggcaaaaccccatctctacaaaaatacaaaaaatcagccggacttggtggcgtgtgcctgtagtgcctgcagctactcggtaggctggggtgggaggaccccttgagcttgggaggtggaggttgcagtgagccaagatcaccccactgcactccagcctgtgtgacagagtgagaccctgtctcaaaaaaaaaaaaaaaaaaatttttttagataagggactgagagatgttaaagaactaaatagcataaatttcacatggcatgttaggactgtagggtaatggtagtttaacagtcattgggggagtaaatttttatgcaactagaatacgcaaaaagtataccttgagtcggaatctcttgaaggtgaaattgttatcctaaatgtctgtactttgctttttggaatgtaggaagcagtatattcattcaaatctgttttgctttcattagcttgcttgctaaaaattaatgcttttctatacagattgaaacaaaagaaatttatgctcaaaggcaacttttactaaaagatatggatttgctaagaggaagagaagcagagctgaagcaaagagttgaagcttttgaattgtaagtaatgcatgttcattttggatattcagaatgatgagattaaaaagaattactaaatatatatctaaatattctaatgttcattgccaagtagagttcttatttgtaaaggggatatcacctagaaggtacaaattaagaggaacaaacactagggttttgtttttgaaatattaaacattaagatgaaaagacgaatgagatgctatcatcaggctacagtaagaccagacagattatttggagaagctgttaatactggaacagatcgtatgttttgcagttacattcagtccctcagatctgatagttccgtgtgtgtatgtatagtaactgaattccatatatccaggcctgcagcttttaccagctgtgtgctcagaaaaggaagtatggtggtccaacttgacttgtacttggtgaaaccatttctttgttactcactgtttctaagtgctcacaaatgtttcatccttgagatcttacctgggattgatggcaagttcacctgtctatagtttgtgcaataagccttctcttcctttgggaatctgctattgacacccatagatactccaggaatcttagttcattaaagaatttggctccattaatgtttttttctcacttctataggcttgatttgtttgatttcaactctctgtctaccttactctctttttggcaataatgaaaaggtaaattgatcaagagagaggaaataggcacaaaattggggcagagagagttcatcattcctttacctccattttctctactcttgttccctccttctcagcatataaactaaataaatgtagtttacctctccatggctttccagattaccagcagagggagctaatacctagagcctttacctgttcttagactagtcagcattttgtagcacttctcaggatggctggatctcaccacccatgaacctacctccctggctaaggagttggtgctatggttgatttaaagtctcactatgaagaccattctattcttcagtatttggaagccctgattgatccatctatcttttgccctctcttttggtacttttttcaatattcaatcaatagggttttttgtttgttttgttttgtttttaagacacagtgtctctctgtattgcccaggctggtctcaaacacttgggctcaagcaatcctcctgcctcagccttctgaaaagctgggattataggtgcgggccaccacacttggctaaagctgattggttattaaatgacaaaaacacatattgtaccttgaatatgtatggactaattaattaaatcccacagttagaaacagcattatagaagatttaagcacataagtacacttatttgttactttgtaactaataatatcattatttcatcccaggattgattttggctatttatcacctataaccattgtttgagtgtttattttcagtgagaaaccacttccctcttgagactctcccactcccctcagcccaaagcacagtcaattctgctagtttcaatatgctgtaactaggtcagttcataaaatacactgaggacttctggctctttccttctacttcccagtagtgatatcatgtagcagttttagtctgtggaactagacacatgtgattttttcctaaatttgttagctcagctatggtagtttatttactttttatatttttgttaatttcaggaaccagaagctccaggaagaaaaacataaaagcataactgaggcacttaggagacaggagcagaatataaagagttttgaggagacctatgaccgaaagctcaagaatgaacttctaaagtaattgtttagcatttttaaataactaatatgtttaaattaaattggtagaaacataacaaaaactgacaaagtagtctgtaacttaggcaaactttagtgtttgaaaaaaaaaaaacatagttttatcgatacagtcaatcctttcctgcatttgagttaggatagtttttaaaagataagggccgggtgtggtggctcatgcctataatcccagcactctgggaggctgaggtgggcggatcacctgaggtcaggagtgcaagaccagcctagccaacatggtgaaaccccatctctactaaaaatacaaaaattagctgggtgtggtggtgggcacttgtaatcccagctactggggaggctgaggcaggagaatcacttgaacccgggaggcagacgttgcagtgaactgaagttgtgctactgcactctactagcctgcgtgacagtgacaatccatctcaaaaattaacaacaataaaaaaatacagagaagcacatcctctgcgcttcttatggcttctctaacgtttattgtgggctgtgatttgctttaattttcaggacaccttgtgacttgcttagcttgcatagttgataagctgtaaaattggaattataaccacttttagttatcttttcctctacctcactcatacagtcagaaggatggggttatctgacaatatataaattatactagtggtcatagtatttgtcagtgaacatgtgccttgtattccttcaagattcagcaaagccagaatcaaaagagctaaaattaactatgtgaggcaaaaagtgatatagggaaaggaaaatatggacaactatggtaactttggcttttctgtagtctgagttttgtgtatcagtgaataatatctcagtgctacgacattatgcccatgtggtaacatttctcttcagtgtgtgggaaagcatctggcacataaaaagtgctcagttaatatttgttgtaaatgtgtcacgaggaaatgattcaactcaggtgctctgggcatttcttatttggcctcttttattgcctttctcataatttgtcatcgatattccattacataatattgcaaaggtttcttgaggtaatcctttaaacaaatcctatttttaaaaaatatggcagcttttttatctattgattttgaaatgatgtattttacccacatcttctatgtcagtttctatactaaaatagctaaaatggaagtgtctgtagttgctgaatttttaggaataaatgaattaaagtatgtgtgttaattttacatagttatggagctagtgaactatttggtgtcattgtgacagcttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaatccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaaggtgatgtttggggggaaaataagctgtatttttcagttctgctgtaggttattagcttcccaagttgggtcttttctatattctaaaaaatacagcttacacttcattgttcatacaaaattacacattttttgtaattttaattttataaattaaaaatcatggtcttcactgccttttgaggaaccttcatgtttaatagtttgtatattcacaaaggccagtgatttatcatggatattttatccaactttatttcatatattttgataaatctgcaattgtcaggaacgtagcagcaacttattgctgtcaagtacgtattactcctaaccatgagagactttatttttcacttacggaaaacttttaacttctctgtcctctgtgacctagtttcttatttcttttgcttctaatatatttttatgctttataatatttttacttgatgtataaccttctgaactcttgtgtacattggcctgagactatggaagttgaataatttttcaatcttcagatgttttacatttcagtgtatttttttttttttttgagacggagtctcgctctgtcacctaggctggagtgcagtggtgcgatctcggctcactacaagctccacctcccaggttcacgccattcttccacctcagcctccccagtagctgggactacaggcacccaccaacacgcccggctaattttttgtatttttagtagaggcggggtctcagcgtgttagccaggatgatctcgatctcctgacctcgtgatccgcccgcctcggcctcccaaagtgctgggattacaggcgtgagccaccacgcccgacccatttcaatgtatttctaggaaattgctgtaacaagaagttgaagttttggtggaaatttcaagtagattcctgggaggaaaccagggttagatagttgatgttgaccagatacccaatgtgtggctactgtctttttttttttttttttttaagagacggagtcttgctctgttgcccaggctggagtacagtggcacaatctcagctcactgcaacctctgcctcctgggttcaagtgattcttgtgcctcagcctcccaagtagctgggactacaggtgtgcgccaccatgcctggctaatttttgtagagagagagtttcaccatgttggccaggctggtctcgaactcgtgacctcaggtggtccgcctgacttggcctcccaaagtgctgggattacaggcgtgagccactgtgcccagccccttttactatcttgtggagactaatacttcttttatgcattaataccattacgtatgtaacaaattatggtttgatgatatatctacatagacttgtgttagatgaagtgaaaactacaaaatagtaactacaatatagtaacagacagatctttgtcttcaaggaagttaagagctgtgggtattagggccctgtgctttgagcacatggtataactctggttagcatgtatagcaagtggaatttcaccacatatatgacagttacagcttcacatcacctgttgggtaacagggtttatttcttacttgcccgctacatctgctatttggattgtgaaatagtggtcattaggtctgacatactggccataaatattaaatggcttttgtattcactaggaaaacattatggtgtttaattggtgggctcttttttcagaaaaagctgttcatttgcaagaggagctcatagctattaattcaaaaaaggaggaactcaatcaatctgtaaatcgtgtgaaagaacttgaggtaattgttaagcatgttggtttttgaaatagattttaagcaatatatgaaattttagtcatacataatttatcctaagtcatcctgttgagatgtttggactgccatttatatggctaagaaggtgttagctgaagttaattcaatagttcttaatttcagtcagtgtcacataggaaagtgtagatagagctttgggtcctggagtcctgcccacatcctgtctgtgtctctaactgcttgtgtgtcgctaggtaagttctgtgactgcaggttcctgagctgtaaactaggatgttttccacattatagggttgttgagggaattcagtaagctaacttatgtgcctagttcatagcaggtggccattactattagtttctacatcagcctgttatctccttccatcagcagcaggtaaacaaaattcctgtcattacattgttatcttacagattaaaacaaaatgaggtacatttttcacatatcattgcttctttacttttctgttcattcgtgtgcttgctgtctgaaggatgaagctggaactttaggtacttacaacatattttgtatatgaaatttattttagcaactgtgacttatgtgagaactttgtaggctttttactcaaatatgagatatactaagaaaagggaagcacttcacaacattttacagaatcttttttcctttctttcccttttttttttttttttttttttgagacagagtcttgttctttcgcccaggctggagtgcagtggtgtgatcttggctcactgcaaccaacctccacctcccgggttcaagtgattctcatgtctcagctcccaagtagctgggatttcagccatgtgccaccacacccagctaattgttgtatttttagtagagatggggtttcaccatgttgcccagggtggtctcgaactcctgagctcaagcaatcctcttgcctcagcctcccaaagtgctgcgattacgggcgtgagccaccatgctcagccatttttatcttacctttcatatttaaaaaatatatattgctatgatgtgtgattattgttgggttcttggttgcctctggaaaatgggatgataatcttagaaggacttgcttcatgggatgcggcctataaaagttctgccccaactgtagggcggaagataattttcgttattgtagttagagtcttattgtagagaatcagacttctgtctagtgaccttaattaaattgtgacaccatgcttaaaggagcctgccagcttttacttttgcagtactgtaaagtcattattcaaatgtaaattttcctttttgaattttagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgtatgtatttttcttttcttctgacttgcgtgttttagtaattcgcattaggtcagtattataaaactatgctttgtacttgtataaggtagggggcttacattgggaagatttataaaattaagattcttggattaaactctgcaaacctgcctataggtggtatcaaagcttcccttgccctctgactgctgattgggtttggccagtggggacaccagcctctacatacagtggccctaggctggccactgtgcctcatggccaagtgaggccatagtgcctgcgattacctcttccaagtgctctgcaccaccaccctgtctctagtgctgagaatttctccctcctctgattccccaggcccaaggagcgctaacagtatggccctgttactagcccacccagggaactccaccatcctttgtgcataccctgaataagtcaacctttattaaagggttcttagatgaccttgaccgtgagagccatctgccttctgcctggatcccaactgctgctgtcagatgcccagatcatattggatcccagggctgtcatcaacaggtagaccagatagagagctccttctgtgcacagtagaggagagaaacaggctttcaggttaatttgagaatttgaaagagttcttttacttggagtaggactccaagggtaataaagtttgcattaacatgcactaaattcttttgttgtgaaatttgagagtcaggattgctctgagctcatttaatagaattattatcatatttattgagtcagtacaaagcaaagaacactttaaaacccctttaactgtttttgttaagttaaataagaaaacttaaggttggtaatgactaggattttttttttttttttaccttcttaggcctagctcagccggctcctgaacttgcagtctttcagaaagaactacggaaagccgaaaaggctatagtggttgagcatgaggagttcgaaagctgcaggcaagctctgcacaaacaactgcaagacgaagtgagtattgctcttcttcagttctagtgtgataccagtacacttcatagttacgtaaacttggcacaagtcacactagtgtaaatcagatttattttaacatcaaacattactcccccaaatatgctaaaggtatcctttctcatctgagaaaattctgcagtgataacgtgactttatattcgtaatagtaataaaatggagaagaaagcaaactcacctaaacataaaattttctgagtgcctgatggtgcccactgttatctctcgattctcaccctgataagtattacaaacattcactgtcttctgatttctgcctgcatgccctagagttctttgatatgactgaaaaagatggtgaagaacttgtttgtgtgttctgcttgtgtttttttttaatagggaccctgttgtttactgtcataaagcttcttggaattggcagaacaaaaagagtacaaacatgataagagaacttttccttttgaagcaagctgtgatttgttttacattgatttcttttcctattctgaatcttttcagattgagcattctgcacagctgaaggcccagattctaggttacaaagcttctgtaaagagtttaactactcaggttgccgatttaaaattgcaactgaagcaaactcagacaggttagagacgttttaacccataaatatttttgtatgtataaagcttctggtgtctgtgaaaatgtaatgatcataatttattgaatattaattattgttttaggggaaaagccatagaaatatgtgtcatcttagaagtaaaactccctatccattttggtaataccatctggatcatcagcaaaagtattttgcttcataggtgcctcatggcttgggagagtctcatgccccaataggaaaggcgtggtggtaacatagaagtccccatattcattataggatttccttttttatttgttaccccaatgttaacaccaattcagtagttttacggattccttgatagatatataaatatacaggacaagcagggtggtttagcaaaaagaatattgccttcagaatcagaactgttcttcttttggacccgttttgaagttgtttgaccttgggcatgttactttaacttccttgggcctcagtctcctcatttgtaatggggataataatacctactgagccatgatgaaaaagatgaaatgggtttcagtccagtgcctgggacataaaagacactcaggaaatggttattggtatcattttattattgtgtcttcactgtggatgcatctctgccccttcctacttcgtaagaaggatattaaagttcagatactttattcttcagttgctttcaagttcaaagaaagtacgtatgtgttaccagttcaactgggtctgagccttccttgttcccacctgcattgtttcctcatcagctccttgctctcttctaccagcacttgttttatttttatctctactcgtttctgcttttttctgttcctcattttctttcagttctgtttgtgaaacttctcacagctgaaatcatagcagtctcctatcaataaaaaatagttgaatgaggatagaactctttcgcatgcatgtgttgccgagggcaagcttctttcttgtagcatcacggggaggcattgcaggagagaggggcaggtgcactggctttgcattaggaaagcccagtagctcttagacttgctaaccgtgtgacccagcctcagtaagctttagtccccccatctgtaaaatgggagcagtgagagtttcttgaccacagtgttgttgtgaatgcaggtcctcacttccttatatgaaactcgggccatatgctgtggatttcgcaatagccctgggagttctgaacagcatcctatagtaaagcacattaattattttgcagtcaactgtatgaatattcatgctgggataaataaagattataaatgggtttacatcagttcaggtcaaacttttcaaccaaatgagttcaagtctggttgggctttgccaccaaataaattatgaataaattttcagttctcagagccttgtggctttcaaaattgtgcataatggattctgaaattatatcatgttacaaaagacatacaaagctgtagctggtacaataagctctcagtaaatgttagtggttatcgttaccatggcttcagaaactgtatagtgcaagtttgtccttattactctcttccatttttcaaaaaaataatattctcaagtatattttcttctctgccttgtccacttacttctgaaattggctttttgtaccctgcagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtaagccacccgcacaaagggttgcggggtgctctggagttgggtagccaccctgcccacgacacagggttgccgtgagggtcagcgggccagagtggcaaggtctagtgtttggcacacagagctgtttagagagtgatagttgccttgcctttgctgcctgttggtttcctgcattttattattgccactgcaatttaatttaggtgcttgaatcattagttttctggatcttatgcatcataattggctatttgtgaggataacagtttattttcaaactagtagagctctttagaaaccacgttggtatcttctccgtgcaattggtaatattcttgccttggttctttctgcaccttaggtctgggcagatcacacattgcttcccccagtccttgtcctgacagaatgcccctaccatcacccactgagtctaggcacagcctctccatccctcctgtctccagccctccggagcagaaagtggggtaagtataacgttctgattgattagcttcagctgaataatgttacttgctctgtcagccttcacttgttttactgggattttttttttttgagataattattatagatcatgtggcagtatagaatttgcaatcagattgcaaaatgatatgtcatctttgagaatcatctaaattacctggagggaaaaagattgcttttagcaaataagtggataatgcttatttgctaaacttgatatatggaccatgcaatctggtattaataagcatcttcctagttctgtgaatagatttggtttattaagataaaaaacaaatgtacaaaatctgaaagcaaacaaatggaggttatttataaagttggaacaattttacacatcattaaaaagtcatttttaaaatattttggcattgaaatataaacagataaggttctgacctgcatatcattgaaataaattcaaacgtggtagcaggctctggtgtatgattgttgaaacaggaaggagtggatgtttttagaaactagtccactgggtcagccaggctatgatttgagtcatgagcagactcctacccatacctgggccccacagcagagggaactgactccttagctccaggctcgatctcgggcatctgcatgttaatgtagttctctgccacatgggcctgtcgtagtcctaaagctttttttttttttttttttttttgtgataagccaaaaggaaggataagacacacacatatgctgagttagggcgctttgctcactcaaggttgtggtgttgcatcttcatctggttcatgctgatagtgtgcagaattttttttcagaaatgttttatggttatttcctaggaatagcattcagagtacaacattattctttattaacaactgtagtacctacttcacagcatgaaatagttacaaggagtaactgattaaacaggtattaattgctgagaacaatgcctagtggtggtggtgaggtggagctatttacaagacaaagagaaagggaattttgtagagccttttcttgagtcacaaaaggctttttgtcaccttgtactctttggttttccattattgaaacttcacgagttttatccttccaatctagtctttatcgaagacaaactgaacttcaagacaaaagtgaattttcagatgtggacaagctagcttttaaggataatgaggagtttgaatcatcttttgaatgtaagttcaaatataaataccagtttttatatgttgaaaatctagaaagcttagttttggtgaaacgtatccattggtttaaaaagaaaagcagttacaaattgggtcattattattttgtgatacaaccacaagtacagatgtatcacctcatttttctaccatgatgattttcatgtgtgtgtttactttttaaaaatttcagtatgactaataatttcagagtttgagctaagcttataaatgaattattaacttatcagattttaaataagtgatttttatttattttttcctttgatggaatacaagaatgtttatttttatttttttgagatggagtctctctctgttgcccaggctggagtacagtggtccgatcttggctcactgcaatctccctcctcctcccaggtccaagtgattcatctgcctcagcctcccgagtagctgggaccaaccacaggtgcatgccatcacacccagctagtttttttgtatttttagtagagatggggtttcaccatattggccaggctggtcttgagctcctgacctcaagtgatccgcctgcatcggcctcccaaaatgctgggataacaggcatgagccactgcgcccggcctaaggatgttattttttaaatatactgattcagttgattgcctcagatttagaaaacctcatttttagtaaaagaatagagataaaagaatattaagagtccagaaactggtgtcctggctatggccctgccttagactgtcttactttgtagccactttgtaagtgtaaaataagcatgtagagcctatcatctctaaggttctttccagcttgagaaatctttatatttgcatataagctattggttagccttgtaaacttcatcttcaaatctgaaagtgttaatattttgaacagttaaatgagagggcttggtaaattttgtaaatatttgttaaagtctttgtgttaaatcattgatattttaatagaattcaaatgatgatcagcaagccaattgaattcttcactgtcactgggttgattttcctgttgggtaacgaatctcattttgtaaacaaagttaattctttcaactacgagaacactctgacaagcaaatacgttgccaagtggttatgttgggaacttcatagaatcctgttaggaaagggcgcacccagttactttggcttcagttcccgtgctccagtcagttgcccccacactgcactgcccttctttgtcttggtgttattattaaggactcatgggacaattgtgcctcatgcagctgcagggaacatgccaaggcagttggaaatgggcgggctttctcctgccggggatatgtctcatgtggacgctgctgcagctgctgtgcccctctcatatcagcacccaagtaagttctttttttgaactaacagtcagcagggtcgcatactaaataccagtccgtgtgctctgtgaattatttcatgtatcactgaagtcatcttgtaggtgtaaattagtcaaaatcttgggttgggggttataggtgtcattatattgttaatgacatttctgaagtaattcccatgtgaacatgtaaagacagtgctgagaaaggacacgttggaaggaaaggcttctcatttaggcttcccaggccagttgcttaaaaagtgttttcatttactcttcagtgcctggcatagtagttggacttttccccaagactcttctgcaaaaactgttccttgggaaccttaaagtttgggaaatcacagtgaaaaattgaaataataattaactcccagcatatatctttaatatgattgtaacatttaaatattatttatttttctatctacttgtttcctttgtgtcttaagaaattaggacagaaaaacttcgtatttcaatctttggaaaagctgtgacaccgagttagcgtagcactggaggaaaactggccatcagacttctcttctctggcccacttcctctttttcctcttctcctccagattacccacttccctccctgcgggtggagggagacgggaagagagccgtgggagctttgtgctttgttccagggctcagccaacagccaggtccttttcttcttggaccaagtgtttaatcctcaaatctgaaaggaattttctcaagtaaagccacctcttagtccctcccaaacgttggaaaaacatcatacccaaaacccctgttagcagtttcttggttttagtcatggtacccaggaacatataaaataactgaaagaggcaagagattttgagagggttgatgttgctgattccagagtaaatctgctttggaaagcattcagtgagacatgatctagagccttgtctctgctgggcactttgctcagcgctgagcatatagctcaagccctcgccttcctggatttctagcaggggaggcagatggtcagcaggccatcacccaggaccgcagcagggaggggctgcagcagctgagtaggggccgtggccacaagagggagtgtctacaggcactcatttggcacagacctgagcgagggaatacaaataatgtgataggataagggaaatcaactgagtaactaggtgttctgctgctgagatggaacatagattataatatttgctttaaaaattattaagcagcatggcgagtgacattttagttattgagaaattgttatatttgtcatttcatctcttcatctgggcacaaagggaattcaaaaaggttgaaatttggtgtctcggaggtgccccgtggacatgcttccttcctttccccttgtgtccaagagatttctgtataccaccctgcagctacaaaatatacaccagagtagagaagcagctcactcttcctctttattttgtaattggtgcttaaacaacattcctattttgagattactattccatataagaaagcaatcttgtttaggagtaactattttttcttctctagcaaggaggaagttgcatttctgcctgtggaaatgatcagctgtctcctctggtattttaatttcatgagaaggattcagaagagatgggggagagagagaagaaactgtgttgcttctctcctattagtaaaactcagttcctgctgatcactttagaacaaggcacagcaaaaaggttcaaagtcctctgctgaacctatgaatttttctacttattagcattgcttgggttgaaaaaaaaaatgtaggttatgggtcagagccagaagagaaaggtcagcataattgtctctgggattggggtctaattaaaacttttgagatatagggacctgtgccaagatgcagagggaacagacaagtaattaaagtatggaccttgcctggaaggaatagaagtggaagaaacaagtacatgtagtttttgacagatcaggtacaagatatcctgcaagtgagatgctggagtggttagttgtcacttcaggaataaggaggaggtggcatttcagttgggtcttgaatagcatttcagactttgtgagagcaagggagtgctacaggctgaggagacagtgaaggtgaatgtcaagcaaggaagatagagccacggccaggccccagtgagtgggttggtacagatgaaatatttctcgtacaaagttggtggtgatgtaggaaatcaatctgggaagaaaagggcaggttgtcagagcccagactaccatggcgtaggactcttatcagagcggagatgctgcacagcagatccacatcttcccctcaggaaatgcctggtgcagatgaccacaggttgttggaaggcagagactggcttcaggaagagccttgactgggctgtttcagtagtccagggagatggtgagaagggcccctgttgcagccacaggacagggagtgtgaacctgcaaacactggtggctgagtggatagagggtagaaagagcatgatcgaaggaccgggatgatcatgcctgggacgaagctagtgctgtggggtttccacatgcggatggcaaggaactatcagaaatgtggacgcgaggctagggagagagaccaggagtagaggaaaagatagggaaaggatccatatacaagtgatggctaaaaccccaggaagggctgccgtcagtttggaggaagtggggaatgaacagtgagatggctggaatggcggggggagggcagtggtgtgatttctgttctgttttgttggggtaggacagacttgagcatctttatgggagtaagacttctaaaactactgtgtacagaaatagggattaatggctcagtctgggtcctaaagataggggagggattataatcaaaggcagaggcagaaatgcagggtttgccttggaaaggagggaggagatctgtgaagaggatgagaacatgtgacatggaaggaggacagttggagttggttatggtgagggtgacgtatttgtctcagtcaagtgaagtagggtacagttcaaggagtggggtcgggagcttgaagtcggtgaaaatgaaatagtgacttgaagcaggtcacagagtcaactaaaagccaagcagagtctccgtgggtcttggcaagggctcctgcagactggtcctgcattcatttgaataatctgatactggaagctactctttattttctgtcctattaggtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaagggtaataagtatgacttgattctctgaactggttgctccattgtacacctttcgtaagtacattgagctcagggaggggagtcaattggtgtacaaagtcagaggtgcggcagatgccttaaaaggcatccctgtcctctccttgtcttaaaagcagtgggaaaggctgcacagaatgtgaagcttaggagttttgtagtaaaggatagtttttgaaggtaatttttgtacattctcatctgatccttaaaacaagcctgtaaaaaaggtagactgtgctttgctgcagaactttgctttgaaaacagggtttaaagaagagactgtcagtgccagctagctgggactagaacccaagggaggagtggctgccagttcacagttgcttccaggggcacacactccctccctccttcctctatttctcttcttgccttctgtgtcccaattctagtcctagcagatggattactctgtccacttaacacacctgctaagtcttgcttgaattactctaacatatgaatgttccttggactcttggttaattcaagtccaaagcacaggacacttgccaattaataccttccttcattgagatgacatatttgtcttcctttgatgatagcaatgacttcaattttaaaaattagtcctctggcatacaggctgtacttgaaggatcgggattaatattagtgcatttttaaaacacttaaaagttttacaaatgtatttgtgtattttctgttttggtgcctgttttatagaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataaggtgccagtgccatgggcagggcaatctgtgggtgggggacatccagggcttccgtggcttaacttcttgggacgggaatccgtcttctccattgaagacaaaaaggtgaaaagtatagaaaatccaaagttcaaatggaaccttgagtcttttaaatatactattcttttgacaaaaattcatagcttttttgcttaaggtaaaagatttaagagattttaatttgtaaaagttggggtggctcattaagaaagaaaagatctatcaaatgcattaatactgacattaatattttatgtaagtctgaagtattatgggtgttaaatgcataccctatagtttattttgatgtgcttgctaaatttcatgtttaaaagtcacctcttttttagacttttaaattacatatatatttcaaaaatggttcttaaagtatttcatgaaattaatgcatatctaatttcaaaattttccaccctctccatgtaatcagagctcaaaaaagatggtccaagaaggctccctagtggacacgctgcaatctagtgacaaagtcgaaaggtacctgttttccctacacactttcatacacaaactgttaattgcttattttgtcagccaagagaaacagatgtttgagattgcctgtaagaagttattgaatcagtcaaaattagtgactataaaaacaattgagttttttgacttgtgaaattgatcctgatataaattgtaaactagggcagaaaccccccagggaaggaattgagaacattatgaagatagcaaataaacttgacacaaatttttacattttaatttttatctttccctaatttagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtca

SEQ ID NO: 5490 - DNA, 167182 bp, human; identical to SEQ ID NO: 3065

SEQ ID NO: 5491 - DNA, 167182 bp, human; identical to SEQ ID NO: 3065

SEQ ID NO: 5492 - DNA, 164078 bp, human; identical to SEQ ID NO: 3063

SEQ ID NO: 5493 - DNA, 164078 bp, human; identical to SEQ ID NO: 3063

SEQ ID NO: 5494 - DNA, 109204 bp, human; identical to SEQ ID NO: 3062

SEQ ID NO: 5495 - DNA, 109704 bp, human; identical to SEQ ID NO: 3064

SEQ ID NO: 5496 - DNA, 21613 bp, human
agtcgccccggcaacagccgcctccctcgcgtcccccactccccctctgtctctccaaggaaaactaggcccctgcgcggccaacgcccaggatccgcaagctgcgcgcccacgaggtgacttcggggacggctgggtttcctttggggagtgagggaggagcttagacgccccgggccctggcttcttctgatgcgcagagagccgaggtcttggacgtcacgttgctctcataattatcttaatcccgcgacaaaaggtggggccggaggcccatgagattcctaaatcattgcaggttaattgtgagaggggaccagtcccagaggctctcagctctgcagtgcttccgaatcactggacgactctttaagaattctgatccccgggcccccatcccggaccaatgaaatcagaatctctaatagtggggccctggcatcggtagtttttaaagctgcccaggtgattctggggtgccgagaaccaccgtgttaaggtctgtaggtgaattcggattttgcccatccagtccagtatctgaatagaagatcgcccaggacagccacatacttgaaggatgtctaggatattgccctctctgctcaaaaattcgggtttctttcttttctcttgcactttaacctctgcaggaggtcagcttttggtgggagttatcttgagacatctggcgcctacagtttatgggccttgtgtctctgcccacttatcagtaatgagctgtaattgaaccagtggccaacgaagtgcattttagctctgaaatcttgatgttcccttagtacagatcagatggttctgaacaattttatttttttcaggaatgatgtttttaaactcgtttgacaggctaggctgtgtattcagctgttcttcatctcaaatcagaacaatattacttaaaaaatctagactaaagattagtaacgcaacacttctaggattatttatgctcacagcccccatgaattgtaggatgagagctaccctttaaaaatactatttttgctagcataatttatcggaataacagtctctttgtaatttcaatgtgaacagaaaccatatatttttaaagactgctggttagtaacttggaataagcataactgaaagcaagttcacaggtgtataaatcccctctgtgtgttcattgctgtgctggggaagtatacaaactaaagttccagagagaaatgttcattctgaaactgttctatagatggtgattaatcattttgggtttttttttaaaggatagggtgagatgagaatgacgggggaaagttttgaacagttaaggctagagtgtaaattggagagtttgcaaagtaggtacagaactttttttgaacaacttctctacaagaggaaattcagccacggaacagctggacaagtgaaaaaagaatgtagttgatcaaatatcagatgaattgaaaagatctttgaaaacataatgtatttaaatatttgcttcctgaaaagatttggtgctttatagtcagttttttgagttactaggtcctcagagattttggggagtagatgcaggaggagagaacgttatcaggaaacaacagacaagctcaacaatttcagcagcatctaagagcatgaaatattagctattatttttatgctggaaggaaaataggaaacttaaaaggagtagattgtagaatccatgcctacaggtaactgagtaagtgcccaagtaaatgaggcatagtgagtgcctataaattcagaaaagagagattaacatggaattaccgtgaatatgtttatagaaaaaagtaaatttgaaataagacgcctgaaatgtactagcgatcttaactactttaaactagccatggtttttgctgttatgctcttaatttgcagaacctgcctattcaacccttattaccttatggtcacactaggttttgcttatgaaggacatgcttgctgtgaaacaaacttatctgtttcctcttttgaactatgttatcattatgtcattctcagtcatcccattgcttgttgtgttcctgagtcagagggtaactttgttcctggcctcatatttcacttttgattctgatattagtcacaaggggattcagagaacttgcaaataaacccattcacaaattcatcacacttgctgacaaattaaacaatgcccttctgtgggtggaatgtcatttgtatgaaaaaaagaattgttaactgcatcctttcagccttactccttccccatgctatgccttctttgtgacagtacttattacaacatccagaagagggtaaattggggttggggattgagggaatgaaaagaaaataaaactcagttttttggctcccttgcctatcagttttaactgtagctattatagacggggagatgcaggctttctgaacacagtggcatgtgcacttgagtaggcctgtgtcctgcccaagatggagcttggatgtctgcaggtggaagaaggccatttggacttgagccatctttgatgtccaaatcactaagcagggaccatgcaaagacacaggagggaggccatgagggcatcaagccagatgagcttgccagcctcagcaaccagccagggatgggggcagggctgcccaagtaggtggggcaggaagcccagccctcaacaaaaccctattatattctttgtcttagtgaggaagttcttactgttgtgtgtattattggaagacatcttctgtgatagggttattattgcatgtacagagagattccttggaaccgcatatgactcaatctatctcactcagatttctcaccataccttcacttattttgctgcagtgtccagcagatctccttgaaacagtgtgtactgaagacctaactaaatcctccaaattacctggttggttcagagaaccaaatcactggagctttgtagggaaggtttgactttcagggctttagccagagtaacttatttaatgattggcttttaatgtgtttctgtgcaaagatcaaagcaggtgaattttcatgtatttttagaattctagtagaaaaggaagataggaaaatctagttcaagtatacattctagtttttaggggaatttgtgtttttattttacttttttggttgctacgatttgtcctatattctatatttataagaacataaatatgtaattaaaagaatatatttgatggcactacctgtcaacaaagccacttatttgtgaaattttttggtaacttgatggaaatagtcacattttatccattgaaaactacaaagctcttatctattgttctttgtgtatatttatgcattaaaaatagatcctgcaggatgagcagatgtactgaagtgtaaatccgttttttaagagaggctatatggaaaaatatatcattcaagactcagtctctgccttgcctataggcctcgtcagtgtttagtgaatgacctcaaccctgtttttttccttccttctttggtggttgaggacagacaatgaatggtctctgtactcgcctgggctcagctgggtggtggccattatgccattgtgctcactggagagggctgccgggtttgtagagctgcggatcccggccttccctgacattgccaatctcttttctttcagctccaccagcccattggagaaaagttactgttcagtccctgaaggcttgtgccataaaagagtgggagacattcccagggaggtgaggaatgaaagatcgaattaaagaccattaaagaccaaagggcatctaaatctgcagcaaccatcagctctcttttctttgagaggtagtagtctctgaaggtgttgctgtaatgtctataattatttagatgttggcttttcagaaacccaggcattcttattagctccttaagttctccatgcgtgaagaaaataaccagcttaaaaaagctaatcggacctatctctagaagaggacctcttcttcccttgggagctaactgatattaactgactaactgattgcttagcaggaaagaatatatattctttccagggaatagagattcagagctctgtcctgtttgctttctaagccctgctgattgatatggttttgcagaatttttattgttatttttagttaagtctttaaatgtttatatggatatttaagaaaagatccaatttccttatttagtcatggagagtgtttttttgtcccacatattagcaaccggtcaacatgattgctattggtcatagtcagttttcttgcctccactagtctttctccaaacctaatcatttatgaaacgtgtgagaatcgtgaagttcgtctactgattcccaagtggaaactgaggaacaattaggatgctcagtatattcagagagaatctatacaacttcaaaatgtgttaacatgaaacaggggtgggcaaaataaaagcccacagcctgttttttgtacttcaggaagctaagaattgtttttacatttttaaagggttgtttggtgtgtgttttttttttttttaaagcaaagaacgtgaagactatgcgacaaagactgtatgtggcccacaagcctaaaatatttatctcgccctttactgaaaaaaaattgctggcataaagtaataatactggaaagacctagctaaaaataattataaagctctatgcaagttgctattcctttaaacatgtttttctatgccttatttgacttttgagagacgaatgtgtaattcttcaagtcaattattcaaattggttaatttgaatataggattttaggaatcttaaaaagacttaaaatgtaaaaggctattacaagtacaagtacattttgggatttagggagagaaaataataaagccaagagtgagatgagcacagtctacatacagcctcaggactttaaacttgatggaagatggcagcaagtttgattataaatgtcccagtggtcaaaactgtgaggaaagcataatcaaagcaaagcaaaattgcctacagagtttcttgcactccatcattaacataaattcatcctttcataatgtcctgggtcttaagagtctagcaccttagctgatgaattaatatatttaattaatgtagatagtgggcactctgggcttattctgaactgcctctggttcagaagctggaactggctttcttcagtcatctcaaatgattctcttggcttctttcttgcataagtgctcaggatgtacctgggtgatctctgaggccttctaacatagcagcccttctaccagatgatttgttggatcaaagttacctctcctcaaactagtgctccctccctcttctttttttttttgtttttgtttttgtttttgagactgagtctcactctgtcactcaggctggagtgcagtggcacgatctcagctcactgcaacctccacttcctgggttcaagcaattcttgtgcctcagcctcccaagtagctgggattacagatgtgcgccaccagacccagctaatttttgtatttttagtagacatggggtttcaccatgttggccaggctggtcttgaactcctgacctcgggtgatccacccacctcggcctcccaaagtgctgggattataggcgtgagccacagtgtctggcccctccctctaaatcacagccattgacatttgagcagcctggagaacatcatcaattacccttgaactccttaaaatggtagtctactttatctcacatgcctaaacttccagctttgcaaaatggagcctctcttagccatctggtggattttcagaatattggtgctacaacctttaataccacactggattttcccaattataactaaaaacaagattttgtctatagtagtgtttgatctcaatggtgtttattccatatttgaggctatcacacttcccagtttggaataattgatattttagttgacctggttctaaatgccttatgatgcgtagaaagaagtctggattcaaaacacttaatttccagaacacatgcagatgtctcctagacttttctaatttaattcctgtgctgcttgttaatctataaaacaaatttgattaagatacacatgcagtttgcgttaatgtcattatgtgctgcaggctctcagaaaattattcagattttagtgataaaaatataaaacctgggccgggcacggtggctcacgcctgtaatcccagcactttgggaggccgaggcgggcggatcatgaggtcaggagtttcgaccagcctggccaacatagtgaaaccccatctctactaaaaatacaaaaattagccaggcatggtgccacgcgcctgtaatcccagctactcgggaggctgaggcaggagaatcgcttgaacctgggaggcggaggttgcagggagcagagatcatgccattgcactccagcctgggtgacagtgtgagacttcgtctcaaaaaaaaaaaaaaaggaatataaaacctggttctagtgaattagccacttaaaggctgcaccttacagttttgctcttaagtacatactaatttctacataatttcaagtatgttttatttctctgagtggtaagccacctaagtattaacttttatatttcttcagtggcccggaaagcacatagcagttagctaggttttcaggtacttgttcatgttttaaacctttaaaacattaaaattatagattaatgtgaacttaatttacactgcatttgttaactttttcagtttatattcgttgcatgtatgcatagtattgaatttaagacaaggaacaggaactatgggctatgtttaagataaatttacagaaggttatgtcagccctcttagaaataccctatttgaaagtttattatattcaaaaagaatgtgaatgattctctttcagctaaatcttaaaatatagaagtggttgatttagcatctcagttcttaatataaccatagcaaaacatctgatagagattataaaacaagtaaagtttgtttcttaagggttggggaatgttttaattctaccctatagttaagtgaaaaggaaaaataagactgctttggtatctgatttccaaagtttcaaaacctaagtagttgtttgctcagcattacattgtgttagtggttttgtctcacagaaacttaaattatcatgcatttttggatatttttgtttaactttttaaaagtacattctggtgtagctctgaacctctgaatagaaaaaaaaaaagtctattttaaatagattgaaaaagctacagctgcagattagccattacttttgggtatttcatgcatcgaatcagcaaatcacaacaggtgggtagagagaaaaggagtaaatctcagcagagcaatgctatttgccagaggcagtctatctggtgcctcagtagagactccatggagtgtttttttctcctgtgaagagacagggtggttaggcaaggagagtgtgatgtcacatgctggctgagaaatgcatattgcaatcaaaatgaaaacaaagcccatttggggaacttaaagcccagggcacaactgaggctggagagatgtcttattctccaagtcccaaacctaaggcaagacccaacagaggtttctggtcatttggaaagatgtgttcccctcaagcctcaggaagacccagggttaatttaagtaagcattagcatgagttaaggattagtaaataaagtaataactataaatttttagttcatgttttgtatattgtgtgtgtgtgtatatatatatacacacacacacatatatatacacattatatatacatgtgtatatatacatgtgtatacatacatatatgtgtatatatacattatatatacacacatatatatgtgtatacatacatatacatatatatgtgtgtatacattatacattatacatatacattatctgggacttggagaataagacatctctccagcctcagtatatatatcagtatatatatactatatatatatatatatatatatatatatacacacacattaactactaaatatttatatggtcattttcatagactttacttcctatagggaaataagtaattgaaccatgcaggatcttttgacccacttaatcaaacctaagtggatccctccttttcagaccacaaagttatagcccaggaaccaacgtcatatagataggttgcatgaaatcaggcatggtcctgggaagaggcagttccttgggagctgcctcacaaaccatagaatagccacaaatatcacacagccatactgatcagacgtttgcactgtgattcttctttcctagtttcagcacccatttggactttcacaatcagagatggcagcggtaaaggtaagatttttatttttttattttttttttgagctcgtaagtaaaaaaggtaaactttagtctttttttttatactttaagttttagggtacatgcgcacaacgggcaggttagttacatatgtatacatgtgccatgttggtgtgctgcacccattaactcgtcatttaacattaggtatatctcctaatgctatccctcccccctccccccaccccacaacagtccctggtgtgtgatgttccccttcctgtgtccatgtgttctcattgttcaattcccacctgtgagtgagaacatgcggagtttggttttttgtccttgcgatagtttgctggtaaattttagtctttaaagtttggtattctcattgcacgatggagaagacctaagaaatacaaaagtaaaagcactattgggtgcattcctagacatctcttaccccaggcatttaggggtggctcaggccagcaagttagtttagggggcagaaagggaaaaactaaagtctgtcatgcttgtcagtctagtgtggttcttagcaggccgttgctcagttggcagtagtcatttaattacagtgggtagagagggctaaggtgataaacatccagtcttctctctccctgcgtctcatctagaaacgatcactagccttcatccccacattataatgctccatagctttaattggctggcttgtgcataccttatgtacatggacttagcaagtgtgcatacacttggtgtccactgtgggcctggacctatctcacacaatattttgggcccagtagcctcctcatgtaggtaggtatttagcaaatactaagtaaatacctgttgggtagcagattaaacatttgaagatttctcttgaggataataaacactttggtgtccaccctccacctcctttcattttgtaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacgtaagttcaggcctctgtctcttcatgcttcctttccttgccctgccttttacattttttttctctaatatataaagtaattttataattcttcattggctagggtaatattccaaatccagtcctaagcctggaaaagctatggggatgctgtaccttgcttatgttagtttctggagttgttttagtataagacatttttttgttccagaacaaagcttatcctaatagtagttctactatttattaaccattagacactctaccaaatggagtgtgtatgcatgcatgcttgtgtgtgtgcgtgctctgatctacacagcagtccctcagagtattaaactcattttatatatgaggaaagtgaaccttaaaaaggttaattgacttgttccgtggtacacaactagtaatttgctgttaggatccaaaccaaatctgcctacctctacttcctgtactgctttctgtatactaggacttgtccctgagactgctaggttcctaaaatacttttgccattcctctgggacacatcttggagatgtccttggtgctagaggtcccaaatcttaaatagcatgaacctaaacagagtaacgaaatgcctggcacttacaactttcctgttggttctgcattgaggccctgtccatggggtcagagaattatgataaaggtcttatatcttcagtcaaaaacaggaattttctttttaaatttcttaccaccttactagaaagaactagaacagcttttgtgctctcctattaaaattcaccagaccatttctaagtacctctaactgagatacaaatgcttctttccctattataaccagtattcattctcaattttgttttaagtgaggcctaattgtatgacattttacctacaattttccaatgacacagaagcgtagaaacctgggaatgggagtttcattcctgtctgtcattgtcagcattttcctaatgatgaattagcttttattgatccccactggatgccaagaactgagcactgggctttgtataaaatattatatcctttagtatcttcgtccgtgattcttcactaaactacttgttcagatttttttgacttcctttcttttgtttaaactgtgtacttctttaagcatattagaaagtatatccagccaggtgtggtggctcacacctgtagtcccagcaactcgggaggatggcttgagcccaggagtttgaggctgcagtgagccacgatcacaccactgtactccagcctgggtgacagagcgagaccctggctcaaaaaaaaaaaaaaaaagaaaagaaaagaaagaaaagaaaaagaaaagaaagaaagaagtatatccaaacaaatacttttaagacagtactttctattacacacagaatacttttgcttgatctccagaaataaattttaccctttttaaaaatatagatacgaaacaaccattagtctaatatatacaacaaatgagaagcattggagcatgtccatgtttgggttggaatgctgtttgttacagcttttgacagagaaaatgggatggagatcgagtttattactcttgtccttaccagaaagtagaataacatgttttgcccactagaggttgatacttttatgatggaaattgtaattatggatggaagcaaatcccagtcatctcaaaggtgactttgaattatctgctggtttaaaataaacttgagttagtcaataaaaagtggatatgaataaaataaagataaaacaatgaaatgtgtccttgcaccaaagaaaaaatgtgaacggttcagttacagatattgttaacaaccatccctattcctccctcttgccattgttaggtagaactctaggtaggtaaacaaaatcatgaaaattacctgctaagtcatacttgccacttaatattattttgagtgaataaatgaagtctttcagtgtgaattagaagccttaaatcagaggttggcaaatcttacccatagagtgctacacttgcagtgattctgtgggacattttacagaatgagctaggccttgtgtgcattataaacttgataagcttcatctctgtgtttcatattatttccaaatctgtctagttactttacggctccaaattgcactttcatcatctgggttgaattgtatctccccaagaaagatacagtggaatcctaacccccagttcctcagaatgtgaccttatttaaagacagggtctttccagaggtaattgaggttaagtgaggtcattacagggatcctaatcctatgtgactcaggtccttataaaaagggcaaaatccggacacagagacagacacacatgcagtgaaaacaccatgtgaagattgacattatgtcgccacaatccaaggaacatccagaaggtgggagaggcctggaacagatccttccctagcacctttagagggtttatggccctgccaacacctcgattgcagacttctgacctccagagccatgagacaatacatttctgttgttttaaaccacccagtatatggtactttgttatggcagccctaggaaaggagtacaatcaccctgggagaattttctttgtccccaaatgcaatctgtgactgggacataaagtaaacccacagttcttgtcatctgtctgaaaaaactgtattacttatttgttttactgtgatctagatagcaaaccatcataaaagggaattttatgaaaacccttgcaacttccatcttgaacctcattttccagtattcatattattgctggcaacagtgtatggaggcagctgtggcagaactgcttgaatcacagaggtccagcctcactctaccactcgctgattagaggttctcgtcctcctgtaagccccctgccttcaccattctttgcctcagttgcctcacctatgaaataggatcctaattagtgggtagtaattatgaagaatccctaatgggtagtaattgtgaagaatccatgagataatatgagaaaagttatagaatggtgcttggtaccaagttggtgcccaataaatgttattgttacagttagttgctagtaacccatcctttaacatggattattaaccataaattggtttttctctgataccgtttgccttgattagtgcttgattgagattctgtacatatatatatatatatatatatatatttttttttttttttttttttttgagacagattcttactctgtcacccaggctagagtacagtggcgccatctcagctcactacaacctatgcctcccgggttcaagtgattctcctgcctcggcctcccaagtagctgggatttcaggcgccaaccaccacacccagctaatttttttattagtagtagagatggtgtttcaccatgttgtccagagtggtcttgaactcctgacctcaggtgatccacctgcctcggcctcccaaagtgctggattataggcatgagctaccgcgcccagctaagattctgcatatttttaataagatgttctgtgacttcagaaaggtcatatttctgctctgggtggcacctttcaaacttttaaactgatttagaatattaaagacatgaaagaatgaaagttttggtgtctatcaaatttagcaattaacacagtttttagttctgtttcaaggatattcttgcttgataaaatttaatgcagtaaagtacatggactgggaaaattaacccacttcaatattactaataatgtccctaaacaagctttcaattctttgtatttttaaaatgtgtagttacagcatgattcaaaactacttttcttagcgtctgtgtcatgctcctacagccttccctgaatgcattagctggtcccagggagatgtgagaattgtctggtgagggtgagaacagactgtggtgtcagactggaatctaaagacttcgtctatattagaagcagctgccagggcccgatcttgcaccagtaagaaaataatgggcaatagatcactagcattatttttttcagcagcacttttggtgagtacaggatgaacaactgttcttcaagcggtaatgaatgatggaattcatatgtaagtaatctgagtgcccatggcgctttccaattcattaccttcaccagaaattttcatggagggttagttacatacactgttggaaaaagctttaataaagagataagggacctgggtagtatgaataattggttcaagttttttgtttcattttgctctcaaaaccactagaagctacttattcaataaggacattttcagctttgaacatgaatgctttgaagaacacaggattttagaaaatgttactagcaagaggaaatgtcactaaatttgaaagatttaacttttcagtattattcacttccacaggaacatacaagttatgcaattcatcatcgcctgagtcttgtttaatattttcttaggataaaggccttcagattggacagtatgttcttttttgtgattgctactcagattccagatagtctctactttaacatatttcaaggataaaaaacaccaaaagcttgactaggataagaactccttttgtacagtgggaacatgcatgcttttgattatgtctgtcatcatttcctaacaagatatttccgttacttaaagcttcaatggaaaataacttatgagaaagtttacagttatgaagttttaaaggtcagctgtgttttcaattatttcttaggaaaaatgtttattattaggttaagaaaaataccattttgtagtcataagtgaccactggtcgagactgcaaggttatattgctaatacttagagggaaaatgagtggaagtcaccctcaaaagagagtaaggccctctgaaacaaacaccaccactgttttctcgggtttgagccaatcaggtatttatgacctatgttttgagggtgttggctcaaaacagggacatattctaaaagcttaaaccccattgggaagaggagacaaaatgaaatgtaaagtgacacatagaagaagagtgtctatggtgtggttcatggttatacatgcacatgaggggtagagccagtgacccaggcagtcaaaggaggagcaccgcggggcagctgtcaagaagtaaggtatgcactaggccaatttgagggatagggtcaatttggaatgagagaaaaaaggacttagttcactcccggcttagacactcaaagtgctgttcttaccagagagcccagatgtggttttcatatgcccagatgtggttttcatacgtttgaggggagacatctgctccattacactgtgtccatctgagtgggaaggctgagactgtagttttcatagtgagcctttagtcagtcaaacctagagagaacccggtgaagtttatggcccagtatttagtgagctgtcttgctttagtcaatgaggttgaaggatgaaattgcagtgattgagcacaatcctgacatgcgtgtgtgtttcatctggtgcagatattcacaggtgcacaaaaccgatcagtgagatgatacgtgttaatggctgtagaaaagtggaaaggaacatgaaaatgcacttctgttgtaaaagtaaaaatggcggttgtccagtaacttcaggattacatttgtcatggggcaagggatgtgcgacgaagagagaagaccagtctgaaatggctccagttctgctggcatgtacctgtgttctgggtggttgctgacaagccagaaatgaggcattcatggcatacatcaagtttgtgctttccctcggttgtgctacaattattcattttggcaaaatagcagaaaatataatcagaaagatgtactagtcctaggaaagtgaggggaaaaaacattctttgccacttgctgcctccatgctttatcctctaacatgttctgcctttgggctctatgtgtggaataatcttggatgaaagttttcctgctatataagattctctgaagtcctggtaactttccatgattttttttttcctttatggactattacgtgatgtgacattggtcacatcatgtagacaaatagattgatgtgaaaaataccaggattatgtatcctgaacccagatggaatccagtaaagcttttccttaataatacatgcctattgttcttgttttaacctatatgcatattaacccttgtattagcctcccagggctgctgtaacaaattacacaacctgggtggattaaaaaaaaaaaaaaaacagatttattctctcacagttctcaaatcaagcggtcaacaggaccacacgccctctgaaggctgtagggcctcacctcttccaacttctggtgtttcctggtgttccttggcttgtggcagcatcattccatctctgcctccatcttcatgtggcctttcccctgtgtctgtgtgtccttttctgtctcatacaaggactttgtcattggagttagggtccaccctaatccagtatgatctcatcttgatcctttaattacatctacaaagccctatttccaaataaggtcaccttctgtggttccaggtggacatggatttgaagtgacactattcaacccactacaatcctattttgaagctggaatagaatcaaaaaagatttctgattcatattaaaacaaattatcttgccaaaataccctataaaagtgtatggcaacattgagtcctacagctgtttccaataaaaatgaccaaaccctccatgacaaggcaactgttcattggcatctgaagtgtgatgtccgtactggtctgctttggtcagatgattttccatctggctggctgagcgctcaccttgttttgacagcaaggaaaactgccagtgattgagaatccgttttcgttggaaggaaggaaggaagcaataaatagaaaacagaatgagtggatgccttcaaactctgatactccattctgaggtttacttggtcccctaagtcagtacacgctaaagtactttcacatgctggctgtgaccatcagtgcacagcctgtctgcagttatttggttttaaactgactggttttcaacttgtagcctagccttaggactttttaaaaaattgtgtgagtaagtagaggcaaagcaattcgaatgtaagagaacagggtccgaccccaactcattggtgcccccccccatagcccctctgcctgggaggctctgaggaacccacagggaagggagttctgcccagcacctagtgagatttgagcatctgtttctcaatccccgagttgtcattattgttctttaacagcatctggaaggaaaagagctgtttacaaaaaaatcatgcatggcctttgagcattcatttgacagtcacttcctgagcatctgctttgtgtcaggcattgtgtcctctcaggtctgggggtacagctgtgagtaaaggtgacagtgcccttccaccataaatgacccccacagggtaggtcgcaggtgacaggcttcttgccctttagttcagtgttttagggccactgttcactatgcaggaaaccattaaacctccaaatctcttgagaggcaaggaggggataagggttgggtcttaaattttcatgaggggccaggcacggtggctttacgcctgtaattccagcactttggtaggccaaggcaggtggatcgcttgagttcaggagttcaagaccagcctgggcaacatggcaaaaccccatctccaaaaaaaaaaaaaatacaaaaattatccaggcgtggtggcacacacctgtagtcccagctactcaggaaaccaaggtgggaggatcgcttgagcccaggaggcagaggttgcagtgagccaagattgcaccactgcactccagcctgagtgacagagcgaaaaaaaaaaaaaaaattcatgaggaagcctgaatgggaatgaaaaacaaataagaatcaaaagcagagggctgtgtcttttatttttgtattcttacaccgtatgaactttattaagaactaaaatcatgtgatggtaacccatgggcacacgctgagtacaaagttggaaaattgtaccagcatcattaactggggttgctttgtgttaacattgtgtatcattcacagatgtcaacaataagagaacacatctctctatatataattgttacaaacattttaaattataaggaaaagaaaaaaaaagatgcaaaagttcaaagactaaactcacaacatcctaccgacagagaatacttaggatagctaagatctcagtgttcattcaaacttctaaactcaaagactcggatttatgcaggaagttgaacatgtcttgtgtcaccagatctgtcagtgaagctgattatagtcttgggataaatttgagagtaatgtgacagtggtctgggaactctgactgtgggctctgccctctggatgcagagactccaaggcactcagcaaacccacctgtgggatcgtctcctccagatagaccaaaaaaaaaaaaaaaaaaaaaaaaaaagagagccataggattggtaatgggtacaaggctgctcatagatggcagagggactgtgttgtgctaatgtggaaatgccaagccttcagaaaagtagcccttgaatgagagattctttagccaaattctacctttcctggaaagcctgggcagtgccatcagcccacccactgcctgctcaaggttcctagaaagaggcaagtgggaaaggcctgtatgaacttagtgactgaatatatctcaccagtctgtactgcccataccaagacccagtgtcctaggtcacccccgctcttccttctaaaagcacgaagctaagctttccttcaaagtcaggttcaatcatcccaggacagaggcaggagaaaaacagagatgcccccagggagaagctagtccccagcggggctttcaccctgacctgagtaccaggaacacacagaactcttgcggaaataagaagctgtcatggcggttgtcgagtgctttctctaacccactgtttggctcatccactcccacgccactccaacacaactcagtttagggggcatagaatttaaacacttgtgagaactgaacaacttatatgctgatgtttcaaacttggcagaaagaccaaaaattagaaacaaatgcttggtggcccccattcatttgcatattaggccaatattttggtttcattctgcattgcccaatgagttaatcatacattttttccatgggtgaggtagcagttacgcagcttttattgtgtttgatagtcattgggcttattcatataagcccttaggtaaaaataaactgtggatgttccaagacagcaatggccacatacatttttaataatgtttccaagtttataaaactccttccctccaatgccatgatgatgcttataaagagcaggatttatgcgagcgactatgcatggccttataaatatctttccattcacacttgattagctcactaccatgttctgttccatgtattagtacagggaggaccaacaatggaagaatgatttatatgattcttttatttccctacaaccatcttcactccttatctcgtggtgtttctcttgatagccatagtagccgtggatatgtgttccctgctgtcaatttctctcttgacagagtcgcttacaagagctatggaaattggctaaatttaaccttatgcagcattgtcttactgatacttttatgttgttgcagtttacataagaataaaaattatgatattgggacttgccatagtaaaaaacagagggaagagtaaattgaatagatacttcttgctttacaagaatccatttaaattagtaggattaaaagtatgtaatgataccacttgcagtttaacctaggccaacctatgaagtggaaagtcaaatcccgtagtgagaaaaccaacccattattgcagattttttgatatagcgggaagattagaagtcagaggccttaattccatttgtagaattgccctttcctcacccttcttccttcagcaagtgttgactcatttaacttttccttgcttggtatgatttgcatttcgaatctgtggaaggataatcaatcatccatcatcattgcatactgtgcttgctagcacttgttcttttccaggttacctaaaatcaatacctcttccaaaggagtgattttttccccccacatcacctcattcatggtggtaagcactgctcgcaacactggactttccaggaagctttttgtttccctgctggcctggggcagtgtttgaaaccaagcaagctctatcagccattcctagctgggcaggtggtgagtgggccgtgcagatgaaaagagagaacctcaggtgggttcatttctttcctgtgttttcagggcttgttgcagaggtttggtagtttggagtgatgagtttccttgtggctcttcaccatttctttttcttttttttttgacaccgggtctggctttgtcacctgggctggagtatagtggtacactgcaatctctgccccctgggctcaagccatcctcccacctcagcctcgcaagtaggtgggactataggcactcaactctttgccatttctctcagtgtataataaccccttggtaggtgaatgatgataataatctgcaggtcttgcctcaaaatctggtaagcatctcatctggaacacttgggcctggtttcacagttggaaagggaaagatgagggaccttagggggctgcagatggcatggccagcagcagcagcactcactgggctccttctgcagtgcacacacgtgtgtttatgttcatgttcacgttcgtgtttgttctcagggcggcagcagcagctggatgcagagcgcctggacagctatgtgaacgctgaccacgacctgtactgcaacacccgccggtcggtagaagccccaactgagaggcctggtgagcggcgccaggccgagatgaagcgtttgtacggggacagtgctgccaagatccaagccatggaggccgcggtgcagctgagctttgacaagcactgtgaccgaaagcagcccaagtactggccggtcatccccctgaagttctgagctcagggcacagggtacccagcctctccttcttccttttgggtacacgctctttatctctccttctgtacatttcttagggaaaggggactttgtactggggtacaggcatgttcaccacagtcccagtgggcctgtcacggggtggatgtactatgccagccacttggaggtctgcaggacatgttctgttgccaacatgataaattttctcctgacataaaataattttgcatatactatactggttttttatgttgttggtaacagttcaattcattaacgttcttgcctagagatactgcctggtgttttgcttttttatcttttcttgtctttaacctgtctgaactacacaaatgcctttaaaaaaccagatatcctctctgactctagctccattagcccccactaaaaatgagccaagtgtgtagtgagacaaataccactacctgtagtggagagggatgcatgttctataaagggccagagagtgaatatctttggcactgcaagccacacggtcagtgttgtgactactcaaccctccctttgtagtgtgaaagcagctgtagacagtaagtaaacaaatgggtgtggctgtgttctaataaaactttatttataaaaaca

SEQ ID NO: 5497 - DNA, 21220 bp, human
cagtcgccccggcaacagccgcctccctcgcgtcccccactccccctctgtctctccaaggaaaactaggcccctgcgcggccaacgcccaggatccgcaagctgcgcgcccacgaggtgacttcggggacggctgggtttcctttggggagtgagggaggagcttagacgccccgggccctggcttcttctgatgcgcagagagccgaggtcttggacgtcacgttgctctcataattatcttaatcccgcgacaaaaggtggggccggaggcccatgagattcctaaatcattgcaggttaattgtgagaggggaccagtcccagaggctctcagctctgcagtgcttccgaatcactggacgactctttaagaattctgatccccgggcccccatcccggaccaatgaaatcagaatctctaatagtggggccctggcatcggtagtttttaaagctgcccaggtgattctggggtgccgagaaccaccgtgttaaggtctgtaggtgaattcggattttgcccatccagtccagtatctgaatagaagatcgcccaggacagccacatacttgaaggatgtctaggatattgccctctctgctcaaaaattcgggtttctttcttttctcttgcactttaacctctgcaggaggtcagcttttggtgggagttatcttgagacatctggcgcctacagtttatgggccttgtgtctctgcccacttatcagtaatgagctgtaattgaaccagtggccaacgaagtgcattttagctctgaaatcttgatgttcccttagtacagatcagatggttctgaacaattttatttttttcaggaatgatgtttttaaactcgtttgacaggctaggctgtgtattcagctgttcttcatctcaaatcagaacaatattacttaaaaaatctagactaaagattagtaacgcaacacttctaggattatttatgctcacagcccccatgaattgtaggatgagagctaccctttaaaaatactatttttgctagcataatttatcggaataacagtctctttgtaatttcaatgtgaacagaaaccatatatttttaaagactgctggttagtaacttggaataagcataactgaaagcaagttcacaggtgtataaatcccctctgtgtgttcattgctgtgctggggaagtatacaaactaaagttccagagagaaatgttcattctgaaactgttctatagatggtgattaatcattttgggtttttttttaaaggatagggtgagatgagaatgacgggggaaagttttgaacagttaaggctagagtgtaaattggagagtttgcaaagtaggtacagaactttttttgaacaacttctctacaagaggaaattcagccacggaacagctggacaagtgaaaaaagaatgtagttgatcaaatatcagatgaattgaaaagatctttgaaaacataatgtatttaaatatttgcttcctgaaaagatttggtgctttatagtcagttttttgagttactaggtcctcagagattttggggagtagatgcaggaggagagaacgttatcaggaaacaacagacaagctcaacaatttcagcagcatctaagagcatgaaatattagctattatttttatgctggaaggaaaataggaaacttaaaaggagtagattgtagaatccatgcctacaggtaactgagtaagtgcccaagtaaatgaggcatagtgagtgcctataaattcagaaaagagagattaacatggaattaccgtgaatatgtttatagaaaaaagtaaatttgaaataagacgcctgaaatgtactagcgatcttaactactttaaactagccatggtttttgctgttatgctcttaatttgcagaacctgcctattcaacccttattaccttatggtcacactaggttttgcttatgaaggacatgcttgctgtgaaacaaacttatctgtttcctcttttgaactatgttatcattatgtcattctcagtcatcccattgcttgttgtgttcctgagtcagagggtaactttgttcctggcctcatatttcacttttgattctgatattagtcacaaggggattcagagaacttgcaaataaacccattcacaaattcatcacacttgctgacaaattaaacaatgcccttctgtgggtggaatgtcatttgtatgaaaaaaagaattgttaactgcatcctttcagccttactccttccccatgctatgccttctttgtgacagtacttattacaacatccagaagagggtaaattggggttggggattgagggaatgaaaagaaaataaaactcagttttttggctcccttgcctatcagttttaactgtagctattatagacggggagatgcaggctttctgaacacagtggcatgtgcacttgagtaggcctgtgtcctgcccaagatggagcttggatgtctgcaggtggaagaaggccatttggacttgagccatctttgatgtccaaatcactaagcagggaccatgcaaagacacaggagggaggccatgagggcatcaagccagatgagcttgccagcctcagcaaccagccagggatgggggcagggctgcccaagtaggtggggcaggaagcccagccctcaacaaaaccctattatattctttgtcttagtgaggaagttcttactgttgtgtgtattattggaagacatcttctgtgatagggttattattgcatgtacagagagattccttggaaccgcatatgactcaatctatctcactcagatttctcaccataccttcacttattttgctgcagtgtccagcagatctccttgaaacagtgtgtactgaagacctaactaaatcctccaaattacctggttggttcagagaaccaaatcactggagctttgtagggaaggtttgactttcagggctttagccagagtaacttatttaatgattggcttttaatgtgtttctgtgcaaagatcaaagcaggtgaattttcatgtatttttagaattctagtagaaaaggaagataggaaaatctagttcaagtatacattctagtttttaggggaatttgtgtttttattttacttttttggttgctacgatttgtcctatattctatatttataagaacataaatatgtaattaaaagaatatatttgatggcactacctgtcaacaaagccacttatttgtgaaattttttggtaacttgatggaaatagtcacattttatccattgaaaactacaaagctcttatctattgttctttgtgtatatttatgcattaaaaatagatcctgcaggatgagcagatgtactgaagtgtaaatccgttttttaagagaggctatatggaaaaatatatcattcaagactcagtctctgccttgcctataggcctcgtcagtgtttagtgaatgacctcaaccctgtttttttccttccttctttggtggttgaggacagacaatgaatggtctctgtactcgcctgggctcagctgggtggtggccattatgccattgtgctcactggagagggctgccgggtttgtagagctgcggatcccggccttccctgacattgccaatctcttttctttcagctccaccagcccattggagaaaagttactgttcagtccctgaaggcttgtgccataaaagagtgggagacattcccagggaggtgaggaatgaaagatcgaattaaagaccattaaagaccaaagggcatctaaatctgcagcaaccatcagctctcttttctttgagaggtagtagtctctgaaggtgttgctgtaatgtctataattatttagatgttggcttttcagaaacccaggcattcttattagctccttaagttctccatgcgtgaagaaaataaccagcttaaaaaagctaatcggacctatctctagaagaggacctcttcttcccttgggagctaactgatattaactgactaactgattgcttagcaggaaagaatatatattctttccagggaatagagattcagagctctgtcctgtttgctttctaagccctgctgattgatatggttttgcagaatttttattgttatttttagttaagtctttaaatgtttatatggatatttaagaaaagatccaatttccttatttagtcatggagagtgtttttttgtcccacatattagcaaccggtcaacatgattgctattggtcatagtcagttttcttgcctccactagtctttctccaaacctaatcatttatgaaacgtgtgagaatcgtgaagttcgtctactgattcccaagtggaaactgaggaacaattaggatgctcagtatattcagagagaatctatacaacttcaaaatgtgttaacatgaaacaggggtgggcaaaataaaagcccacagcctgttttttgtacttcaggaagctaagaattgtttttacatttttaaagggttgtttggtgtgtgttttttttttttttaaagcaaagaacgtgaagactatgcgacaaagactgtatgtggcccacaagcctaaaatatttatctcgccctttactgaaaaaaaattgctggcataaagtaataatactggaaagacctagctaaaaataattataaagctctatgcaagttgctattcctttaaacatgtttttctatgccttatttgacttttgagagacgaatgtgtaattcttcaagtcaattattcaaattggttaatttgaatataggattttaggaatcttaaaaagacttaaaatgtaaaaggctattacaagtacaagtacattttgggatttagggagagaaaataataaagccaagagtgagatgagcacagtctacatacagcctcaggactttaaacttgatggaagatggcagcaagtttgattataaatgtcccagtggtcaaaactgtgaggaaagcataatcaaagcaaagcaaaattgcctacagagtttcttgcactccatcattaacataaattcatcctttcataatgtcctgggtcttaagagtctagcaccttagctgatgaattaatatatttaattaatgtagatagtgggcactctgggcttattctgaactgcctctggttcagaagctggaactggctttcttcagtcatctcaaatgattctcttggcttctttcttgcataagtgctcaggatgtacctgggtgatctctgaggccttctaacatagcagcccttctaccagatgatttgttggatcaaagttacctctcctcaaactagtgctccctccctcttctttttttttttgtttttgtttttgtttttgagactgagtctcactctgtcactcaggctggagtgcagtggcacgatctcagctcactgcaacctccacttcctgggttcaagcaattcttgtgcctcagcctcccaagtagctgggattacagatgtgcgccaccagacccagctaatttttgtatttttagtagacatggggtttcaccatgttggccaggctggtcttgaactcctgacctcgggtgatccacccacctcggcctcccaaagtgctgggattataggcgtgagccacagtgtctggcccctccctctaaatcacagccattgacatttgagcagcctggagaacatcatcaattacccttgaactccttaaaatggtagtctactttatctcacatgcctaaacttccagctttgcaaaatggagcctctcttagccatctggtggattttcagaatattggtgctacaacctttaataccacactggattttcccaattataactaaaaacaagattttgtctatagtagtgtttgatctcaatggtgtttattccatatttgaggctatcacacttcccagtttggaataattgatattttagttgacctggttctaaatgccttatgatgcgtagaaagaagtctggattcaaaacacttaatttccagaacacatgcagatgtctcctagacttttctaatttaattcctgtgctgcttgttaatctataaaacaaatttgattaagatacacatgcagtttgcgttaatgtcattatgtgctgcaggctctcagaaaattattcagattttagtgataaaaatataaaacctgggccgggcacggtggctcacgcctgtaatcccagcactttgggaggccgaggcgggcggatcatgaggtcaggagtttcgaccagcctggccaacatagtgaaaccccatctctactaaaaatacaaaaattagccaggcatggtgccacgcgcctgtaatcccagctactcgggaggctgaggcaggagaatcgcttgaacctgggaggcggaggttgcagggagcagagatcatgccattgcactccagcctgggtgacagtgtgagacttcgtctcaaaaaaaaaaaaaaaggaatataaaacctggttctagtgaattagccacttaaaggctgcaccttacagttttgctcttaagtacatactaatttctacataatttcaagtatgttttatttctctgagtggtaagccacctaagtattaacttttatatttcttcagtggcccggaaagcacatagcagttagctaggttttcaggtacttgttcatgttttaaacctttaaaacattaaaattatagattaatgtgaacttaatttacactgcatttgttaactttttcagtttatattcgttgcatgtatgcatagtattgaatttaagacaaggaacaggaactatgggctatgtttaagataaatttacagaaggttatgtcagccctcttagaaataccctatttgaaagtttattatattcaaaaagaatgtgaatgattctctttcagctaaatcttaaaatatagaagtggttgatttagcatctcagttcttaatataaccatagcaaaacatctgatagagattataaaacaagtaaagtttgtttcttaagggttggggaatgttttaattctaccctatagttaagtgaaaaggaaaaataagactgctttggtatctgatttccaaagtttcaaaacctaagtagttgtttgctcagcattacattgtgttagtggttttgtctcacagaaacttaaattatcatgcatttttggatatttttgtttaactttttaaaagtacattctggtgtagctctgaacctctgaatagaaaaaaaaaaagtctattttaaatagattgaaaaagctacagctgcagattagccattacttttgggtatttcatgcatcgaatcagcaaatcacaacaggtgggtagagagaaaaggagtaaatctcagcagagcaatgctatttgccagaggcagtctatctggtgcctcagtagagactccatggagtgtttttttctcctgtgaagagacagggtggttaggcaaggagagtgtgatgtcacatgctggctgagaaatgcatattgcaatcaaaatgaaaacaaagcccatttggggaacttaaagcccagggcacaactgaggctggagagatgtcttattctccaagtcccaaacctaaggcaagacccaacagaggtttctggtcatttggaaagatgtgttcccctcaagcctcaggaagacccagggttaatttaagtaagcattagcatgagttaaggattagtaaataaagtaataactataaatttttagttcatgttttgtatattgtgtgtgtgtgtatatatatatacacacacacacatatatatacacattatatatacatgtgtatatatacatgtgtatacatacatatatgtgtatatatacattatatatacacacatatatatgtgtatacatacatatacatatatatgtgtgtatacattatacattatacatatacattatctgggacttggagaataagacatctctccagcctcagtatatatatcagtatatatatactatatatatatatatatatatatatatatacacacacattaactactaaatatttatatggtcattttcatagactttacttcctatagggaaataagtaattgaaccatgcaggatcttttgacccacttaatcaaacctaagtggatccctccttttcagaccacaaagttatagcccaggaaccaacgtcatatagataggttgcatgaaatcaggcatggtcctgggaagaggcagttccttgggagctgcctcacaaaccatagaatagccacaaatatcacacagccatactgatcagacgtttgcactgtgattcttctttcctagtttcagcacccatttggactttcacaatcagagatggcagcggtaaaggtaagatttttatttttttattttttttttgagctcgtaagtaaaaaaggtaaactttagtctttttttttatactttaagttttagggtacatgcgcacaacgggcaggttagttacatatgtatacatgtgccatgttggtgtgctgcacccattaactcgtcatttaacattaggtatatctcctaatgctatccctcccccctccccccaccccacaacagtccctggtgtgtgatgttccccttcctgtgtccatgtgttctcattgttcaattcccacctgtgagtgagaacatgcggagtttggttttttgtccttgcgatagtttgctggtaaattttagtctttaaagtttggtattctcattgcacgatggagaagacctaagaaatacaaaagtaaaagcactattgggtgcattcctagacatctcttaccccaggcatttaggggtggctcaggccagcaagttagtttagggggcagaaagggaaaaactaaagtctgtcatgcttgtcagtctagtgtggttcttagcaggccgttgctcagttggcagtagtcatttaattacagtgggtagagagggctaaggtgataaacatccagtcttctctctccctgcgtctcatctagaaacgatcactagccttcatccccacattataatgctccatagctttaattggctggcttgtgcataccttatgtacatggacttagcaagtgtgcatacacttggtgtccactgtgggcctggacctatctcacacaatattttgggcccagtagcctcctcatgtaggtaggtatttagcaaatactaagtaaatacctgttgggtagcagattaaacatttgaagatttctcttgaggataataaacactttggtgtccaccctccacctcctttcattttgtaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacgtaagttcaggcctctgtctcttcatgcttcctttccttgccctgccttttacattttttttctctaatatataaagtaattttataattcttcattggctagggtaatattccaaatccagtcctaagcctggaaaagctatggggatgctgtaccttgcttatgttagtttctggagttgttttagtataagacatttttttgttccagaacaaagcttatcctaatagtagttctactatttattaaccattagacactctaccaaatggagtgtgtatgcatgcatgcttgtgtgtgtgcgtgctctgatctacacagcagtccctcagagtattaaactcattttatatatgaggaaagtgaaccttaaaaaggttaattgacttgttccgtggtacacaactagtaatttgctgttaggatccaaaccaaatctgcctacctctacttcctgtactgctttctgtatactaggacttgtccctgagactgctaggttcctaaaatacttttgccattcctctgggacacatcttggagatgtccttggtgctagaggtcccaaatcttaaatagcatgaacctaaacagagtaacgaaatgcctggcacttacaactttcctgttggttctgcattgaggccctgtccatggggtcagagaattatgataaaggtcttatatcttcagtcaaaaacaggaattttctttttaaatttcttaccaccttactagaaagaactagaacagcttttgtgctctcctattaaaattcaccagaccatttctaagtacctctaactgagatacaaatgcttctttccctattataaccagtattcattctcaattttgttttaagtgaggcctaattgtatgacattttacctacaattttccaatgacacagaagcgtagaaacctgggaatgggagtttcattcctgtctgtcattgtcagcattttcctaatgatgaattagcttttattgatccccactggatgccaagaactgagcactgggctttgtataaaatattatatcctttagtatcttcgtccgtgattcttcactaaactacttgttcagatttttttgacttcctttcttttgtttaaactgtgtacttctttaagcatattagaaagtatatccagccaggtgtggtggctcacacctgtagtcccagcaactcgggaggatggcttgagcccaggagtttgaggctgcagtgagccacgatcacaccactgtactccagcctgggtgacagagcgagaccctggctcaaaaaaaaaaaaaaaaagaaaagaaaagaaagaaaagaaaaagaaaagaaagaaagaagtatatccaaacaaatacttttaagacagtactttctattacacacagaatacttttgcttgatctccagaaataaattttaccctttttaaaaatatagatacgaaacaaccattagtctaatatatacaacaaatgagaagcattggagcatgtccatgtttgggttggaatgctgtttgttacagcttttgacagagaaaatgggatggagatcgagtttattactcttgtccttaccagaaagtagaataacatgttttgcccactagaggttgatacttttatgatggaaattgtaattatggatggaagcaaatcccagtcatctcaaaggtgactttgaattatctgctggtttaaaataaacttgagttagtcaataaaaagtggatatgaataaaataaagataaaacaatgaaatgtgtccttgcaccaaagaaaaaatgtgaacggttcagttacagatattgttaacaaccatccctattcctccctcttgccattgttaggtagaactctaggtaggtaaacaaaatcatgaaaattacctgctaagtcatacttgccacttaatattattttgagtgaataaatgaagtctttcagtgtgaattagaagccttaaatcagaggttggcaaatcttacccatagagtgctacacttgcagtgattctgtgggacattttacagaatgagctaggccttgtgtgcattataaacttgataagcttcatctctgtgtttcatattatttccaaatctgtctagttactttacggctccaaattgcactttcatcatctgggttgaattgtatctccccaagaaagatacagtggaatcctaacccccagttcctcagaatgtgaccttatttaaagacagggtctttccagaggtaattgaggttaagtgaggtcattacagggatcctaatcctatgtgactcaggtccttataaaaagggcaaaatccggacacagagacagacacacatgcagtgaaaacaccatgtgaagattgacattatgtcgccacaatccaaggaacatccagaaggtgggagaggcctggaacagatccttccctagcacctttagagggtttatggccctgccaacacctcgattgcagacttctgacctccagagccatgagacaatacatttctgttgttttaaaccacccagtatatggtactttgttatggcagccctaggaaaggagtacaatcaccctgggagaattttctttgtccccaaatgcaatctgtgactgggacataaagtaaacccacagttcttgtcatctgtctgaaaaaactgtattacttatttgttttactgtgatctagatagcaaaccatcataaaagggaattttatgaaaacccttgcaacttccatcttgaacctcattttccagtattcatattattgctggcaacagtgtatggaggcagctgtggcagaactgcttgaatcacagaggtccagcctcactctaccactcgctgattagaggttctcgtcctcctgtaagccccctgccttcaccattctttgcctcagttgcctcacctatgaaataggatcctaattagtgggtagtaattatgaagaatccctaatgggtagtaattgtgaagaatccatgagataatatgagaaaagttatagaatggtgcttggtaccaagttggtgcccaataaatgttattgttacagttagttgctagtaacccatcctttaacatggattattaaccataaattggtttttctctgataccgtttgccttgattagtgcttgattgagattctgtacatatatatatatatatatatatatatttttttttttttttttttttttgagacagattcttactctgtcacccaggctagagtacagtggcgccatctcagctcactacaacctatgcctcccgggttcaagtgattctcctgcctcggcctcccaagtagctgggatttcaggcgccaaccaccacacccagctaatttttttattagtagtagagatggtgtttcaccatgttgtccagagtggtcttgaactcctgacctcaggtgatccacctgcctcggcctcccaaagtgctggattataggcatgagctaccgcgcccagctaagattctgcatatttttaataagatgttctgtgacttcagaaaggtcatatttctgctctgggtggcacctttcaaacttttaaactgatttagaatattaaagacatgaaagaatgaaagttttggtgtctatcaaatttagcaattaacacagtttttagttctgtttcaaggatattcttgcttgataaaatttaatgcagtaaagtacatggactgggaaaattaacccacttcaatattactaataatgtccctaaacaagctttcaattctttgtatttttaaaatgtgtagttacagcatgattcaaaactacttttcttagcgtctgtgtcatgctcctacagccttccctgaatgcattagctggtcccagggagatgtgagaattgtctggtgagggtgagaacagactgtggtgtcagactggaatctaaagacttcgtctatattagaagcagctgccagggcccgatcttgcaccagtaagaaaataatgggcaatagatcactagcattatttttttcagcagcacttttggtgagtacaggatgaacaactgttcttcaagcggtaatgaatgatggaattcatatgtaagtaatctgagtgcccatggcgctttccaattcattaccttcaccagaaattttcatggagggttagttacatacactgttggaaaaagctttaataaagagataagggacctgggtagtatgaataattggttcaagttttttgtttcattttgctctcaaaaccactagaagctacttattcaataaggacattttcagctttgaacatgaatgctttgaagaacacaggattttagaaaatgttactagcaagaggaaatgtcactaaatttgaaagatttaacttttcagtattattcacttccacaggaacatacaagttatgcaattcatcatcgcctgagtcttgtttaatattttcttaggataaaggccttcagattggacagtatgttcttttttgtgattgctactcagattccagatagtctctactttaacatatttcaaggataaaaaacaccaaaagcttgactaggataagaactccttttgtacagtgggaacatgcatgcttttgattatgtctgtcatcatttcctaacaagatatttccgttacttaaagcttcaatggaaaataacttatgagaaagtttacagttatgaagttttaaaggtcagctgtgttttcaattatttcttaggaaaaatgtttattattaggttaagaaaaataccattttgtagtcataagtgaccactggtcgagactgcaaggttatattgctaatacttagagggaaaatgagtggaagtcaccctcaaaagagagtaaggccctctgaaacaaacaccaccactgttttctcgggtttgagccaatcaggtatttatgacctatgttttgagggtgttggctcaaaacagggacatattctaaaagcttaaaccccattgggaagaggagacaaaatgaaatgtaaagtgacacatagaagaagagtgtctatggtgtggttcatggttatacatgcacatgaggggtagagccagtgacccaggcagtcaaaggaggagcaccgcggggcagctgtcaagaagtaaggtatgcactaggccaatttgagggatagggtcaatttggaatgagagaaaaaaggacttagttcactcccggcttagacactcaaagtgctgttcttaccagagagcccagatgtggttttcatatgcccagatgtggttttcatacgtttgaggggagacatctgctccattacactgtgtccatctgagtgggaaggctgagactgtagttttcatagtgagcctttagtcagtcaaacctagagagaacccggtgaagtttatggcccagtatttagtgagctgtcttgctttagtcaatgaggttgaaggatgaaattgcagtgattgagcacaatcctgacatgcgtgtgtgtttcatctggtgcagatattcacaggtgcacaaaaccgatcagtgagatgatacgtgttaatggctgtagaaaagtggaaaggaacatgaaaatgcacttctgttgtaaaagtaaaaatggcggttgtccagtaacttcaggattacatttgtcatggggcaagggatgtgcgacgaagagagaagaccagtctgaaatggctccagttctgctggcatgtacctgtgttctgggtggttgctgacaagccagaaatgaggcattcatggcatacatcaagtttgtgctttccctcggttgtgctacaattattcattttggcaaaatagcagaaaatataatcagaaagatgtactagtcctaggaaagtgaggggaaaaaacattctttgccacttgctgcctccatgctttatcctctaacatgttctgcctttgggctctatgtgtggaataatcttggatgaaagttttcctgctatataagattctctgaagtcctggtaactttccatgattttttttttcctttatggactattacgtgatgtgacattggtcacatcatgtagacaaatagattgatgtgaaaaataccaggattatgtatcctgaacccagatggaatccagtaaagcttttccttaataatacatgcctattgttcttgttttaacctatatgcatattaacccttgtattagcctcccagggctgctgtaacaaattacacaacctgggtggattaaaaaaaaaaaaaaaacagatttattctctcacagttctcaaatcaagcggtcaacaggaccacacgccctctgaaggctgtagggcctcacctcttccaacttctggtgtttcctggtgttccttggcttgtggcagcatcattccatctctgcctccatcttcatgtggcctttcccctgtgtctgtgtgtccttttctgtctcatacaaggactttgtcattggagttagggtccaccctaatccagtatgatctcatcttgatcctttaattacatctacaaagccctatttccaaataaggtcaccttctgtggttccaggtggacatggatttgaagtgacactattcaacccactacaatcctattttgaagctggaatagaatcaaaaaagatttctgattcatattaaaacaaattatcttgccaaaataccctataaaagtgtatggcaacattgagtcctacagctgtttccaataaaaatgaccaaaccctccatgacaaggcaactgttcattggcatctgaagtgtgatgtccgtactggtctgctttggtcagatgattttccatctggctggctgagcgctcaccttgttttgacagcaaggaaaactgccagtgattgagaatccgttttcgttggaaggaaggaaggaagcaataaatagaaaacagaatgagtggatgccttcaaactctgatactccattctgaggtttacttggtcccctaagtcagtacacgctaaagtactttcacatgctggctgtgaccatcagtgcacagcctgtctgcagttatttggttttaaactgactggttttcaacttgtagcctagccttaggactttttaaaaaattgtgtgagtaagtagaggcaaagcaattcgaatgtaagagaacagggtccgaccccaactcattggtgcccccccccatagcccctctgcctgggaggctctgaggaacccacagggaagggagttctgcccagcacctagtgagatttgagcatctgtttctcaatccccgagttgtcattattgttctttaacagcatctggaaggaaaagagctgtttacaaaaaaatcatgcatggcctttgagcattcatttgacagtcacttcctgagcatctgctttgtgtcaggcattgtgtcctctcaggtctgggggtacagctgtgagtaaaggtgacagtgcccttccaccataaatgacccccacagggtaggtcgcaggtgacaggcttcttgccctttagttcagtgttttagggccactgttcactatgcaggaaaccattaaacctccaaatctcttgagaggcaaggaggggataagggttgggtcttaaattttcatgaggggccaggcacggtggctttacgcctgtaattccagcactttggtaggccaaggcaggtggatcgcttgagttcaggagttcaagaccagcctgggcaacatggcaaaaccccatctccaaaaaaaaaaaaaatacaaaaattatccaggcgtggtggcacacacctgtagtcccagctactcaggaaaccaaggtgggaggatcgcttgagcccaggaggcagaggttgcagtgagccaagattgcaccactgcactccagcctgagtgacagagcgaaaaaaaaaaaaaaaattcatgaggaagcctgaatgggaatgaaaaacaaataagaatcaaaagcagagggctgtgtcttttatttttgtattcttacaccgtatgaactttattaagaactaaaatcatgtgatggtaacccatgggcacacgctgagtacaaagttggaaaattgtaccagcatcattaactggggttgctttgtgttaacattgtgtatcattcacagatgtcaacaataagagaacacatctctctatatataattgttacaaacattttaaattataaggaaaagaaaaaaaaagatgcaaaagttcaaagactaaactcacaacatcctaccgacagagaatacttaggatagctaagatctcagtgttcattcaaacttctaaactcaaagactcggatttatgcaggaagttgaacatgtcttgtgtcaccagatctgtcagtgaagctgattatagtcttgggataaatttgagagtaatgtgacagtggtctgggaactctgactgtgggctctgccctctggatgcagagactccaaggcactcagcaaacccacctgtgggatcgtctcctccagatagaccaaaaaaaaaaaaaaaaaaaaaaaaaaagagagccataggattggtaatgggtacaaggctgctcatagatggcagagggactgtgttgtgctaatgtggaaatgccaagccttcagaaaagtagcccttgaatgagagattctttagccaaattctacctttcctggaaagcctgggcagtgccatcagcccacccactgcctgctcaaggttcctagaaagaggcaagtgggaaaggcctgtatgaacttagtgactgaatatatctcaccagtctgtactgcccataccaagacccagtgtcctaggtcacccccgctcttccttctaaaagcacgaagctaagctttccttcaaagtcaggttcaatcatcccaggacagaggcaggagaaaaacagagatgcccccagggagaagctagtccccagcggggctttcaccctgacctgagtaccaggaacacacagaactcttgcggaaataagaagctgtcatggcggttgtcgagtgctttctctaacccactgtttggctcatccactcccacgccactccaacacaactcagtttagggggcatagaatttaaacacttgtgagaactgaacaacttatatgctgatgtttcaaacttggcagaaagaccaaaaattagaaacaaatgcttggtggcccccattcatttgcatattaggccaatattttggtttcattctgcattgcccaatgagttaatcatacattttttccatgggtgaggtagcagttacgcagcttttattgtgtttgatagtcattgggcttattcatataagcccttaggtaaaaataaactgtggatgttccaagacagcaatggccacatacatttttaataatgtttccaagtttataaaactccttccctccaatgccatgatgatgcttataaagagcaggatttatgcgagcgactatgcatggccttataaatatctttccattcacacttgattagctcactaccatgttctgttccatgtattagtacagggaggaccaacaatggaagaatgatttatatgattcttttatttccctacaaccatcttcactccttatctcgtggtgtttctcttgatagccatagtagccgtggatatgtgttccctgctgtcaatttctctcttgacagagtcgcttacaagagctatggaaattggctaaatttaaccttatgcagcattgtcttactgatacttttatgttgttgcagtttacataagaataaaaattatgatattgggacttgccatagtaaaaaacagagggaagagtaaattgaatagatacttcttgctttacaagaatccatttaaattagtaggattaaaagtatgtaatgataccacttgcagtttaacctaggccaacctatgaagtggaaagtcaaatcccgtagtgagaaaaccaacccattattgcagattttttgatatagcgggaagattagaagtcagaggccttaattccatttgtagaattgccctttcctcacccttcttccttcagcaagtgttgactcatttaacttttccttgcttggtatgatttgcatttcgaatctgtggaaggataatcaatcatccatcatcattgcatactgtgcttgctagcacttgttcttttccaggttacctaaaatcaatacctcttccaaaggagtgattttttccccccacatcacctcattcatggtggtaagcactgctcgcaacactggactttccaggaagctttttgtttccctgctggcctggggcagtgtttgaaaccaagcaagctctatcagccattcctagctgggcaggtggtgagtgggccgtgcagatgaaaagagagaacctcaggtgggttcatttctttcctgtgttttcagggcttgttgcagaggtttggtagtttggagtgatgagtttccttgtggctcttcaccatttctttttcttttttttttgacaccgggtctggctttgtcacctgggctggagtatagtggtacactgcaatctctgccccctgggctcaagccatcctcccacctcagcctcgcaagtaggtgggactataggcactcaactctttgccatttctctcagtgtataataaccccttggtaggtgaatgatgataataatctgcaggtcttgcctcaaaatctggtaagcatctcatctggaacacttgggcctggtttcacagttggaaagggaaagatgagggaccttagggggctgcagatggcatggccagcagcagcagcactcactgggctccttctgcagtgcacacacgtgtgtttatgttcatgttcacgttcgtgtttgttctcagggcggcagcagcagctggatgcagagcgcctggacagctatgtgaacgctgaccacgacctgtactgcaacacccgccggtcggtagaagccccaactgagaggcctggtgagcggcgccaggccgagatgaagcgtttgtacggggacagtgctgccaagatccaagccatggaggccgcggtgcagctgagctttgacaagcactgtgaccgaaagcagcccaagtactggccggtcatccccctgaagttctgagctcagggcacagggtacccagcctctccttcttccttttgggtacacgctctttatctctccttctgtacatttcttagggaaaggggactttgtactggggtacaggcatgttcaccacagtcccagtgggcctgtcacggggtggatgtactatgccagccacttggaggtctgcaggacatgttctgttgccaacatgataaattttctcctgacataaaataattttgcatata

SEQ ID NO: 5498 - DNA, 20504 bp, human
gagattcctaaatcattgcaggttaattgtgagaggggaccagtcccagaggctctcagctctgcagtgcttccgaatcactggacgactctttaagaattctgatccccgggcccccatcccggaccaatgaaatcagaatctctaatagtggggccctggcatcggtagtttttaaagctgcccaggtgattctggggtgccgagaaccaccgtgttaaggtctgtaggtgaattcggattttgcccatccagtccagtatctgaatagaagatcgcccaggacagccacatacttgaaggatgtctaggatattgccctctctgctcaaaaattcgggtttctttcttttctcttgcactttaacctctgcaggaggtcagcttttggtgggagttatcttgagacatctggcgcctacagtttatgggccttgtgtctctgcccacttatcagtaatgagctgtaattgaaccagtggccaacgaagtgcattttagctctgaaatcttgatgttcccttagtacagatcagatggttctgaacaattttatttttttcaggaatgatgtttttaaactcgtttgacaggctaggctgtgtattcagctgttcttcatctcaaatcagaacaatattacttaaaaaatctagactaaagattagtaacgcaacacttctaggattatttatgctcacagcccccatgaattgtaggatgagagctaccctttaaaaatactatttttgctagcataatttatcggaataacagtctctttgtaatttcaatgtgaacagaaaccatatatttttaaagactgctggttagtaacttggaataagcataactgaaagcaagttcacaggtgtataaatcccctctgtgtgttcattgctgtgctggggaagtatacaaactaaagttccagagagaaatgttcattctgaaactgttctatagatggtgattaatcattttgggtttttttttaaaggatagggtgagatgagaatgacgggggaaagttttgaacagttaaggctagagtgtaaattggagagtttgcaaagtaggtacagaactttttttgaacaacttctctacaagaggaaattcagccacggaacagctggacaagtgaaaaaagaatgtagttgatcaaatatcagatgaattgaaaagatctttgaaaacataatgtatttaaatatttgcttcctgaaaagatttggtgctttatagtcagttttttgagttactaggtcctcagagattttggggagtagatgcaggaggagagaacgttatcaggaaacaacagacaagctcaacaatttcagcagcatctaagagcatgaaatattagctattatttttatgctggaaggaaaataggaaacttaaaaggagtagattgtagaatccatgcctacaggtaactgagtaagtgcccaagtaaatgaggcatagtgagtgcctataaattcagaaaagagagattaacatggaattaccgtgaatatgtttatagaaaaaagtaaatttgaaataagacgcctgaaatgtactagcgatcttaactactttaaactagccatggtttttgctgttatgctcttaatttgcagaacctgcctattcaacccttattaccttatggtcacactaggttttgcttatgaaggacatgcttgctgtgaaacaaacttatctgtttcctcttttgaactatgttatcattatgtcattctcagtcatcccattgcttgttgtgttcctgagtcagagggtaactttgttcctggcctcatatttcacttttgattctgatattagtcacaaggggattcagagaacttgcaaataaacccattcacaaattcatcacacttgctgacaaattaaacaatgcccttctgtgggtggaatgtcatttgtatgaaaaaaagaattgttaactgcatcctttcagccttactccttccccatgctatgccttctttgtgacagtacttattacaacatccagaagagggtaaattggggttggggattgagggaatgaaaagaaaataaaactcagttttttggctcccttgcctatcagttttaactgtagctattatagacggggagatgcaggctttctgaacacagtggcatgtgcacttgagtaggcctgtgtcctgcccaagatggagcttggatgtctgcaggtggaagaaggccatttggacttgagccatctttgatgtccaaatcactaagcagggaccatgcaaagacacaggagggaggccatgagggcatcaagccagatgagcttgccagcctcagcaaccagccagggatgggggcagggctgcccaagtaggtggggcaggaagcccagccctcaacaaaaccctattatattctttgtcttagtgaggaagttcttactgttgtgtgtattattggaagacatcttctgtgatagggttattattgcatgtacagagagattccttggaaccgcatatgactcaatctatctcactcagatttctcaccataccttcacttattttgctgcagtgtccagcagatctccttgaaacagtgtgtactgaagacctaactaaatcctccaaattacctggttggttcagagaaccaaatcactggagctttgtagggaaggtttgactttcagggctttagccagagtaacttatttaatgattggcttttaatgtgtttctgtgcaaagatcaaagcaggtgaattttcatgtatttttagaattctagtagaaaaggaagataggaaaatctagttcaagtatacattctagtttttaggggaatttgtgtttttattttacttttttggttgctacgatttgtcctatattctatatttataagaacataaatatgtaattaaaagaatatatttgatggcactacctgtcaacaaagccacttatttgtgaaattttttggtaacttgatggaaatagtcacattttatccattgaaaactacaaagctcttatctattgttctttgtgtatatttatgcattaaaaatagatcctgcaggatgagcagatgtactgaagtgtaaatccgttttttaagagaggctatatggaaaaatatatcattcaagactcagtctctgccttgcctataggcctcgtcagtgtttagtgaatgacctcaaccctgtttttttccttccttctttggtggttgaggacagacaatgaatggtctctgtactcgcctgggctcagctgggtggtggccattatgccattgtgctcactggagagggctgccgggtttgtagagctgcggatcccggccttccctgacattgccaatctcttttctttcagctccaccagcccattggagaaaagttactgttcagtccctgaaggcttgtgccataaaagagtgggagacattcccagggaggtgaggaatgaaagatcgaattaaagaccattaaagaccaaagggcatctaaatctgcagcaaccatcagctctcttttctttgagaggtagtagtctctgaaggtgttgctgtaatgtctataattatttagatgttggcttttcagaaacccaggcattcttattagctccttaagttctccatgcgtgaagaaaataaccagcttaaaaaagctaatcggacctatctctagaagaggacctcttcttcccttgggagctaactgatattaactgactaactgattgcttagcaggaaagaatatatattctttccagggaatagagattcagagctctgtcctgtttgctttctaagccctgctgattgatatggttttgcagaatttttattgttatttttagttaagtctttaaatgtttatatggatatttaagaaaagatccaatttccttatttagtcatggagagtgtttttttgtcccacatattagcaaccggtcaacatgattgctattggtcatagtcagttttcttgcctccactagtctttctccaaacctaatcatttatgaaacgtgtgagaatcgtgaagttcgtctactgattcccaagtggaaactgaggaacaattaggatgctcagtatattcagagagaatctatacaacttcaaaatgtgttaacatgaaacaggggtgggcaaaataaaagcccacagcctgttttttgtacttcaggaagctaagaattgtttttacatttttaaagggttgtttggtgtgtgttttttttttttttaaagcaaagaacgtgaagactatgcgacaaagactgtatgtggcccacaagcctaaaatatttatctcgccctttactgaaaaaaaattgctggcataaagtaataatactggaaagacctagctaaaaataattataaagctctatgcaagttgctattcctttaaacatgtttttctatgccttatttgacttttgagagacgaatgtgtaattcttcaagtcaattattcaaattggttaatttgaatataggattttaggaatcttaaaaagacttaaaatgtaaaaggctattacaagtacaagtacattttgggatttagggagagaaaataataaagccaagagtgagatgagcacagtctacatacagcctcaggactttaaacttgatggaagatggcagcaagtttgattataaatgtcccagtggtcaaaactgtgaggaaagcataatcaaagcaaagcaaaattgcctacagagtttcttgcactccatcattaacataaattcatcctttcataatgtcctgggtcttaagagtctagcaccttagctgatgaattaatatatttaattaatgtagatagtgggcactctgggcttattctgaactgcctctggttcagaagctggaactggctttcttcagtcatctcaaatgattctcttggcttctttcttgcataagtgctcaggatgtacctgggtgatctctgaggccttctaacatagcagcccttctaccagatgatttgttggatcaaagttacctctcctcaaactagtgctccctccctcttctttttttttttgtttttgtttttgtttttgagactgagtctcactctgtcactcaggctggagtgcagtggcacgatctcagctcactgcaacctccacttcctgggttcaagcaattcttgtgcctcagcctcccaagtagctgggattacagatgtgcgccaccagacccagctaatttttgtatttttagtagacatggggtttcaccatgttggccaggctggtcttgaactcctgacctcgggtgatccacccacctcggcctcccaaagtgctgggattataggcgtgagccacagtgtctggcccctccctctaaatcacagccattgacatttgagcagcctggagaacatcatcaattacccttgaactccttaaaatggtagtctactttatctcacatgcctaaacttccagctttgcaaaatggagcctctcttagccatctggtggattttcagaatattggtgctacaacctttaataccacactggattttcccaattataactaaaaacaagattttgtctatagtagtgtttgatctcaatggtgtttattccatatttgaggctatcacacttcccagtttggaataattgatattttagttgacctggttctaaatgccttatgatgcgtagaaagaagtctggattcaaaacacttaatttccagaacacatgcagatgtctcctagacttttctaatttaattcctgtgctgcttgttaatctataaaacaaatttgattaagatacacatgcagtttgcgttaatgtcattatgtgctgcaggctctcagaaaattattcagattttagtgataaaaatataaaacctgggccgggcacggtggctcacgcctgtaatcccagcactttgggaggccgaggcgggcggatcatgaggtcaggagtttcgaccagcctggccaacatagtgaaaccccatctctactaaaaatacaaaaattagccaggcatggtgccacgcgcctgtaatcccagctactcgggaggctgaggcaggagaatcgcttgaacctgggaggcggaggttgcagggagcagagatcatgccattgcactccagcctgggtgacagtgtgagacttcgtctcaaaaaaaaaaaaaaaggaatataaaacctggttctagtgaattagccacttaaaggctgcaccttacagttttgctcttaagtacatactaatttctacataatttcaagtatgttttatttctctgagtggtaagccacctaagtattaacttttatatttcttcagtggcccggaaagcacatagcagttagctaggttttcaggtacttgttcatgttttaaacctttaaaacattaaaattatagattaatgtgaacttaatttacactgcatttgttaactttttcagtttatattcgttgcatgtatgcatagtattgaatttaagacaaggaacaggaactatgggctatgtttaagataaatttacagaaggttatgtcagccctcttagaaataccctatttgaaagtttattatattcaaaaagaatgtgaatgattctctttcagctaaatcttaaaatatagaagtggttgatttagcatctcagttcttaatataaccatagcaaaacatctgatagagattataaaacaagtaaagtttgtttcttaagggttggggaatgttttaattctaccctatagttaagtgaaaaggaaaaataagactgctttggtatctgatttccaaagtttcaaaacctaagtagttgtttgctcagcattacattgtgttagtggttttgtctcacagaaacttaaattatcatgcatttttggatatttttgtttaactttttaaaagtacattctggtgtagctctgaacctctgaatagaaaaaaaaaaagtctattttaaatagattgaaaaagctacagctgcagattagccattacttttgggtatttcatgcatcgaatcagcaaatcacaacaggtgggtagagagaaaaggagtaaatctcagcagagcaatgctatttgccagaggcagtctatctggtgcctcagtagagactccatggagtgtttttttctcctgtgaagagacagggtggttaggcaaggagagtgtgatgtcacatgctggctgagaaatgcatattgcaatcaaaatgaaaacaaagcccatttggggaacttaaagcccagggcacaactgaggctggagagatgtcttattctccaagtcccaaacctaaggcaagacccaacagaggtttctggtcatttggaaagatgtgttcccctcaagcctcaggaagacccagggttaatttaagtaagcattagcatgagttaaggattagtaaataaagtaataactataaatttttagttcatgttttgtatattgtgtgtgtgtgtatatatatatacacacacacacatatatatacacattatatatacatgtgtatatatacatgtgtatacatacatatatgtgtatatatacattatatatacacacatatatatgtgtatacatacatatacatatatatgtgtgtatacattatacattatacatatacattatctgggacttggagaataagacatctctccagcctcagtatatatatcagtatatatatactatatatatatatatatatatatatatatacacacacattaactactaaatatttatatggtcattttcatagactttacttcctatagggaaataagtaattgaaccatgcaggatcttttgacccacttaatcaaacctaagtggatccctccttttcagaccacaaagttatagcccaggaaccaacgtcatatagataggttgcatgaaatcaggcatggtcctgggaagaggcagttccttgggagctgcctcacaaaccatagaatagccacaaatatcacacagccatactgatcagacgtttgcactgtgattcttctttcctagtttcagcacccatttggactttcacaatcagagatggcagcggtaaaggtaagatttttatttttttattttttttttgagctcgtaagtaaaaaaggtaaactttagtctttttttttatactttaagttttagggtacatgcgcacaacgggcaggttagttacatatgtatacatgtgccatgttggtgtgctgcacccattaactcgtcatttaacattaggtatatctcctaatgctatccctcccccctccccccaccccacaacagtccctggtgtgtgatgttccccttcctgtgtccatgtgttctcattgttcaattcccacctgtgagtgagaacatgcggagtttggttttttgtccttgcgatagtttgctggtaaattttagtctttaaagtttggtattctcattgcacgatggagaagacctaagaaatacaaaagtaaaagcactattgggtgcattcctagacatctcttaccccaggcatttaggggtggctcaggccagcaagttagtttagggggcagaaagggaaaaactaaagtctgtcatgcttgtcagtctagtgtggttcttagcaggccgttgctcagttggcagtagtcatttaattacagtgggtagagagggctaaggtgataaacatccagtcttctctctccctgcgtctcatctagaaacgatcactagccttcatccccacattataatgctccatagctttaattggctggcttgtgcataccttatgtacatggacttagcaagtgtgcatacacttggtgtccactgtgggcctggacctatctcacacaatattttgggcccagtagcctcctcatgtaggtaggtatttagcaaatactaagtaaatacctgttgggtagcagattaaacatttgaagatttctcttgaggataataaacactttggtgtccaccctccacctcctttcattttgtaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacgtaagttcaggcctctgtctcttcatgcttcctttccttgccctgccttttacattttttttctctaatatataaagtaattttataattcttcattggctagggtaatattccaaatccagtcctaagcctggaaaagctatggggatgctgtaccttgcttatgttagtttctggagttgttttagtataagacatttttttgttccagaacaaagcttatcctaatagtagttctactatttattaaccattagacactctaccaaatggagtgtgtatgcatgcatgcttgtgtgtgtgcgtgctctgatctacacagcagtccctcagagtattaaactcattttatatatgaggaaagtgaaccttaaaaaggttaattgacttgttccgtggtacacaactagtaatttgctgttaggatccaaaccaaatctgcctacctctacttcctgtactgctttctgtatactaggacttgtccctgagactgctaggttcctaaaatacttttgccattcctctgggacacatcttggagatgtccttggtgctagaggtcccaaatcttaaatagcatgaacctaaacagagtaacgaaatgcctggcacttacaactttcctgttggttctgcattgaggccctgtccatggggtcagagaattatgataaaggtcttatatcttcagtcaaaaacaggaattttctttttaaatttcttaccaccttactagaaagaactagaacagcttttgtgctctcctattaaaattcaccagaccatttctaagtacctctaactgagatacaaatgcttctttccctattataaccagtattcattctcaattttgttttaagtgaggcctaattgtatgacattttacctacaattttccaatgacacagaagcgtagaaacctgggaatgggagtttcattcctgtctgtcattgtcagcattttcctaatgatgaattagcttttattgatccccactggatgccaagaactgagcactgggctttgtataaaatattatatcctttagtatcttcgtccgtgattcttcactaaactacttgttcagatttttttgacttcctttcttttgtttaaactgtgtacttctttaagcatattagaaagtatatccagccaggtgtggtggctcacacctgtagtcccagcaactcgggaggatggcttgagcccaggagtttgaggctgcagtgagccacgatcacaccactgtactccagcctgggtgacagagcgagaccctggctcaaaaaaaaaaaaaaaaagaaaagaaaagaaagaaaagaaaaagaaaagaaagaaagaagtatatccaaacaaatacttttaagacagtactttctattacacacagaatacttttgcttgatctccagaaataaattttaccctttttaaaaatatagatacgaaacaaccattagtctaatatatacaacaaatgagaagcattggagcatgtccatgtttgggttggaatgctgtttgttacagcttttgacagagaaaatgggatggagatcgagtttattactcttgtccttaccagaaagtagaataacatgttttgcccactagaggttgatacttttatgatggaaattgtaattatggatggaagcaaatcccagtcatctcaaaggtgactttgaattatctgctggtttaaaataaacttgagttagtcaataaaaagtggatatgaataaaataaagataaaacaatgaaatgtgtccttgcaccaaagaaaaaatgtgaacggttcagttacagatattgttaacaaccatccctattcctccctcttgccattgttaggtagaactctaggtaggtaaacaaaatcatgaaaattacctgctaagtcatacttgccacttaatattattttgagtgaataaatgaagtctttcagtgtgaattagaagccttaaatcagaggttggcaaatcttacccatagagtgctacacttgcagtgattctgtgggacattttacagaatgagctaggccttgtgtgcattataaacttgataagcttcatctctgtgtttcatattatttccaaatctgtctagttactttacggctccaaattgcactttcatcatctgggttgaattgtatctccccaagaaagatacagtggaatcctaacccccagttcctcagaatgtgaccttatttaaagacagggtctttccagaggtaattgaggttaagtgaggtcattacagggatcctaatcctatgtgactcaggtccttataaaaagggcaaaatccggacacagagacagacacacatgcagtgaaaacaccatgtgaagattgacattatgtcgccacaatccaaggaacatccagaaggtgggagaggcctggaacagatccttccctagcacctttagagggtttatggccctgccaacacctcgattgcagacttctgacctccagagccatgagacaatacatttctgttgttttaaaccacccagtatatggtactttgttatggcagccctaggaaaggagtacaatcaccctgggagaattttctttgtccccaaatgcaatctgtgactgggacataaagtaaacccacagttcttgtcatctgtctgaaaaaactgtattacttatttgttttactgtgatctagatagcaaaccatcataaaagggaattttatgaaaacccttgcaacttccatcttgaacctcattttccagtattcatattattgctggcaacagtgtatggaggcagctgtggcagaactgcttgaatcacagaggtccagcctcactctaccactcgctgattagaggttctcgtcctcctgtaagccccctgccttcaccattctttgcctcagttgcctcacctatgaaataggatcctaattagtgggtagtaattatgaagaatccctaatgggtagtaattgtgaagaatccatgagataatatgagaaaagttatagaatggtgcttggtaccaagttggtgcccaataaatgttattgttacagttagttgctagtaacccatcctttaacatggattattaaccataaattggtttttctctgataccgtttgccttgattagtgcttgattgagattctgtacatatatatatatatatatatatatatttttttttttttttttttttttgagacagattcttactctgtcacccaggctagagtacagtggcgccatctcagctcactacaacctatgcctcccgggttcaagtgattctcctgcctcggcctcccaagtagctgggatttcaggcgccaaccaccacacccagctaatttttttattagtagtagagatggtgtttcaccatgttgtccagagtggtcttgaactcctgacctcaggtgatccacctgcctcggcctcccaaagtgctggattataggcatgagctaccgcgcccagctaagattctgcatatttttaataagatgttctgtgacttcagaaaggtcatatttctgctctgggtggcacctttcaaacttttaaactgatttagaatattaaagacatgaaagaatgaaagttttggtgtctatcaaatttagcaattaacacagtttttagttctgtttcaaggatattcttgcttgataaaatttaatgcagtaaagtacatggactgggaaaattaacccacttcaatattactaataatgtccctaaacaagctttcaattctttgtatttttaaaatgtgtagttacagcatgattcaaaactacttttcttagcgtctgtgtcatgctcctacagccttccctgaatgcattagctggtcccagggagatgtgagaattgtctggtgagggtgagaacagactgtggtgtcagactggaatctaaagacttcgtctatattagaagcagctgccagggcccgatcttgcaccagtaagaaaataatgggcaatagatcactagcattatttttttcagcagcacttttggtgagtacaggatgaacaactgttcttcaagcggtaatgaatgatggaattcatatgtaagtaatctgagtgcccatggcgctttccaattcattaccttcaccagaaattttcatggagggttagttacatacactgttggaaaaagctttaataaagagataagggacctgggtagtatgaataattggttcaagttttttgtttcattttgctctcaaaaccactagaagctacttattcaataaggacattttcagctttgaacatgaatgctttgaagaacacaggattttagaaaatgttactagcaagaggaaatgtcactaaatttgaaagatttaacttttcagtattattcacttccacaggaacatacaagttatgcaattcatcatcgcctgagtcttgtttaatattttcttaggataaaggccttcagattggacagtatgttcttttttgtgattgctactcagattccagatagtctctactttaacatatttcaaggataaaaaacaccaaaagcttgactaggataagaactccttttgtacagtgggaacatgcatgcttttgattatgtctgtcatcatttcctaacaagatatttccgttacttaaagcttcaatggaaaataacttatgagaaagtttacagttatgaagttttaaaggtcagctgtgttttcaattatttcttaggaaaaatgtttattattaggttaagaaaaataccattttgtagtcataagtgaccactggtcgagactgcaaggttatattgctaatacttagagggaaaatgagtggaagtcaccctcaaaagagagtaaggccctctgaaacaaacaccaccactgttttctcgggtttgagccaatcaggtatttatgacctatgttttgagggtgttggctcaaaacagggacatattctaaaagcttaaaccccattgggaagaggagacaaaatgaaatgtaaagtgacacatagaagaagagtgtctatggtgtggttcatggttatacatgcacatgaggggtagagccagtgacccaggcagtcaaaggaggagcaccgcggggcagctgtcaagaagtaaggtatgcactaggccaatttgagggatagggtcaatttggaatgagagaaaaaaggacttagttcactcccggcttagacactcaaagtgctgttcttaccagagagcccagatgtggttttcatatgcccagatgtggttttcatacgtttgaggggagacatctgctccattacactgtgtccatctgagtgggaaggctgagactgtagttttcatagtgagcctttagtcagtcaaacctagagagaacccggtgaagtttatggcccagtatttagtgagctgtcttgctttagtcaatgaggttgaaggatgaaattgcagtgattgagcacaatcctgacatgcgtgtgtgtttcatctggtgcagatattcacaggtgcacaaaaccgatcagtgagatgatacgtgttaatggctgtagaaaagtggaaaggaacatgaaaatgcacttctgttgtaaaagtaaaaatggcggttgtccagtaacttcaggattacatttgtcatggggcaagggatgtgcgacgaagagagaagaccagtctgaaatggctccagttctgctggcatgtacctgtgttctgggtggttgctgacaagccagaaatgaggcattcatggcatacatcaagtttgtgctttccctcggttgtgctacaattattcattttggcaaaatagcagaaaatataatcagaaagatgtactagtcctaggaaagtgaggggaaaaaacattctttgccacttgctgcctccatgctttatcctctaacatgttctgcctttgggctctatgtgtggaataatcttggatgaaagttttcctgctatataagattctctgaagtcctggtaactttccatgattttttttttcctttatggactattacgtgatgtgacattggtcacatcatgtagacaaatagattgatgtgaaaaataccaggattatgtatcctgaacccagatggaatccagtaaagcttttccttaataatacatgcctattgttcttgttttaacctatatgcatattaacccttgtattagcctcccagggctgctgtaacaaattacacaacctgggtggattaaaaaaaaaaaaaaaacagatttattctctcacagttctcaaatcaagcggtcaacaggaccacacgccctctgaaggctgtagggcctcacctcttccaacttctggtgtttcctggtgttccttggcttgtggcagcatcattccatctctgcctccatcttcatgtggcctttcccctgtgtctgtgtgtccttttctgtctcatacaaggactttgtcattggagttagggtccaccctaatccagtatgatctcatcttgatcctttaattacatctacaaagccctatttccaaataaggtcaccttctgtggttccaggtggacatggatttgaagtgacactattcaacccactacaatcctattttgaagctggaatagaatcaaaaaagatttctgattcatattaaaacaaattatcttgccaaaataccctataaaagtgtatggcaacattgagtcctacagctgtttccaataaaaatgaccaaaccctccatgacaaggcaactgttcattggcatctgaagtgtgatgtccgtactggtctgctttggtcagatgattttccatctggctggctgagcgctcaccttgttttgacagcaaggaaaactgccagtgattgagaatccgttttcgttggaaggaaggaaggaagcaataaatagaaaacagaatgagtggatgccttcaaactctgatactccattctgaggtttacttggtcccctaagtcagtacacgctaaagtactttcacatgctggctgtgaccatcagtgcacagcctgtctgcagttatttggttttaaactgactggttttcaacttgtagcctagccttaggactttttaaaaaattgtgtgagtaagtagaggcaaagcaattcgaatgtaagagaacagggtccgaccccaactcattggtgcccccccccatagcccctctgcctgggaggctctgaggaacccacagggaagggagttctgcccagcacctagtgagatttgagcatctgtttctcaatccccgagttgtcattattgttctttaacagcatctggaaggaaaagagctgtttacaaaaaaatcatgcatggcctttgagcattcatttgacagtcacttcctgagcatctgctttgtgtcaggcattgtgtcctctcaggtctgggggtacagctgtgagtaaaggtgacagtgcccttccaccataaatgacccccacagggtaggtcgcaggtgacaggcttcttgccctttagttcagtgttttagggccactgttcactatgcaggaaaccattaaacctccaaatctcttgagaggcaaggaggggataagggttgggtcttaaattttcatgaggggccaggcacggtggctttacgcctgtaattccagcactttggtaggccaaggcaggtggatcgcttgagttcaggagttcaagaccagcctgggcaacatggcaaaaccccatctccaaaaaaaaaaaaaatacaaaaattatccaggcgtggtggcacacacctgtagtcccagctactcaggaaaccaaggtgggaggatcgcttgagcccaggaggcagaggttgcagtgagccaagattgcaccactgcactccagcctgagtgacagagcgaaaaaaaaaaaaaaaattcatgaggaagcctgaatgggaatgaaaaacaaataagaatcaaaagcagagggctgtgtcttttatttttgtattcttacaccgtatgaactttattaagaactaaaatcatgtgatggtaacccatgggcacacgctgagtacaaagttggaaaattgtaccagcatcattaactggggttgctttgtgttaacattgtgtatcattcacagatgtcaacaataagagaacacatctctctatatataattgttacaaacattttaaattataaggaaaagaaaaaaaaagatgcaaaagttcaaagactaaactcacaacatcctaccgacagagaatacttaggatagctaagatctcagtgttcattcaaacttctaaactcaaagactcggatttatgcaggaagttgaacatgtcttgtgtcaccagatctgtcagtgaagctgattatagtcttgggataaatttgagagtaatgtgacagtggtctgggaactctgactgtgggctctgccctctggatgcagagactccaaggcactcagcaaacccacctgtgggatcgtctcctccagatagaccaaaaaaaaaaaaaaaaaaaaaaaaaaagagagccataggattggtaatgggtacaaggctgctcatagatggcagagggactgtgttgtgctaatgtggaaatgccaagccttcagaaaagtagcccttgaatgagagattctttagccaaattctacctttcctggaaagcctgggcagtgccatcagcccacccactgcctgctcaaggttcctagaaagaggcaagtgggaaaggcctgtatgaacttagtgactgaatatatctcaccagtctgtactgcccataccaagacccagtgtcctaggtcacccccgctcttccttctaaaagcacgaagctaagctttccttcaaagtcaggttcaatcatcccaggacagaggcaggagaaaaacagagatgcccccagggagaagctagtccccagcggggctttcaccctgacctgagtaccaggaacacacagaactcttgcggaaataagaagctgtcatggcggttgtcgagtgctttctctaacccactgtttggctcatccactcccacgccactccaacacaactcagtttagggggcatagaatttaaacacttgtgagaactgaacaacttatatgctgatgtttcaaacttggcagaaagaccaaaaattagaaacaaatgcttggtggcccccattcatttgcatattaggccaatattttggtttcattctgcattgcccaatgagttaatcatacattttttccatgggtgaggtagcagttacgcagcttttattgtgtttgatagtcattgggcttattcatataagcccttaggtaaaaataaactgtggatgttccaagacagcaatggccacatacatttttaataatgtttccaagtttataaaactccttccctccaatgccatgatgatgcttataaagagcaggatttatgcgagcgactatgcatggccttataaatatctttccattcacacttgattagctcactaccatgttctgttccatgtattagtacagggaggaccaacaatggaagaatgatttatatgattcttttatttccctacaaccatcttcactccttatctcgtggtgtttctcttgatagccatagtagccgtggatatgtgttccctgctgtcaatttctctcttgacagagtcgcttacaagagctatggaaattggctaaatttaaccttatgcagcattgtcttactgatacttttatgttgttgcagtttacataagaataaaaattatgatattgggacttgccatagtaaaaaacagagggaagagtaaattgaatagatacttcttgctttacaagaatccatttaaattagtaggattaaaagtatgtaatgataccacttgcagtttaacctaggccaacctatgaagtggaaagtcaaatcccgtagtgagaaaaccaacccattattgcagattttttgatatagcgggaagattagaagtcagaggccttaattccatttgtagaattgccctttcctcacccttcttccttcagcaagtgttgactcatttaacttttccttgcttggtatgatttgcatttcgaatctgtggaaggataatcaatcatccatcatcattgcatactgtgcttgctagcacttgttcttttccaggttacctaaaatcaatacctcttccaaaggagtgattttttccccccacatcacctcattcatggtggtaagcactgctcgcaacactggactttccaggaagctttttgtttccctgctggcctggggcagtgtttgaaaccaagcaagctctatcagccattcctagctgggcaggtggtgagtgggccgtgcagatgaaaagagagaacctcaggtgggttcatttctttcctgtgttttcagggcttgttgcagaggtttggtagtttggagtgatgagtttccttgtggctcttcaccatttctttttcttttttttttgacaccgggtctggctttgtcacctgggctggagtatagtggtacactgcaatctctgccccctgggctcaagccatcctcccacctcagcctcgcaagtaggtgggactataggcactcaactctttgccatttctctcagtgtataataaccccttggtaggtgaatgatgataataatctgcaggtcttgcctcaaaatctggtaagcatctcatctggaacacttgggcctggtttcacagttggaaagggaaagatgagggaccttagggggctgcagatggcatggccagcagcagcagcactcactgggctccttctgcagtgcacacacgtgtgtttatgttcatgttcacgttcgtgtttgttctcagggcggcagcagcagctggatgcagagcgcctggacagctatgtgaacgctgaccacga

SEQ ID NO: 5499 - DNA, 7067 bp, human
atcttctgtgatagggttattattgcatgtacagagagattccttggaaccgcatatgactcaatctatctcactcagatttctcaccataccttcacttattttgctgcagtgtccagcagatctccttgaaacagtgtgtactgaagacctaactaaatcctccaaattacctggttggttcagagaaccaaatcactggagctttgtagggaaggtttgactttcagggctttagccagagtaacttatttaatgattggcttttaatgtgtttctgtgcaaagatcaaagcaggtgaattttcatgtatttttagaattctagtagaaaaggaagataggaaaatctagttcaagtatacattctagtttttaggggaatttgtgtttttattttacttttttggttgctacgatttgtcctatattctatatttataagaacataaatatgtaattaaaagaatatatttgatggcactacctgtcaacaaagccacttatttgtgaaattttttggtaacttgatggaaatagtcacattttatccattgaaaactacaaagctcttatctattgttctttgtgtatatttatgcattaaaaatagatcctgcaggatgagcagatgtactgaagtgtaaatccgttttttaagagaggctatatggaaaaatatatcattcaagactcagtctctgccttgcctataggcctcgtcagtgtttagtgaatgacctcaaccctgtttttttccttccttctttggtggttgaggacagacaatgaatggtctctgtactcgcctgggctcagctgggtggtggccattatgccattgtgctcactggagagggctgccgggtttgtagagctgcggatcccggccttccctgacattgccaatctcttttctttcagctccaccagcccattggagaaaagttactgttcagtccctgaaggcttgtgccataaaagagtgggagacattcccagggaggtgaggaatgaaagatcgaattaaagaccattaaagaccaaagggcatctaaatctgcagcaaccatcagctctcttttctttgagaggtagtagtctctgaaggtgttgctgtaatgtctataattatttagatgttggcttttcagaaacccaggcattcttattagctccttaagttctccatgcgtgaagaaaataaccagcttaaaaaagctaatcggacctatctctagaagaggacctcttcttcccttgggagctaactgatattaactgactaactgattgcttagcaggaaagaatatatattctttccagggaatagagattcagagctctgtcctgtttgctttctaagccctgctgattgatatggttttgcagaatttttattgttatttttagttaagtctttaaatgtttatatggatatttaagaaaagatccaatttccttatttagtcatggagagtgtttttttgtcccacatattagcaaccggtcaacatgattgctattggtcatagtcagttttcttgcctccactagtctttctccaaacctaatcatttatgaaacgtgtgagaatcgtgaagttcgtctactgattcccaagtggaaactgaggaacaattaggatgctcagtatattcagagagaatctatacaacttcaaaatgtgttaacatgaaacaggggtgggcaaaataaaagcccacagcctgttttttgtacttcaggaagctaagaattgtttttacatttttaaagggttgtttggtgtgtgttttttttttttttaaagcaaagaacgtgaagactatgcgacaaagactgtatgtggcccacaagcctaaaatatttatctcgccctttactgaaaaaaaattgctggcataaagtaataatactggaaagacctagctaaaaataattataaagctctatgcaagttgctattcctttaaacatgtttttctatgccttatttgacttttgagagacgaatgtgtaattcttcaagtcaattattcaaattggttaatttgaatataggattttaggaatcttaaaaagacttaaaatgtaaaaggctattacaagtacaagtacattttgggatttagggagagaaaataataaagccaagagtgagatgagcacagtctacatacagcctcaggactttaaacttgatggaagatggcagcaagtttgattataaatgtcccagtggtcaaaactgtgaggaaagcataatcaaagcaaagcaaaattgcctacagagtttcttgcactccatcattaacataaattcatcctttcataatgtcctgggtcttaagagtctagcaccttagctgatgaattaatatatttaattaatgtagatagtgggcactctgggcttattctgaactgcctctggttcagaagctggaactggctttcttcagtcatctcaaatgattctcttggcttctttcttgcataagtgctcaggatgtacctgggtgatctctgaggccttctaacatagcagcccttctaccagatgatttgttggatcaaagttacctctcctcaaactagtgctccctccctcttctttttttttttgtttttgtttttgtttttgagactgagtctcactctgtcactcaggctggagtgcagtggcacgatctcagctcactgcaacctccacttcctgggttcaagcaattcttgtgcctcagcctcccaagtagctgggattacagatgtgcgccaccagacccagctaatttttgtatttttagtagacatggggtttcaccatgttggccaggctggtcttgaactcctgacctcgggtgatccacccacctcggcctcccaaagtgctgggattataggcgtgagccacagtgtctggcccctccctctaaatcacagccattgacatttgagcagcctggagaacatcatcaattacccttgaactccttaaaatggtagtctactttatctcacatgcctaaacttccagctttgcaaaatggagcctctcttagccatctggtggattttcagaatattggtgctacaacctttaataccacactggattttcccaattataactaaaaacaagattttgtctatagtagtgtttgatctcaatggtgtttattccatatttgaggctatcacacttcccagtttggaataattgatattttagttgacctggttctaaatgccttatgatgcgtagaaagaagtctggattcaaaacacttaatttccagaacacatgcagatgtctcctagacttttctaatttaattcctgtgctgcttgttaatctataaaacaaatttgattaagatacacatgcagtttgcgttaatgtcattatgtgctgcaggctctcagaaaattattcagattttagtgataaaaatataaaacctgggccgggcacggtggctcacgcctgtaatcccagcactttgggaggccgaggcgggcggatcatgaggtcaggagtttcgaccagcctggccaacatagtgaaaccccatctctactaaaaatacaaaaattagccaggcatggtgccacgcgcctgtaatcccagctactcgggaggctgaggcaggagaatcgcttgaacctgggaggcggaggttgcagggagcagagatcatgccattgcactccagcctgggtgacagtgtgagacttcgtctcaaaaaaaaaaaaaaaggaatataaaacctggttctagtgaattagccacttaaaggctgcaccttacagttttgctcttaagtacatactaatttctacataatttcaagtatgttttatttctctgagtggtaagccacctaagtattaacttttatatttcttcagtggcccggaaagcacatagcagttagctaggttttcaggtacttgttcatgttttaaacctttaaaacattaaaattatagattaatgtgaacttaatttacactgcatttgttaactttttcagtttatattcgttgcatgtatgcatagtattgaatttaagacaaggaacaggaactatgggctatgtttaagataaatttacagaaggttatgtcagccctcttagaaataccctatttgaaagtttattatattcaaaaagaatgtgaatgattctctttcagctaaatcttaaaatatagaagtggttgatttagcatctcagttcttaatataaccatagcaaaacatctgatagagattataaaacaagtaaagtttgtttcttaagggttggggaatgttttaattctaccctatagttaagtgaaaaggaaaaataagactgctttggtatctgatttccaaagtttcaaaacctaagtagttgtttgctcagcattacattgtgttagtggttttgtctcacagaaacttaaattatcatgcatttttggatatttttgtttaactttttaaaagtacattctggtgtagctctgaacctctgaatagaaaaaaaaaaagtctattttaaatagattgaaaaagctacagctgcagattagccattacttttgggtatttcatgcatcgaatcagcaaatcacaacaggtgggtagagagaaaaggagtaaatctcagcagagcaatgctatttgccagaggcagtctatctggtgcctcagtagagactccatggagtgtttttttctcctgtgaagagacagggtggttaggcaaggagagtgtgatgtcacatgctggctgagaaatgcatattgcaatcaaaatgaaaacaaagcccatttggggaacttaaagcccagggcacaactgaggctggagagatgtcttattctccaagtcccaaacctaaggcaagacccaacagaggtttctggtcatttggaaagatgtgttcccctcaagcctcaggaagacccagggttaatttaagtaagcattagcatgagttaaggattagtaaataaagtaataactataaatttttagttcatgttttgtatattgtgtgtgtgtgtatatatatatacacacacacacatatatatacacattatatatacatgtgtatatatacatgtgtatacatacatatatgtgtatatatacattatatatacacacatatatatgtgtatacatacatatacatatatatgtgtgtatacattatacattatacatatacattatctgggacttggagaataagacatctctccagcctcagtatatatatcagtatatatatactatatatatatatatatatatatatatatacacacacattaactactaaatatttatatggtcattttcatagactttacttcctatagggaaataagtaattgaaccatgcaggatcttttgacccacttaatcaaacctaagtggatccctccttttcagaccacaaagttatagcccaggaaccaacgtcatatagataggttgcatgaaatcaggcatggtcctgggaagaggcagttccttgggagctgcctcacaaaccatagaatagccacaaatatcacacagccatactgatcagacgtttgcactgtgattcttctttcctagtttcagcacccatttggactttcacaatcagagatggcagcggtaaaggtaagatttttatttttttattttttttttgagctcgtaagtaaaaaaggtaaactttagtctttttttttatactttaagttttagggtacatgcgcacaacgggcaggttagttacatatgtatacatgtgccatgttggtgtgctgcacccattaactcgtcatttaacattaggtatatctcctaatgctatccctcccccctccccccaccccacaacagtccctggtgtgtgatgttccccttcctgtgtccatgtgttctcattgttcaattcccacctgtgagtgagaacatgcggagtttggttttttgtccttgcgatagtttgctggtaaattttagtctttaaagtttggtattctcattgcacgatggagaagacctaagaaatacaaaagtaaaagcactattgggtgcattcctagacatctcttaccccaggcatttaggggtggctcaggccagcaagttagtttagggggcagaaagggaaaaactaaagtctgtcatgcttgtcagtctagtgtggttcttagcaggccgttgctcagttggcagtagtcatttaattacagtgggtagagagggctaaggtgataaacatccagtcttctctctccctgcgtctcatctagaaacgatcactagccttcatccccacattataatgctccatagctttaattggctggcttgtgcataccttatgtacatggacttagcaagtgtgcatacacttggtgtccactgtgggcctggacctatctcacacaatattttgggcccagtagcctcctcatgtaggtaggtatttagcaaatactaagtaaatacctgttgggtagcagattaaacatttgaagatttctcttgaggataataaacactttggtgtccaccctccacctcctttcattttgtaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgac

SEQ ID NO: 5500 - DNA, 38785 bp, human; identical to SEQ ID NO: 3115

SEQ ID NO: 5501 - DNA, 18603 bp, human
aataggagaaaaaacaggcaagaaagaggacagcacacgagtatctgaagaaaaggttgaaatgttactgtaataaaagcggaaataaatttctacacaggtaagttcctaaatgaaacacgtgggtttagtggaaaaaatgggagtagtccaaattcaattcgctgaggcagaaaatacgattaacttgatcaaactgaaatggagaaagcaagatataaaatctgaaagctaagaataaatgaacaaggagcctgggacagcagtgaggcaggcaggaaaatgctagaagccaagaaactttgagaagcaagggaaaagggagaatagtctacagtgattctgtagaaaaactagcccagaatggccaactgcaagcactgactgaattattggaatttttgttcacacttttttgagaagatatcaatgttctgatagttccccagaagcgttctctctgagcgcattccgagaatggaaagaattcactgaagactcaggagatgagacccagaaaaacaattggtctaaaggaatgtattgtctttgagaaaaattggagaatcagaaaaaattagaagaccaaagatgcaggaaagatgttctatgtttcaaaaagattggaggagggggtggatttcataatggtaaagggaagtttgaccttaacacctagtaaagctataaagtaaatttttttttttttgagacggagtctcgctttgtcacccaggctggagtgcagcggcgcgatctccgctcactgcaagctccgcctcccaggttcacgccattctcctgcctcggcctcccgagtagctgggactacaggcgcccgccaccatgcgcagctaatatttttgtatttttaatagagacggggtttcactgtgttagccaggatggtctcgatcttctgacctcgtgatctgcccgcctcggcctcccaaagtgctgggattacaggcatgagccaccgcacccggcctaaagtaaaatttttagaatgtgatttgcacttggaaaaatatatctctggtccattaggaattcactaggaataagtcagatgctgcctgccctatctcctctctgatagaatacaatagtaaaaaaatatatccaaagacgtagtgtatcttccttttcaataagggatttaacagaatgtaaaatgctatgactagacccaaatgtcccctgaaacaattacacagtacaggattaggcagtcctctggtaaacaacaattcatgtccaaaacaacaagaatcttgcttcaatcattgtttattgaatacctactatatgccaaacactattctagattttgaatgtaagctaataaatattgtattatatgaggtgacaatagaaggaagacaaaaatagtgataaatgtcatgacttataataagcaagaaatggaggatagagaattatggggtggggagagggattttctataaggagggcctctctgagaaggtgacgtttgagcaaagaccggaaagaagtgatgaaagttgtgcggatctctgggtgaagaagttttcctagggagagggagcagcaagtgtaaaggatgtaggcagatttcaagaacatcagaggtctttgtgactggagctcagtgtgcaggggaaagtggcaggaggtgaagtcaaggaagaagctagggtcacaccagggaggtcttaaagacaattaactgtgagacttcagctttactctcagcaacatgggaagacactggaaggcttcaagcagagaagtgatctagtagaagctttagcagggtcactttggctgctgcttagagaatggacactaaaggggtaaggatggaagcagggaggctagttaatgagctactgcagcagcccagtcaagctggttgaataaaagcttagtatgagcttcaagatccaactaggaggcccagtaaaaattactgggcctataattacatcttatactatattagactttgctaatataagcattagatacaaaataatctagactataacattcatttctgtgaaccacaattttagagacgcacaagagagcatccagaggaaaataaataggagagcagatggatctaaaataatataatttggagaatggtttagatatggaagagaagacagggtggacagctttcttccatcatggtactgccatttagaagaagacttagcatagtggatttactctgccacttgttagctgtgtgaccttaggcaggtaatatcctccctgcacctaatttatttcaaggccaatgatagttttatatccatttcatagggatgtcatattacttgaattaatacataagaacacagagagtaatgttgtaagcctagtaataaaagccacagaaaatgaaaggagctgtgtaataattagagaacttccacactggaatgtttaatcaaaccatctgcaaggtcatctttcagagacactgcagcagacagagactggctgggagtttgactcaaaggtctgtttggactataggatcctgcattgtaggagaagtctgctagtttgtgctgaaacagcaggatggaggagctcaccaatggaatgagtagagtcatatatgaaaggaaaggggagtcagccagtagtctacatgagcccagccatagagaacctctcagcgtgctttcatcacccagtcatggtcaggtcctggtataaaacttcctacatacagagaagagaaaacttgagtctgtcacgctatcttgaggaagaaggggaaagtcataaaggtaaatgactccctctcaatatttacagatgttgtatttgttggttgcatatgctttgtacctgctcctgtatataaactcttcacaacaactttacaggtagaaatagtgagatccattttataattaaggaaaccaactgttcccatgattaattcaaacttccacaactgataggcaatggggctacattttgatcccagattgcttaagagaccttttctctccacagagtcatgggttcagttatctgctaacttcatgcatgtctaataagtcctcatcaatctgtcatattctgagaataagcaggtccccataagcaaaattaaaatgtactgctttgattacaccagttatacatttttaaaccgttttagttagaaatttttcttcaatatattccatcccgatcgcgatgctgcctggacattagtttagggttatatttcagatgactcagtgtcatcatcttaaataatatttactggctaagctataatgtgacaatgtcttcaaggctttacattaaatgactcaacagctttattgctattaattctgctgtttctgcacattctgagttcacagtcacagtatcaactttcagtagccctgctctccacaagtcccctccctgtttctgatctgctatctgctaaaacctaaatggaaactagataaccatggagttcaactagaaacctcccttttcataggctgaaatccgagggtgggtctttattctgctagagcaaagtacatagactttgaaatccatatttcccttactgttcaactttttatatccttccaactgagtcacaaatgctgaggttgccaaatagctataggagaaacctcttccagttccccaagttgggtggataactttggtaaacatcagaaaagaaaggatgttttgttcaatttcttattgattaatactgctgacagaacaaggaagggtatcaggaacacaatgcatagagaaattcaaaactttgcatggtcaagaactatttgcattcagtacaattgattttgaccacatgtttatcacacaaagtgaatttataagtgctttatagaaaataaataactagttgggctttcagcccaaaggaaaagctaaagctctttcctgtttacatttttagttgcatagcagtcccttttttcctaaatgtaaaaagtaaagtagaggttcctcttcaaagactttcctccctgtctaattaggaataaataatagcttctcttagaagcaaaattcattcaaaaacctgtgctaacattcttaaatatctgctagccataataaaaaaaaatcaatgtactttatgttcttagctcccacaatttaacctaaatatttgccctggcatccttaatactgctccaaacaagcattaggtcatagcctgttcctcttccttatttgaaggggtttttacctttctcaacattccacaagttacttcctccttcctttgttctcctctgcctttgcctcttttaaaaagttctaagttgctagccagtcaagacaaacacaaaatgtgaggtcccgttccagccaataagaaccagacacaacagtagggtagacgcgtcaagttataaataaccctatctcctttgttcggtatactctcgtaacaaaactactggcaagtggaccctttctacagaaagtataaaaatagccttactaaaaaaaataaatctatgttcaaatactatttatttatggcaccagaaaacaaacatttcaaacactaaagatacagcaaagataatcttcattaaccaaactgataaacagtttcaatagacagagttcaaatttgtgagaataaacattggattccaagaaggttatactgattgttactggcctgaatttatgatagtacagtgcctgccacagtaaccgtaatttattttgatacctatactgtacaaaatatcagatagcactagagcaaggaactcactagtataaatttacatctaagactttagaagcaaaacatgagcatttatcctaagtgagatgggatgcatggtagaatttgaacagaagagttacacgatatcacttacatttaaaagaaatcctgggccgggcacagtggctcacacctgtaatcccaacactttgggaggccacggcgtgaggatctcttgaacccaagagttcaagaccagcctgggcaacatggtgaaacactgtctctactaaaactacaaaaaattagccaggtgtggtggtgtgtgcctgtagccccagctacttgggaggctgaggtggtagcatcatgtgaaaccaggaagttgaggctgcagtgagccgtgatcgcaccatggcactgcagcctgggtgacaggagtgagaccctgcctcaaaaaaaaaaaaagaaaaaaaaaaaaaggaatccctctggccactacatgaagaacaaaccacatatggggcaagactacagtcagagagaccactgaggaagctgttgcaataatccagatgaaatataatggtggcttggtggtaacagtagagttgatgagacgtgattggatttttaatacattttaaaagtaaagcaaacaagctttgctggtgaattggatgtaggctatgaaagaaagagtcaaagatcactccgggtttttggattaaacagctagaaggatgaaattaacatcaatttagatgagaaagattgctggtaaaataggcttaaagggaagactgaaagtttagttaagtttatgatatctattagcaacccaagtgtagatgttgagaaggcaattggatatacaaatctggagtttggcagagaggtcaaggatggagatacaaatttgagaattgtcagctagagatggttactcaaatattgtctctcagctaaaactaaaaagaaaatatcttacctcttcaaaatcccagtgtactgaaaagtattaaagtctagacctcaggagggaaattggaaggataaatagtgggggaaagttacttgaaacaactctccttaaaagagacatctgtgaacagagacctcagaaataaaaccacacatctacaaccatctgatctttgacaaacctgacaaaaacaagcaatggggaaaggattccctatttaataaatggtgctgggaaaactgactagccatatgcagaaaacagaaagccgaccccttccttacaccttatacaaaaattaactcatgatggattaaagacttaaatgcaaaacccaaaaccataaaaaccctagaagaaaaactaggcaatacaattcaggacttaggcatggcaaaatatttcatgactaaaacaccaaaagcaattgcaacaaaagccaaaattaacaaatgggatctttttttttttttttttttttttgagatggagtttcactcttgttgcccaggctggagtccaatgactcgatctcgactcactgcaacctccgcctcccaggttcaagtgattcttctgcctcagcctccctagtagctgggattacaggcgcccaccaccatgcccagctaactttttgtatgtttttagtagagacggggtttcactatgttggccaggctggtctcaaactcctaatctcaggtgatccacccacctcagcctaccaaagtgctgggattacaagcgtgagccaccatgcccagctcaacaaatgggaactaattaaactaaagagcttctgcacagcaaaagaaaccatcatcagagtgaacaggccatctacagaatgggagaaaatttttgcaatctattcatctgacaaaggtctaatatccagaatctacaaggaacttaaatttacaagaaaaaaacaaacaaccccatcaaaaagtgggtgaaggatatgaacagacaattctcgaaagaagacatttatgtggccaacaaacatgaaaaaacgctcattatcactggtcattagagaaatggaaatcaaaaccacaatacgataccatttcacaccagatagaatggcagttattaaaaagtcaggaaacaatagatgctggctaagctgtggagaaataggaacgcttttacacgctggtgggagtgtaaattagttcaaccattgtggaagacagtgtggcgattcctcaaggatctagaaccagaaataccatttgacccagcaatcccattactgggtatatacccagaggattataaatcattctactataaagacacatgcacacgtatgtttattgcagcactattcacaatagcaaagacttggaaccaacccaaattcccaacaatgatagaatagataaagaaaatgtggcacatatacaccatggaatactatgcagctataaaaaagaatgagttcatgtcctttgcagggacatggatgaagctggaagccatcattctcagaaaactaacacaggaacaaaaaaacaaacaccacatgttctcactcataagtgggagttgaacaatgagaacacatggacacagggaggggagcatcacacactggggtctgtcgggaggtggggggtaaggggagggagagcattaagacaaatacctaatgcatgcaggccttaaaaactagataatgggttgataggtgcagcaaaccaccatggaatatgtacacctatgtaacaaacctgcacgttctgcacatgtatcccaggacaaaaaaaaaaaaaaaaaaaaaaaagccatctgtggaatgaacaggaaggagaaacgggagtttcaggatcttggccagagcattgtagtcctcactggtttatggcaaagtagaaacatctcagaagaacagggtggttaagttgaggcaaggtgccagttcaggaaagtcagctgacatgacagatagtcaaagtcaagggcttagacgcaatccaggtcaaggctgcaacactggtgggcatttaaggcatagaagacttattgtggaaccagctctggcatctcagctagagtctgagggtgaccgaagaattttagactttggtcaatgcttcctaattgactctaaatatcttagaaaacccctttattttattggcctccacctcagtctatggattgtgtatgagtcatgttttctgatccaactggaaatgttcaacagtagttgtcttcttgaggtctagcaggctcatcttggacacctcattgtattcctccctcctcgtcttctaagggatttgtctggtctgagccatcagtggagcttggtcaaggttagttacagactccaacctcaaccttcctattcactcgtagagtcccttctatcaagttggaagaagagacctcacagagaactaacagaacaataactcaatagagccagttttactaagtccagcattggtcccaggaatgctggtcaacgttataaagtcccaattttactaaacactgtttttgcctcctgtcaatctgacgacttgaatttttttaaatattatgattctcttttttaatgagtcaagagtaaagctcaagctacccaatcaactaattaaaatttatcctccctatcaccactacatacacatatagtggcactatttatacaacttccatcctttattttttttcatgacaccaccatctgctacacggtactcataattacatgttttactaatgtattcctttattatctgtctctccccactaaaatataagctccaagagggcagaaacttttctctattttgttcactgctatatcttcagctgcttagaaaagtggctggtgcattataggtacacacaataaatatttattgaatacagacattgttcagcaactcagtagtaaggaggaagaagagggaaagctcagttgtctaccctgtgtgtagcataattcattttcatatggcatatttcatctgtttatttgcccatccacagaatgtgatggatagagattagtatcaactgaaaaaaaggtggaaaaattttctggaacaaaatgagatttggaagctatgattcaagttactatggtaaaagacgtgagagaaaaacagcatgattactgtaagtcaggcattgggctaaatgccttacatatgttgtcactgaatccaccaaatgaccctgtaaaaatggtattgttactaccttctcatagatgaagaaaatgaaaggcccaggcgcggtggctcaggcctgtaatcccagcactttgggaggctgaggagggtggatcacctgaggtcaggagtttgagaccagcctggacaatgtggtgaaaccctgtctctactaaacatacaaaaattagccgggcatggtggtgtgcgcccgtagttccagctactcaggaggctgaggcagaagaatcgcttgtacccaggaggtggaggttacagtgagccaagatagtgccactggactccagcctgggtggcagagcgagactccatctcaaaaaaaaagcgggggtggtgagagcataaatgaagtttacctcaatcaagctgcttcttctcgcaaggtcatactattatttactaagtagccaagccaagtgttgaacactggttagtcttttccctgagccagatatctcagcccacagttaatgttttaggcaacaagagaaatgaggaccctccagcattgtatgaaaagaaccatatttatgttgcaactaccatgatgccaaagctcactgatgactgaaagtgggtgtcaaggaatgaggtcacagcaatggaaatccctccagttggtttcactaataatttttattttataaaaatgtattctgaaatttattcacctactttttattttaatatgacattaattcttcactcctacccaatgctggcccatctgtggccataaactagaactgattttcccatagttgtggttatcagaatccctagatggtgagattgttctaattgggatatcaaagtggaatattccataaaataatagtattctaggatataaatataaaatggcatataaaaataagtattgtagatcaagattcaggacatgtaaacactctttaaagtgggtcagcaaaacatagggctggtaattctagcactgctaatttattccacaatctggagggctctgaactcaagaggttagaatgctatcaagagtccatgccattccttgaggagctgctatttattaagtgtggtcctaataaccagccattaacttcagcaaagatgagatagtcaagtagtcacagacacatgcaaagaggccagaatactggctaaaccgagaagctgttttggcagccatggtggatgcatttttttcccaaacaatgtatcaagagaattaggataagatgattatgacttggagttctcagacatgccactcctgttaacaaattgttatattagtacatcacaaaaataatatgccaaaagtcctgagagagaaaaaaaataatgattgcaaagacagaatggcatggcagaatatatgataattattctacaaagtataaaattctctttccatttgtgcccctctatgacacacaatgtcccagataagaacttattaacaccagtggtgcatgagaaattgtaagcttcaaggctgggaactactttggagacatcagatctctggaaaggtagaaggacccgggtgaggctcagagggaagcttgctggtctggtctatagtaagagaagggatcttaattggggctttgaagttttgctctagattattctataagactggtcccctgcccaaggatgctattgtttatttgattgaaggactcctttgttttccctgtatatagaacctaagcaagtggttagtgagggagatgtgggggaagatatcagaggtcatagaaccatctcatttccaaaaattacagacatagggaatgcgtaagttactttgtaaattttcaggtgcttaatatctgaacttcaaagaggaccaatctgaaagtcaaaagtcaaagggtaagggctttaattttatgccacatgaatacatgcacttgaaattataagaacttttctgaggtcttatcgtgtatcatattttaaataaaaatcccttggtttttgatgatgccagagatgtaatgtcacaatgataatgtcacaatgaatatataaaaactagaagctaagttgtgtaagagctttactcctacttcattctttgccaccaaagaccctcctaagatttaccaacttgtcttcaatcccatcaggagtgttctttggctgcaaaatatgttcagtgcctagaaattacacagtgcaaattctagggaagccttgcatcttttctggggacagtcaaaatgtggtaggtcttaataatattaatttggattcaatgcagaaaggaattggggccctgttgccttgaaatttggatattgccatcatgctacaagatgttatttttagatcttggtgattaccagtgtttttcaacattggttgaaaggcaaacaaggactgagcaacctctacaaggatgaagtaatgaagcaattataaaaattggaaatttgagaacatacctggaggaactctcatagtgagtgtctttctctgcttagccttttcactggatttggtagttggtattgtgcaaagcttttttgaccttcctagatcatctttatgaattttgcctcagtcttcaggggagcttccatgttagtaccaatatcatgctgatgtctctacctactgactacatatgaaataaccagataagagaggacaagaggaggaggaaattctgataagagaggagagagttccccaaaccactatccaattttgtataggtatatagacccccccaagtggtgttaacaactatttacccaatttatgaggtggatgagaaaatgcaaatcatgtagaacatgtaatttatggctcacacatccttgtgctattgggaaattttattcagatggcccagataaaagataatgtgaataagctttgatctataaaattataagaacttctatgatttcagagataaaagaggtcaaagcgggctcatggagtccggcaggctttctgacggagatgagactctgaattatagagactactactacctctagcaataataatatccaaactttgttgagtgattattatgtgccaaacagagtttaactgctttacatgtgctcccttattaaatcctcacaaaaccctatgaggtgagtaatagcatcattcccattttttagatgaggaaaccgtggcacagaatcaaggtcacacagctggaaatcaatggaactgggatttgaaccttagcaatctgtcctcaggcccagaatctttgtagtcagaaagggctttttgagagaattcttatcagagacatgaaggagagggacagttaaagcataaggaagcataaaaatctttggttccatgataacatcaaacttacatgaattacaaatatagtttgtccttgcatttcttatactgcattttttctttttgattttcactgaaaggagacaactggtgctctattctatcttggtaataggctatgtttttctcagtagggtcagaatattcaggatagagagtaattagagatcacagactcacagatgacaacctcagttggtatggcagtaatttatgctcttcaaagcactatatcagagatatagaacaggggttctcaaccagggtgattttgtctcccaggagacatgtttggttatcacactgaggggagagtactactgcatctagttggtagagaccagggatactacttaacattatacaatatgcacgacagcctctcacaaccaagaattatttggccccaaatgtcaagtaccaagattgaggagctctgatctacatagtggtacaaacatagtgttctcaggaactaacgtgtgtgcatgattccacctccccacatctcagtcagggccaaggagaatagtaaatcacctattcctagtagcaaagctcccaaggcattcaagcacgaaatagctaatccttttggacacgtatacgtatgtataagctgtggtctccataacaagtagaagaaatcagaaataggccaggcacggtggctcacacctgtaatcccagcactttgggaggctgaggtgggcagatcacttgaggtcaagagttcgaaaccagcctggccaatatggtgaaaccctgtttctactaaaaatacaaaaattagccgggcttggtggcacatgcctgtaatcccagctacttgggaggctgaggcacgagaatcgcttgaacctgggaggcagaggttgcagtgagctgagattgcaccactgcactccagcctgggtgacagagtgagactccatctcaaaaaaaaaaaaaaaaaagaaagaaagaaatcagaaataactaaataaaacataaaatatcagtccaggtaattagccctgactagaacaacacagtggggataactaaaacttcaagtatttactacattcagggcacaaatgtaccttacctcactgagtgttcacaaccaccttagaggaagttgttatttttcaaatcctcagcaaggttagtaactagctctgtgtcatccagtaagagaactggggtttaatctgtcagtgtgttttcaattgcaacccctgcctctttctatgggatgtggtaaaggttccgaagagctagtaaggttattaaagaagaaaataattatcattttaaaaaatagatgaaaatgacagagtacttttgccttgaaatttgttgacgtcagtacataggagatattgcccagatagctgtttcttgcaagaaaagaacaggaggaaatgtactgaaagaacacagtgaaacctcatgtttagtcttcagggagaatcacttcacagtttgaaacattgacgcagactactgaaggatgttgtgtaatctgcgtctctggagggtttatagaatagatgctctgctggggagggtttgagtgtggccctgaccaagggcaaggacatgggctgccagggctccactcaactgcttctctggtaataatccctgaccacagcccagtgtggcctcttcccccgcccctccaccatgcccactcccactttgtgaggaactcagttcaataggcagtctagcccaccttgcattccatctctaacagtctgatctggtaggtcctctctcttttcattcccaaccctcccaggactccatctctccaagccctttataatgttagttttgaagcgttagatcaaattggtagatatatgggtgttcattgtactgttcatccaacttctctttatgtatgacaacttttataatgaaaaatagtagggggttcacaggggttgagaaaagattgtgtggggcctggttaccatttaaagacttcggcttctaccctgggagagatgaggagatatggagaagtttgagtaaaggaatgatatggtctggttttctgttttaacatatgtcagggctttctttctctacttaaacctggctcaataccaggaggatgaggagtgttgtagttctcgacatagtcttgccagagtctctgaaatatgtcctgcattactcacaagaaaagcataaacagccgggcacagtggctcacgcctgtaagcccagcactttggcaggccaaggtgggtggatcacctgaggtcgggagttcaagaccagcccggccaacatggtgaaactccatctctactaaaaatacaaaaattagccaggcatagtggcatgtgcctgtaatcccagctactcaggaggctgaggcaggagaatcacttgaacccgagaagcggaggttgcagtgagctgagattgcgccattgcactctagcctgggcaaccagagcgaaactctgactcaaataaaaaatgaaagaaaagaaaaaaagaaaagaaaagcataaacaagaaatggcttcaatcaaggtatagcacaggaatagccaacaaacaattgaccagagtgctatgtaaatgctaaggcacaactataatctgcattttaaaatgtccagttgtgaaatacacccaaattgtctaagattctgatttctctctatgccactgcccatggttctgtgtttggtttggatcaatactcactctggcaaccacactgcacattattcagtcatgagtttgcagacattccaatcccagttcttattctccattgagtatacacctggtatggtgaagatgatatcttcaagttattccaggaagaggagttgatgactgccttagtccattttgtatgtctataaaggaatacctgaggcggggtaatttataaagaaaagaggttttgttggctcatggttctgcagactatgcaagcatggcaacagcatctgcttctggccaggatctcaggaagtaaaagctttttggatcccgacccaaatggtggaaggggaagggtgagcaggagtgtcacatggcaagagagggagcaagaaagaggaggaggagaggtgccaggctctttttaataaccagatcttgcgtgaattcactaccatgcgggaaggcaccaagccattcatgagggatctgaccccatgacccaaacacctcctactaagccccacttccaacattgaggatcatacttcaacatgatatttggaagggacaagcatccaaatcatgtcaatgacaaagtattttttaaatgggcataaggtaaaaatagaacaataataatttaaaatagaaacaaaaacaatcaatcactatgaatcctataacacaacctatgaacatttttaaatgctgtatgatttcaggcaacatatttaaatttgcttagcctctgtttcttcttttgttgaatgcaattagtaatacttgccttatccctttggatggagatccaaagagatatgatatccatccaaagggataaggcaagtattactaattgtagttagagttaaatgaaataatgaaaaacagtaagaattaatgaataaaatgagacctgtgaacaatacaaagtaatattgaaactactcaagtccacaaactaaaggaaaaaaaagatttatttaggaaacatattttactttatatataaatattcatatcctcaatgactaaaccttggaagttagataacctatccatctggaaagacacatagatctcgcaggaaggtggtagaagggaatacgtagatttatcaggtatctatttgaattcttagcacaaagataaaaagaactatgaaactatgaaaaaaactgccaagtacattgatttctaaccccccacaataccctcaacttcccacctctctccccacaaaaggactctagcataatccttggggaggttttgtaaattgtgttttgtttgctgatctattgaaatgtgctgtgtcaaagcaatgcgttcaaaactgtaacctgaggctttctgcaatcattgcactactaaaatgaaccttggtattccccctttatagctgtacagatgataatctagtaaataaatataatatgtgatgggaatttaataagggcctcgatcgctcttgcaatgatggcagagacattaacattgagaaacctctatcacttttgagcaagcagattttagttcttacattcattggtttaaatttcctttagctctaaaaagagcacattatatcacctggaattgtcccaagtgaaagccaaaaggcttgtcatagcaataaattgttcccctgctggcttatggctctgtcctctcaaggacctttgagttcttgcttacaggagccccaagcaatgaagaaatagaacaggtgagtcatcccccacatacctggcagataagtcagaggcaccaatcctcagtataagagagtctaagtagcattagaatttgaccaatccacaaagttttaccatgttgactagttaatttaacaaaatagcttgtccatccatcagataaacttttttttaactgaattgattgggaagccagttgattcaataaatgtcaactggtgcaatgatagtcatggtcagaaaaaaaagtaatcattttaaaacatggtcatcattacctgattggatggaagttaatactggtgtaattagcttttcaatctctcttgcacgtgctctctctctctctctgcagtttgttttttgcaactatactagtagagttttgcagtgtcttgtttaatttctttgtgttgaaaattcaaatagatacattacgctccctagtagagcagatcaatgtgtggttgcatttttccagatggataggttatcctacttctaaatatttagtcatgataggaacaattatatattcatatagcaaagtatttcccttaagtaaaccctttccttacttctttatggcctcaggttgaataatttcaatatcaattttaataaagaaaaacttcacttacagatcacattttctttactaattttatggtttaatattatttcattctactctcacaataactctttgggcatatagaacaactattagttcctttcctttctaaagacagtctattgatatcaaatgggaactagttctttcactggattgccttctctccgcttttatgaaaccttgctcacctggggccactcagttagtaaatggtactgttaggattagaattcagacagtgcaaggtaatgctgtacatatgctgtatattcatctactccagtgggatctgggatagcatcctatcaccaaacacttgaatatttctgcattcagtaatatgatggtatcatttactacaataaataaagaccattacacataataaatgaagataataaagagcattatgtctgctcaggtcaagtgttgccaccaaatagtttttagaggtttttggattttagagttgcatataagggattgtggatatgttttcctctggtcctcatgctctttttcactatgtgaagcaaccagtcatttaatattcaaataactacctacatactttttttctcttacttcaaagcttctctggatagcaatcaagctattggtggtcagcagacagaaccattaaccccaagtattttttccattgtcttcattatgcacaaaatgcaattctgttctttctttcactactgagagttcaactacacttcacacaatattactcataatttttcacctgtttctttctttctctttcaactttttccctagcttctttagaaatggtccgggagagagacagaagaagtaaaaggatgaggccatatcccagaagccaagaaggcagattctgtcgaagagggtgacagggtgccctacactgtaaaatgcttcaaacagatttaggagagtgaggaccaaaaagctgtgaccttgacaaccagaaattcacagtgacctttgaggaaacagttttctcaagatgtggaaatggaagtcagaatgcaaagagttgaggagcaagtgcatggtggtgaagccaacctattttttaattaaccagggtcaatgtactttaaaagtcttcagaatgcctgtaagtttcctttactagttccatgtactttcttgttttcccataaaaatctggatttgtggcagaagagaatgaaaaaaattaaaaattaaaagcgctgcttttccttaagcactgacaaaatacaataaaagctgattcttattaa

SEQ ID NO: 5502 - DNA, 37713 bp, human; identical to SEQ ID NO: 3117

SEQ ID NO: 5503 - DNA, 29125 bp, human
gcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccgtaagtccctgggggcgaaagggggcgccggggatgggggagagggggagggaggactgggcgcgccccccgccaccccgcgcgcgccccgacgaccccaccccgagcctgcccggcccgccactgggtcgccgcgcccgcaactcacttctctccgtgtccgcgccctccgcaccactccgcgccgcgcccggggatgtgggggccagtcccgggctccgcgacagcctcgcggcacctgtggttcgggaatcgcctcaagttttgcggggcgctttcgggaggggccgggggcggtggcggccgaggactcttggcgccccctgcgcggcggcggatgccattgtctgctccgctccttgcctgtcacctctcccgggcttggtcagtgatggagtgtggccacgggagtgggggggaggcaccggcgacggccggacccgaggaacgctggccccgagcccgcgccgcggctgagcccattgtttttaatgccagtctcgaggaattgtggtgccctgtgatttgcggcaaaatcaaagcgttggtttttaacacgagggaaggaatactcgtgctttgcaaccgggtttcgtcccatgttaggacataatttattttaaggagaatacattgttttttcgtcctgcaaagtggtagggcggatacaggaccctgctccagacagccttgagcccatactcttcgcaggcaaaccctcaccctttctggtcaccaagatctaggaatacgaggtccattcttttccaagttctggtaacgggtttgcagtaaatgcccagttgatgcttcacttcctgcccccttcgaatgccgctatcttcaggacttgcacgggaggcactttggtatcacctaataatgtccttatattttgttcccctgacgcattttaagtgaggtaataagaccattttaactttactaaagttgaattgccacgtcatacatttctagatatcttgttgatacctttttgggtggttacaaaaagcgacgataatttcttaccgaaatttagggcccatttttattctacattggttctgtaaatttcccctccccgtgttcaaattcaagatggtgtggtgaatcttgagaatcatgcttgaatcttatttgcagtaacgctgttaaaggaacttaacagtgattaaaagaaaaaaggatacctatgtgaattctgcctttaaattacctttgtagaaacaatacttctgtttgcagttgagatgaccaattggattacaaaaagcttggcgttaaaaatgaaacatgcagactaatcaacacatttgcagatcacaaataaatacatacaaattagtttaagtataaaacacactagaattcagcatccattccatctgtagatactattttttattttaaatgaagtatttcatgtaatgtttcaatgctgaatcttatttaataagtgtaaatcttattgtggccttttaaacgtttgttttctttttcataatacattaactcagttctagattttgtacatatttaagttggaatgctttaaaagtcagatgaaaacatacttttttattaatgaaaatttgtatttatgggatttttcagttaatattttggatcattctgttttgcttaaaatatgccatcataaactgaggagaacattccaagacataagctactgtctgcaagtaattcaccctggaactagaacggcctcaggatgaaaaatagcaggtcttctgtttctttcaaaagtacccaaaccagatgatgtctaccattctcttttgatgcatatagagagtgcgcaatgtatagcacaggtagaaaatagtttcttaaattgaaagagtgatctttatttttcttcaaaaatttcacttcagcttattacccatttttcttttttctcctgcacactccccttcaaacttaatgtggaacaaggtgggattggaaggtttgcatctagaggaagatctgtccaaaagaatttcttgctattttaattggcatagaaatattgatggctactaatcatttgtcatgtaaatgccccatcccccaaaacttctctgtgaaacacataatcttaactttattgattcaaagtattacatgtaatcttgattttatttatcttaacagatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaaggtataatttttgtttgtcagaaaggtgaaatagaatcaaatgttaggtcatttaggaaattgcagacttcagtgatgacatttataaataacgattaataaagatttagatgaaataggtttaaggtaaagctttgtgtttttaaaataactagtgttttgattgataattactgaggctgaaatgataaaggcagggaaatcctttgaaaactagttatataattaaaggcataaatgattattcatgcttaatcatctttatagaagagtttaatgaattcatttcattgcaggggaaagtagggtcagtattttaaattgtgtgagtaattctctgaattgagacaagtacagatagagtctaattctttttccccgaaaatctataaagtaatgactaatatttgacatgccttttatctgatttttagaatcttactcacgtgtaaataccttgactatgtagactatttcaatcacatagatgttttaaaaactttgtgtatacatgagatgtgtttgtaagtagtgtttattaacttttaagtacccttgttgctatggtgggggtgcaattaaatatgacagataatttttccaaggacagattttttaaaaatttgatgttacaaaatgactcatagattggcttttaacactaaaatttttttaatgctatacgtctttattttataaatatctgaaaccctgaataccctaaaataaatttctcaagattgttctaagtaggttaaaagaaataaactttcttcttttacagaacattttttgaggggacatttacttcattccccatttgtttctttttgaataatttgctgaatttaagataagagcatttctgcatataaaaagttctcttgtgtggggagtatacatggaagtaacagtatgggatacaatgagggtgggagagaagtctggttttcttctcagcttccctttattgcactccaaatatgggttggatattttgtcagggagatggctgggaagaaatggagattacaagacataagtttcttaaatactgaggactcctctttattattgaatgatctttggtgattttgtatctttgggtgattttgtatccagtgtttcgtttggtcttattaaagattatagaaaagtcatatcatttgagaggtgagagatgttttacagtgatctagtcaggtgattttgttttgttttgttttgttttaagctttttgccccatgggtagaaccttaaataaaatgagtggaagtgaggctgctccttgtgaaatcaggaatgaggatcctgtatcctggctcacttggcctttacccctctgcacaggagacagttcttgagtttgaaaactgccgttgttgatcaaacttcaattttataaagaatgcaaatttgggagaagtgacttgtctagggccatatgccagttagtgattgacatggggctgcaactcagatcttaagcttagaggcaaagattttaaacagggctggaaaaagatcaggtttacatatcttaaaagattgaactgagacaatggatgagggcaggaggggctgagactggcacctgcaggatcagtaggagactatgtgagatcctgaacccaggcgctagaaaggagggctgtcactaaatagccattatcaaataggtaggtttgataagacttggtcacctctagaagtgggaagaatatgggaggtcgaggcaggagaatcgcttgagcccaggagttcaagtccagccctggcaacttagtgagaccccgccgtctctacaattaaaaaaaaaaaaaaaaattagctgggcgtggtggcatgcacctgtattcctagctgctctggaggctgaggtgggaggattgattgtgcctgggagttcaagcctgcactgagccctgattgggccactgcactccagcctaggtgacagagtgagaccctcaacgacaacaacaaagcggagagagcagcgaaggaaagggaggagtggggtgatctccacatttctggtttgctgatggggtacaaggtgagctagataactcggcttattttggggtgagttgatttggggatgtctatgtgactttcattaagagaagcctgattttctggtgggatgtggttggtgtaagtatggaagtctggggaaaataagacaaagtattagatcaccagcattcaagtggcaggcaaaggagatgaagaagggaccttcagagtggaatgagaaatttcaccaatgccagatgttgcataaagttcaatgaaagtgaggaaggaatctggtagattttacagtgagcatttcatataatgccctttgccagaacattttcagtggaatagtggagatagaactctcgatgtaatggggcgaagtgtgaagaggtggagaaatttaaatagcatgtgtagactattttggggaactttgctgtgaaggacaggagacgaggtggtaaccactcatagacataggagtgggggacaaggtttttaaaaaagaaggtgtgagaggcttaagcttatttctagataggggaaggagtcccccgtgtggaggaggaaaataccagcaagggattcaatcccaggaatgggctgttatgggaagaaaggaaagcactgcttggtgttcatgcacatgtcactcagtctgtccgtgttgagccactactttttcttttgaaagctacaaagggtatctaatccaactctgatacttatatcaagcacctttaaataaaaggtggactttaaaaaaaacagctttattgagatatcagtcatatacaaaaggtggaatttatcagttctttctctatacgttcccccttccatttcatactgaaaacctcatctactctaccacttacggacatattttttgttggtataaacaggtggtttgttttccctactgctggaagcgaagagctttttaagcaggagaattactgcttagcgcctgagaaattctggactgggacttctgctgttcatatcagcaagtgatttttgttgtttttgttaaattatctcatctacattcttcatcctgagtatttggcatacaaattcccccttttgagaggggaatgatggataagaataatattagctgaaaagacagactgaaaatctggggacttaagttctgttccctttgtaacgttagctagttttatgactttaaacaagtcactttgtttccttatctctaaatgctcttgaagatcccttcaagacagaatactgtgcttttttgattcctgttttgtgtagcattttgtggaagagtcactggattaaggtcttttaaaattaatttaaaaacatatatatctccaaattactagcttgataatttgttaaagaatacttactgattttctttactaacaaaagaatttttaatgacataccagtgggtattgagaacacttcagctacattcacccacagtcagctgatatttagctgatatttagctgactgcggagaagtcatgtgttttgaatataagaataggcactttcagatgttctctgagtgccagtaattagagtaagccttaatccactgtgctaaaaataaccaaacatacctttcttcttactagtctattattaattttacttcagatttagacttacaaataggcactaagagaacaaaatgagctcattattgatttttttaaaaccatttggtcctaaatataggaagtacacttcaggttctcttggtaatcttttactaaatcagtatggcatattttacttctcttcaaagctcttaaaatattgtttcgagcacattttaatttttgccaggtatgggattacgttaatgcaattgctggctatagtttttaatgtaaaacttgggctctagagtcaaattgctgttcctaggcaggttactcaaacctgggtctcttatcaatgcaaataataatggtatctcatggatacggttgttgtgaggattagagtggtaaaatatgcaaaagccttagctaacatttaatgtctcatgtagggcgaggattcagtgaatggtacttaattattatgtttctgtttttttcctgccctaagctttctggaaagaggtacattattatcctgatagctatctgttcacctacaccaaagaattcattaatttgattattctttttccattccgagtgaaagtaaacattactggctggggcttagacacattgtttctgatgatttttaaattaatgcttccaagtgattcatgcagtttaggacctttgactagtgtttaagtgctttttatttgtaagtaaagaggcagtactgtggataaggagcgaggatggtacgagcattagcttgtttaatagtagcatgaggaaatcttaaataaaaggaattttacttgaaactgttagtaaactttgtataataaattatttagcattctgttcctatcagctagtcatatctggtttttaatctaccatttttatgtcagtccctttaatgtttagttttcttaaatcagggaatcttatgtgtcatttatcagtttcctcaaattcaaagttctatttaatgagcatgggttagggaggatggagagttggaatactctattctcttttaaatagacaaacaaaaacagtaacgatgggaaagagagggagcactttgttaaagttggcattgatgccctgttttgtcttccatgacttattcccttcacaatgatgataaatgaacacatgtgaatacctcctctcaataagactgcagtagctccaccattttaaataacttactgagtgtggaagtcaggtagagtagacatgcacaaactcatgatatatatgccaagtgagtttgtatgatacagtggaaaaaggcctggagttaaggtcaaaagatcaggtttcttatcccagtactagcacttgtaggcgctgtactcttaagcctcattttttttttgtctttttttaatctgtgatcaaggatgaaagatagtacttgctgttgaaaacatcaaataagatgaaatggttttaataatgaaattaatgctgttgtgtgaatactagttattttcatactaaggagcaagaattcattgagtctcaaaacaggttgtgttattctgtatacagtattattttacattaatgctacgagcagtaactgcccattgtgttttctaaaaatcatttaagtgatcttcagtgaaaattataatctccactgaaatgttctgtgtttagcctatcttaggtttttattttctttcttttcaaaagccttaagtacatgtaaaccattttaaaatgcccttttaatcctcctcaaaggacttgctatgcctcagggttgaagttttgcttccttgggtcaagcataacatgattccatatgctagaatcctaatttgaaggagaatataagtttcccaaccttattccctcttctagggtaaataaactacacttcagttcaacagtgtagaacttggtaaatttgagaacaggcctctgtttcccttaagtgataggaactttctgttctctttctctaacttctgtaataacgtggagctgttgttcttttcgtatggtttattctgcaatcctagaaacctttttaaaaacaattctattctgttagaagtcaagagcatagttacccttgggggtgggaggttgtgactgggagagggtagcagaggagtttcagggttcagtagtgttcagcttcttgatgtgggtgctgatatatagttgagttcactttgaaaatttattgagcttgtaggacttaaggtcttctctgtgtatatattatacatattccaataaaatatcccaaaatattgacctcaccttggcattatcctcaacaagtcctccttcagttggaaggtttgttttcttctctgtacttacagtttgaattaatctgctatatattttgttttaattaagtaaacttaggaaaaacctgggtctgctatgttttaaaatgcttatagaaaagaacctgaaaggaagaagggcaaaatcacttattctaagtggtatgattattttgattttttctttatacttgcctatgcttttcaaaatttctgttatgcgtttattacttttgtagtctatgagaaaaatctgtactgtcgtgaaagaagaaataaactgtataaacttggggcttttcataataggatatgaaaatatatttagaaaacatcattataggataacagtttttttcacatttgtactttgttacagatatgctagtctgtatttttgctgtgctattgaggatcaggacaatgaactaattaccctggaaataattcatcgttatgtggaattacttgacaagtatttcggcagtgtgagtagtattttattttaggaaattgaatgccatagtatattttggaaccttttctctaacaagtttattttttggttgtcttggggattctaaccgcgggagagggtgggaatgactatttattagtagaaattattaagttgtccatattgggaacatgcagagcccagtcttatttagcttgtaggaatatgttttcaagtacttgagatttggaaattaagcttacttaaaccagtgatacttagtcatttttagaaagagttaagattgattcactctagttcgattttattcactacctgatagtgaataagcatcttctgcttctgcaagttttaacaattttttcttttcttttttcttttttttttccttttcaggtctgtgaactagatatcatctttaattttgagaaggcttattttattttggatgagtttcttttgggaggggaagttcaggaaacatccaagaaaaatgtccttaaagcaattgagcaggctgatctactgcaggaggtaagctacttattctcttcactaggcactagcatgttttgctcttgctggggaagtctcattcatcattcttacagtttcagaaagtactctgaagcatgcttgtcatgtagtgtccatccatgtgcagtttattgactggaatatgtgtcagtcacgtcaactcagttatctatggatggatggttcagtttggagatggtctatcggtcaggcctcttcccaatggccctttttggaccctaaaacactggagtctaaacctttagaggacagactatttgaagaagggaaaagattggctgaaagtagcagtaagttgagaactctccatctattgcttcaaattgtttaagataaccccctttttcattagtgtagataatcaggagttgactatgagattatgacattttaattccaaattggctcatatttttacctcatgtccattaaatgcaaaagtagccaagcaaatgatagtgttttctaattatactttttgtagaaacttccaggttttttttgttagcaaaactaaacagtatttgcatttctctttgctcttcttaaataacaaaccatgttctgtcaaactgcattcttgtcttacctccatatccccagatgtgtaactcccttttctttctaattaccatagtcatcttgggttaattgtgcagttgatgctgatgtaccttctatttctgaagcttaacatttcatagataaggctacctttttccaaaaacttaatgataccttaattcagataccaaattgaattatgctttagagctaattgtgatttttatcatatggaaagcttacagcatgagaagtgattagtaaatattgaaaaatgaaatgtgttttcactaaagtagttgttaagtgtgtgtttgcatgtatgtaaaagtcttgaatatttttggctcactggttcattttccagaagcattgaaaatatgattttgtatttccagtttattttagtcccttctttgttacatacatgtttatcagtttgttcttgtctttttttagtcaccaaaggtgactttcagtcccattttttagccttggaggcattcagttttaagggagtgaaataaggggagaagagtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaattttaatatttttcctggagagtaattttttgtttgtttgtttgagatggagtttcgctcttgttgcccaggctggagtgcaatgacacgatcttggctcactgcaacctctgcctcccgggctcaagcgattctcctgcctcagcctcccgagtagctgggattacaggcttgcactaccatgcctggctagttttgtacttttagtagagacagggtttcaccatgttggtcaggctggtctcgaactcctgacctcaaatgatccgtcccccttggcctcccaaagtgctgggattaaaggtgtaagccactgcacccagctgtgcctggatttttaaatgctactgggaaattgctatgggccttagaatatgacagcaatgttaagtttaccttagagcatatattcagtatttaatgtactaggggataagaacattattgcagatccacatttatttgtgtgtgtatatgtacatatgtatatatattcccctatgggagtattttaatagttaatattgtccttctgtttgaagtactatttttatgtctttttttttttttttttgagatggagtttcgcttatcacccaggctggagtgcagtggtgcaatttcggctctctgcaacctccgcttcctgtgttcaagcaatcctcctgcctcagcctcccaagtagctgggactacaggtgcacaccaccatgcccagctaatttttgtatttttagtaaagacaggctttcaccatgttggccaggatggtctcaaactcctgacaggtgatccacccacctcggcctcccaaagtgctgggattacaggcgtaagccaccgcatccagcctatttttatgtctttaattggggaaagtaagtgcaaagagaaaagcataggatgagtatggttggtcccatgtaaaattttccttacccccttgtaacctttgtttaaaataaagaaatgagtactgttaattacagttccttgtctttagaagaaagctgtggtcctgtttctcttctatgactacttttacattgctttgtacacaaacgaaactgagtaccacattgagacattgtctatttagcagtctgagtgaaccatttttcttagccatgtaggtcttggggaagcagtaggtggtggtccattctgaatttagagtgagaatacatcgtaggttaaggccattatgaagccaagctcaagtctgtgtggagcagtaaggcttcaggttattctgttctcttcatcaacatactctgagaagaaatgcaggaatggcaagatgcatgtttcctaaaaatagattcatttatatttttgatgcatgatacaagtttacatctgtgggagagtatttgaatattatgttcataaaatagcaagtggaataagagaaaaagcactccacaaactgctggaaaactttttgttttggataccatgacaacaaaaataattatgatggtaactaacgcttgagtgcttgtatgtgaggccctgggctcagcagtttgctttaagcatcctgtgctaatcctcaagacaccctgtgaaaggttagaggtagcctaatgagaaagtggaatctcagtgaggttccatgactggtctgaggccacctggttagcaactggcaaaaccaggattctaaacccagatctactaggcttcacagctgtgtaaaatcttaaccactgtgcacttcccctaaccccagttatgtattgtcttggtatatatattttaaacgttctgttttagatatgaacttctttgtttctcagtcatatagtgagaaattcataattctcccagaggtttttctgtgtggaaaagagtagatttcctaagacagtgccatctttgacttcttagactgcaaatttttattgtccagattatcagcagttggaattttttattggatatgtagatataaataatatttttcaacctatttcttgttggattgatcaaaatgcctggatttataataacttttttggtcttatagtttggggtatagcattcacttaatcaatttcatgaaatgattttgcttccaaaattgtaaatatagctgtgaagatctaaattcagacttacatttgtagtagaagtcctaattggtcaattttaatctactttttcatgtgtcattatttttctgtttagtgtcaggtcttttacttgaattgattatttctaagcaccaaagatgactttgaacttatcatgtacttatctgttggcttaaaggtgtatacacatctcaatgattttgatttttttttaatttgtgaaatatacatttctatccttaagaatgcttattttcttcagaaaaattaaaaaaaaatttctcttacccaatttgtataaacacatagtttaaggtagtccttcattttatagccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaattggcccgttatccattttttaatgtttggctgtcttaacatgccactggtactaaagatgattcttaaattattaaagtacaacatgctgaaattgctaaattgatattctttgcaatacttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatgataaagagcagtctaaggctttagtccctttgatccccaacttatttattggtaactactaaatttaccatttttgtggcatggataaaatggagtgctatgcaaatactgttgcacgtgagatgatttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgttggtattttttctcactaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtgatttcttttaaaaaatgaagcttttgtaacttaaaattattttaataagtactttttgaagtattgaataacatatcttttaatatgaagttttggactttttaaaggtcagctcttgatataattaagaatatttgggctgagcacggtggcccaagcttgtaatcccagcactttgggaggccggggcagttggattgcttgagcccagaagttcgagaccagcctgggcaatgtggtgaaaccccatccttacaaaaagtgaaaaaaaaaaagactagctgggcatggtggtgtgtgtctgtagtccaagctaattgggaggctgaggtgagaggattgattgagccctggaggtccaggctatagtgagccatgatcatgctactatataccagcctgggtggccacagaacgaaactttgccgaaaggaaggaaggaaggagggagggagggagggaaaacagaaaaaagaaagaatatttgggcatgctagtccaacttgagaatatcttaaattgttttaaaaaaagagatgcttccaaatatgtacaagaatgtcatttaacagcaaaaagcattttgatataaatcctcttagatttgcttaaataagacaaactcgtgtaactcctttgtaattactactgttcatgttaaaaccttcaagcctcttttaaagttaacaagactatagtcttttattgccagcgtactttagtttttttataggtaaacttaatcagggtttattataacaaattctggacaaatgaagtttgattacattaatgcttgaaatggaagtgcttgaaaggaagggcagaaagcaggacaaatgttgcctttcattttacatttaataagaaacaatttggccaggcatggtggctcacgcctgtaatcccagcactttggaaggctgaggcaagcggatcacttgaggccaggagttcaagaccaacctggccaacatggtaaaaccccatctctacaaaaaatacaaaaattagctgggcgtggtggtgcacacctgtagtcccagatacctggggggctgaggcacaagaatggcttgaacccaggaagcggaggctgcagtgatccgaaatcaggccactgcactccagcctgggcgacagagtgagactctgtctcaaaaataaataaataaataaaataataatttggccagtgtccttactctctggttctcaggttgtagtcattttgctttatgtgtttttgagccttttttcttttcatacttttcaaaattttgaggattttccgcttgctatttctattctattcttttcttaaatgctgatcctgacctagtaatttgatttcatgagccctagggttggaacctgcacagggacctgcaaagggaatagtctgtggtgtcggtggtgattttttttttaattaaaaaatactttctgaaaaatgtcacgtttgagtccttttttcacctactgacattttcttttgtttcctctgagggcctttttttaaaaataaaaattcccattctggaaaaattagcaaatacaggcaaacacactagaatataatcttacccaccaactagagccaattagattaactcagtggttcccatggagtgggagtggtgcagttgtgcccctctaggggacattgggtaatgtttggacacatttttggttgtcacaattgggggtgcagtgctaccggcatccagtaggtgaagaccaaggatgctgctgagaattctgcagtgcacaggacagcccccttagaacgcggaattatctggcctcaaatgtcagttgtgcccaggttaagaagccttggtttaatttaacactatggagtaaagattccatttacatttatagactgctatatcttttcaatattatatgtagaccacagtataaataagtggctaaaaattaatcaaaaatgcaaaaaatcaagaaaggataaatgtgcttaagaacatacaaatagctataaaaatcattcctaggccaggcgcggtggctcacgcctgtaatcccagcactttgggaggccgaggtgggtggatcacaaggtcaggagatcgagaccaacctggacaacatggtgaaaccctgtctctactaaaaatacaaaaattagctgggcgtggtggtgcgtgcctgtaatcccagctacttgggaggctgaggcaggagaatcgcttgaaccagggagtcggaggttgcagtgaagcgagataacgccactgcactctagcctggcgacagagtaagactccgtctcaaaaaaaaaaaaaaaaaaaagtcatctctatgattcaccaaaattacctctacataatgaccagttactggggagataatctatggttgactttagaatccaccctacagcaaggcttgtaggatgtcactctataatttaatttcctcaacaacagccaaatctgttaacttctattaaggtaattgagtttttatgtggaaactgaattgagtataccctgcagacagaacacctttgaattttctgccaatctccccagccactttagggatttgttaatttcttaaaggaggaatagttcaaatgaccagaatttacatatatagacttttgttgcatatatagactttttgttgttgttgttctctggcatcctgttagccttaaaggttttacttagtgaagatatttagtagcatttgagtatttgaaattctgtgattccaagaaatcttttacctttgaaaaaccctaatttagggtattccaaggcaaatacaatacagcatgtcctaaaacatgcttaaaatatttctttgcagtctaaaattatatttgctagctgggcacagtggcacacttccataatcccggctacttggaaggctgaagtggaaggatcccttgagctcagaagtttgagaccagcctgggcaacatagtgagacccctcactcttaaacaaattatatttgctaagttaattattctgcttttttttgtttgtatatttgttttgagacagggtctcactctgtcaccaaggctggaatgcagtggcaccaccatggctcacttgcagccttgaactcctgggctcaagtgatcctcccacctcagcctcccgagtagctgggattacaggtgcacaccaccatgcccagctaattttttaaaaattttcagtagaaatggggtctcgccatgttgtcagggctggtcttgaactccgaggctcatgcagtcctcccaccttggcctcccaaagtgctgggattacaggcgtgagccactgcacctggcctctgcttttttattttaaaagcacaactaactggtagataaagtgatttgtctttagtatttgataactaatgggttttagagtgttatttataagatgtagtaaattatcctcatcattatttttaagacaaatttataagacaagtgtaatagaaatagatcaacagcacaatagaaaaagatggcagaaaacatgaatatgtaattcacagatgaaagcaaaacaaatggtccttttattaagggaatgcaaagttaaaaatcaactagacccttttttgtttgtttcttcttggattggcaaagaggagcacttaaaagctgtattttgttttggaggattagtttggttatgtctactaatgactaaatgtgtacatacattttgacccattagttacacttcaaagaattttatccaacaaaaatgtactgagacacattgcttagtataataagccattgaagcttacccaaatattcatcaatgagaaataggttaagaaaattatagtacaaccatacatgaaactgatgtagctgtaaaagaaatgagatcgatttttttttgtaatgatatggaaggatactcaaagtatatcaagtgagaaaagatctaggaacaggatattattattattattattttattttttgtagggacagggtctcaccatgttgcccaggcttaggagcaggatattagctaactcgtgttacttctgaaaatctttgaagctccccctgctcttttttccagaagtgtaaaaacaagcatgtatttagtattacacatttttaaaaaatgaaaaaatgctgctgtgtgaatgaaagagtatacatcgtgttgctccagatggtaaaactagagtagaatttactaaaataaagtttcagcacgtaaagtaaagcacttctctgctcttggccattttagacactaaccatctggagcaaccatgtaactcttgccactcatagctaacttaatgtaaaaaaaaaaaatcgcttgactttcttagcacttcacaaatgcttgtaagactgacaccaggagccctgtcatctaaaaggcactttatagagtgctttcaattcttctgttttttcattcattgctcaaaatagatcgtagtgagataagatagtctctggccttcttggtctttggcacaaggaagagggttccagagttgagagtaaggactttgcatcctttgccatagaatttgattaggggccataaaaaggaccattgtgttctagaatgtgaaggactaagcataccactttatagtgcaaggaataagtgaagaagtccttttataagaaaaactgcagtagagcaataacttgaaattacacttatttatatttacttttcattaaatgtaaattattttcttttaccacattgtactactagaaagagaatcaggagtttaggcattcagtcatagatattcgataccattgatttacttaagcacttctcatgtcaacaagacttaagcctgcagataattcctattttatcagtgttcgttatagcttccctgttggttttacttgtgagtcataagcctagtatggtgaatatctaggaaatttcacggtaacagggcttgtcttaggttttgagaacaggtgtaacttgacttctctctgctgtttgtcatcctacacttcccactacatctggtcctttttgtagggtgttgagaacaacatttttcttcatgcaggggaaagtggaagtgcatgttttctaagaaggacaaataggaatagaataaaagaaaaagtatattggggctgggcatagtggttcactatgtaatcccagcactttgggaggctgaggcgggtggatcatgaggtcaggagttcgagaccagcctggccaagatggtgaaaccccatctctactaaaaaaaaaaaaaaaatacaaaaattagccgggcacagtggtgggtgcctgtaatcccagctactcaggaagctgaggcaggagaatcgcttgaacccgtgaggtggagattgcagtgagctgagatcaagccactgccttctagcctgggcgacagagcaagactctgtctcaaaaaaaaaaaattatatatatatatatatatatatatatatatatatatatattttggaagggagaatgggagtggaatcaaaaacattggtctcggatgagaagagtctttctcattggttatgtggtgataatggggtaaagctgtagactttttttttctttaattcatgagtaagatgagcaaaattgaggaagtgtcattttcttggccttgagaaatgacatcatctaaaggagaatcgttgggactggggagaaggggaggggtgtatagcttgaggacagtgtgaggagttggcagtagacttggtggggagcaaattagtgaggagcaaaaaagatttcctgggattgaaagcccgtttcaggttgaaataatacattgtcatccttattcaaagaataggtctccagagaacctgtactaaggacaatacatggtttatagttgtacaatacaactggattaaaaaattttttctcactgttttcattctgacctttattcccacttaattgaaatcactggggttttagtgttttaagaaacggatagtttgctgagtattatatgtgactatttcctacgggtgcccaggggaagaacaagatagtaggcctaggcctgcacagggtcccttgtgtgctatgacagactttactctcaccctccctaattcctaattgatataatttttatgtgactcacaagaggtactggtggtaagaggtataaactggaatttataattgaatctactttctttgtatctgaaagaaaaatattttggttaattatgggcatataatttagctaaaaaattaccttaaatgttaagtggtccttaaggcatttataacagaactttttcagaccctagaagtctaaactgggaaattatttaaaacgttattaaagcaatttaaaatggtaaaaataatacatttatttttgtgcattttagagtttcttttcttcttgaaggatgtttttccagtgaagaggggtttctccctatgaagagtattctcacatttaatagatggtaatttcttacttaagtacagtaatatggatcaatggctataaagaatagtttggcttatcatcaacccttttctttcctaaaagcagtaaaaggtgtgtcagggtataagtggtggaaatgcctgggtggtcacattgagaattgttcctgtagaattgctggtgtagttcatagtaagtctcctggggaggaatggttgcatactccgccctgtttgggaaaccacctcttctcttttaatgagcgtaagctctcgatggttggtttttacatggtatgatagaaaattaagagagaaaagaaaaagatgataaactataatataaaggctcaaagaactggtattatttaggcaaaaggttatttgacagattggtattatttaggcaaaaggttatttgacagacttaaacttttcttgttctctctccagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagtttggtcttcaaatatggaggttaaaaaaagaaactattttgtgtgattatcttacaatctgtatgagctaatgtgttctaatgtatcacataaaagtatatgtgaaaatattacaagaaactaaaattaatttgtaccattatataatatttaaggttaaaacattcagtattaagaaattttgtagtgccacatttattgaatcacatttgtgctatataataatatcaaacaatccctttaagaacttattagagagctatgtctgaagtctgttctgcaatatctgttgctgaataataactctttcaaagcattaatgctgagtttatatagttcaaaaattctaatattcattcagttttaatacctaaatacttatattttactagtgatggcattctaatatattaagtcctcatttaaatacttgatactttgttaactgtggcattatatttctgaattttaaaacctttaatattggtaactattgcatattcttttaataaaacatgcagcatatttttttataaaaggaaaagaattcattgtttatatctagagagcataaagcctaagttaagtaagttattaaacaataacttcacaagatgttcaaatcgatttatcactgaaagaagatctatgaaaatgtgttttgaccaaacttagtattaggcaggtacacagataagattttccattcttaacattctcactgtaatgcacgacatttgaagcacctggatgtgctatcaatcaggtgggaaatttagcattatatattggaagcattgagaaacattggtctttcatttctatttttttttcccctcctttcctcctcctgccccacaatatattattcatctggttttaatgctacataaatatgcattgtctcatgcctgtttgtgttggatgccttgtgctaagctgtaacaaaatgttgcttcttttgctgtctgtatacagctgcttgctttaaattagtagattctgaaatagctttccttgcatgtctaaaataaaagtattgcatgtacttcgtctcatgtgaatgactttttcttttccatccctcataaaataacgttttatattttcatttttctaggcaaattttttaaattgtggttaaaaacacataacacagaattcaccatcttacgcagttttaagtgtacagttcagttgtgttagttaagtttattcacattgttgtgcagcagatctgcaggactttttcatctggcagaactgaaactctatacccattaatcaacaattccccatttctccctgtcccccagcccctggcaaccaccattcgactttctgtttctataaattttactactttagatagataatagtttttctgggtagttttgagctacaatttcagtgtgaacatgtgtaagttccattttatattatcaccacaatttattttaaaactctacctgtgcaagtctcacaagaataaaatgtgtaaataattctttgaaactaggccttttagaaaggacacatattttcaataatgcatatttgataagcagtatgattctctacaggaaatgctatataagattgcaggcagtgagcacatggggaaaagtctgaccagctccacggagtagctgtggggcatttttacatggagaagctgagaatgtaaactgtagaattcaatggaggcattatttaattgatacattcaaggctacatgaacctttaaactacttaacattacatggaaataattattttaaatttttcttgaatatttatgagatttagatgtcattctcagtgtatttaatgcttaaggctaaatataaatgaaagggattggcttacatcactcttgggtgttacatcatttccagtggactttcttaaaaaactttatcatgaaaacttcaagactcacgagtataggaaatagtataaagaaccctcgtgtacacatcactgagcttcaagaaccatcaacttaatactgtttccccaaccactccccgcatttttgcctcagtatcttagagcaagccctagacatcttgtcagtttgtctttaatacttcagtatgtgtccctaacagataaagtaccatgccccacaaaattaacaggaattaataattactatcttatgcctggctcaatttttcctaattgtctgaaaaatgcctttttatatttggtttgttagaatcagattccaaccaagactctcacattgtatctgattgatgtgcgttttaagtctcttttaatctttaacaaatcgtctgctttttcccgccttgccattttttttttttaaaacgaggtcatttatgctgcaggatgtcctaccttatggatttggccatcatactcatatggcaatgtttagctgttcttatatccctcatttctatttagatctgtaacctgactagattgaggttcaatttgagggggcaagaatacttcataggttagactctttttaaaaaaataccttttttcgctaaagctgatttttacccatttttattactatgcagacatactaaaaggtcatcatatgagctttataagtagaattggtgtatagtacttgcgtttaataataaatgctaaatcatttcgatttcaattgtgtaactatatcacctaacatttttgaagcactttctataaattaggcagagccttaattcacttaatctcaacatatgaaggtaagtactattatccatgttttccaaataaggaaacagaccatagagtttaagtaatttacttaagattacaccatgaagtgctttacatgcaattaatattctaaagatttatggtttaatataatttctcttctccttgctttgtgctgtaccatgattaggatgcgaaagtaagtttattactggatgccaaaaatttatattattttccatcattaaaatatagtgttgccttttaattacaaaattcgttgctagtaatacctgaaagttggcctccttggtcctttattttgtgatttgcaaaatcagccactttggaaaattattaaataattttttcctggatatgcttactttgttttgacctcctttgacacttaaaaaccagtgctggttgctacatagaataaaaatgcctttggcccatggcattctttgcatatgtggcctctagtgatgccattggttgcactggggaggtctgggaagatagctgtttctgaagacttgccgctgtggacacagttaactaaaaactccaagaggaagacatttctataaatgcatgtgacaaaaagcatggaacacaacagtaggcgaagaactgtgggaactcggagggaagaggttttgaattttaccactaagataacttatctttcatatatataattgagtagcagtgatttcataaattgccagcaggtttgcactgggcttgactgctttttgcatgacagcaacggcatctagcacattggtaggtaattagcaggtacttaatgaatgctgaaaacgtccttttgtggtctccaattttgagggcacaaaaccctaaataaccaatggctgtcaactagaatgctactgtgacacgaaattgctttcttgattctctaaaacaagcatgttcttccatgtcaatgtttcacattctcaagactccctggatctgcttaccagagtctcacattttccctccacaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacataccttttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttg

SEQ ID NO: 5504 - DNA, 25621 bp, human
gttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaaggtataatttttgtttgtcagaaaggtgaaatagaatcaaatgttaggtcatttaggaaattgcagacttcagtgatgacatttataaataacgattaataaagatttagatgaaataggtttaaggtaaagctttgtgtttttaaaataactagtgttttgattgataattactgaggctgaaatgataaaggcagggaaatcctttgaaaactagttatataattaaaggcataaatgattattcatgcttaatcatctttatagaagagtttaatgaattcatttcattgcaggggaaagtagggtcagtattttaaattgtgtgagtaattctctgaattgagacaagtacagatagagtctaattctttttccccgaaaatctataaagtaatgactaatatttgacatgccttttatctgatttttagaatcttactcacgtgtaaataccttgactatgtagactatttcaatcacatagatgttttaaaaactttgtgtatacatgagatgtgtttgtaagtagtgtttattaacttttaagtacccttgttgctatggtgggggtgcaattaaatatgacagataatttttccaaggacagattttttaaaaatttgatgttacaaaatgactcatagattggcttttaacactaaaatttttttaatgctatacgtctttattttataaatatctgaaaccctgaataccctaaaataaatttctcaagattgttctaagtaggttaaaagaaataaactttcttcttttacagaacattttttgaggggacatttacttcattccccatttgtttctttttgaataatttgctgaatttaagataagagcatttctgcatataaaaagttctcttgtgtggggagtatacatggaagtaacagtatgggatacaatgagggtgggagagaagtctggttttcttctcagcttccctttattgcactccaaatatgggttggatattttgtcagggagatggctgggaagaaatggagattacaagacataagtttcttaaatactgaggactcctctttattattgaatgatctttggtgattttgtatctttgggtgattttgtatccagtgtttcgtttggtcttattaaagattatagaaaagtcatatcatttgagaggtgagagatgttttacagtgatctagtcaggtgattttgttttgttttgttttgttttaagctttttgccccatgggtagaaccttaaataaaatgagtggaagtgaggctgctccttgtgaaatcaggaatgaggatcctgtatcctggctcacttggcctttacccctctgcacaggagacagttcttgagtttgaaaactgccgttgttgatcaaacttcaattttataaagaatgcaaatttgggagaagtgacttgtctagggccatatgccagttagtgattgacatggggctgcaactcagatcttaagcttagaggcaaagattttaaacagggctggaaaaagatcaggtttacatatcttaaaagattgaactgagacaatggatgagggcaggaggggctgagactggcacctgcaggatcagtaggagactatgtgagatcctgaacccaggcgctagaaaggagggctgtcactaaatagccattatcaaataggtaggtttgataagacttggtcacctctagaagtgggaagaatatgggaggtcgaggcaggagaatcgcttgagcccaggagttcaagtccagccctggcaacttagtgagaccccgccgtctctacaattaaaaaaaaaaaaaaaaattagctgggcgtggtggcatgcacctgtattcctagctgctctggaggctgaggtgggaggattgattgtgcctgggagttcaagcctgcactgagccctgattgggccactgcactccagcctaggtgacagagtgagaccctcaacgacaacaacaaagcggagagagcagcgaaggaaagggaggagtggggtgatctccacatttctggtttgctgatggggtacaaggtgagctagataactcggcttattttggggtgagttgatttggggatgtctatgtgactttcattaagagaagcctgattttctggtgggatgtggttggtgtaagtatggaagtctggggaaaataagacaaagtattagatcaccagcattcaagtggcaggcaaaggagatgaagaagggaccttcagagtggaatgagaaatttcaccaatgccagatgttgcataaagttcaatgaaagtgaggaaggaatctggtagattttacagtgagcatttcatataatgccctttgccagaacattttcagtggaatagtggagatagaactctcgatgtaatggggcgaagtgtgaagaggtggagaaatttaaatagcatgtgtagactattttggggaactttgctgtgaaggacaggagacgaggtggtaaccactcatagacataggagtgggggacaaggtttttaaaaaagaaggtgtgagaggcttaagcttatttctagataggggaaggagtcccccgtgtggaggaggaaaataccagcaagggattcaatcccaggaatgggctgttatgggaagaaaggaaagcactgcttggtgttcatgcacatgtcactcagtctgtccgtgttgagccactactttttcttttgaaagctacaaagggtatctaatccaactctgatacttatatcaagcacctttaaataaaaggtggactttaaaaaaaacagctttattgagatatcagtcatatacaaaaggtggaatttatcagttctttctctatacgttcccccttccatttcatactgaaaacctcatctactctaccacttacggacatattttttgttggtataaacaggtggtttgttttccctactgctggaagcgaagagctttttaagcaggagaattactgcttagcgcctgagaaattctggactgggacttctgctgttcatatcagcaagtgatttttgttgtttttgttaaattatctcatctacattcttcatcctgagtatttggcatacaaattcccccttttgagaggggaatgatggataagaataatattagctgaaaagacagactgaaaatctggggacttaagttctgttccctttgtaacgttagctagttttatgactttaaacaagtcactttgtttccttatctctaaatgctcttgaagatcccttcaagacagaatactgtgcttttttgattcctgttttgtgtagcattttgtggaagagtcactggattaaggtcttttaaaattaatttaaaaacatatatatctccaaattactagcttgataatttgttaaagaatacttactgattttctttactaacaaaagaatttttaatgacataccagtgggtattgagaacacttcagctacattcacccacagtcagctgatatttagctgatatttagctgactgcggagaagtcatgtgttttgaatataagaataggcactttcagatgttctctgagtgccagtaattagagtaagccttaatccactgtgctaaaaataaccaaacatacctttcttcttactagtctattattaattttacttcagatttagacttacaaataggcactaagagaacaaaatgagctcattattgatttttttaaaaccatttggtcctaaatataggaagtacacttcaggttctcttggtaatcttttactaaatcagtatggcatattttacttctcttcaaagctcttaaaatattgtttcgagcacattttaatttttgccaggtatgggattacgttaatgcaattgctggctatagtttttaatgtaaaacttgggctctagagtcaaattgctgttcctaggcaggttactcaaacctgggtctcttatcaatgcaaataataatggtatctcatggatacggttgttgtgaggattagagtggtaaaatatgcaaaagccttagctaacatttaatgtctcatgtagggcgaggattcagtgaatggtacttaattattatgtttctgtttttttcctgccctaagctttctggaaagaggtacattattatcctgatagctatctgttcacctacaccaaagaattcattaatttgattattctttttccattccgagtgaaagtaaacattactggctggggcttagacacattgtttctgatgatttttaaattaatgcttccaagtgattcatgcagtttaggacctttgactagtgtttaagtgctttttatttgtaagtaaagaggcagtactgtggataaggagcgaggatggtacgagcattagcttgtttaatagtagcatgaggaaatcttaaataaaaggaattttacttgaaactgttagtaaactttgtataataaattatttagcattctgttcctatcagctagtcatatctggtttttaatctaccatttttatgtcagtccctttaatgtttagttttcttaaatcagggaatcttatgtgtcatttatcagtttcctcaaattcaaagttctatttaatgagcatgggttagggaggatggagagttggaatactctattctcttttaaatagacaaacaaaaacagtaacgatgggaaagagagggagcactttgttaaagttggcattgatgccctgttttgtcttccatgacttattcccttcacaatgatgataaatgaacacatgtgaatacctcctctcaataagactgcagtagctccaccattttaaataacttactgagtgtggaagtcaggtagagtagacatgcacaaactcatgatatatatgccaagtgagtttgtatgatacagtggaaaaaggcctggagttaaggtcaaaagatcaggtttcttatcccagtactagcacttgtaggcgctgtactcttaagcctcattttttttttgtctttttttaatctgtgatcaaggatgaaagatagtacttgctgttgaaaacatcaaataagatgaaatggttttaataatgaaattaatgctgttgtgtgaatactagttattttcatactaaggagcaagaattcattgagtctcaaaacaggttgtgttattctgtatacagtattattttacattaatgctacgagcagtaactgcccattgtgttttctaaaaatcatttaagtgatcttcagtgaaaattataatctccactgaaatgttctgtgtttagcctatcttaggtttttattttctttcttttcaaaagccttaagtacatgtaaaccattttaaaatgcccttttaatcctcctcaaaggacttgctatgcctcagggttgaagttttgcttccttgggtcaagcataacatgattccatatgctagaatcctaatttgaaggagaatataagtttcccaaccttattccctcttctagggtaaataaactacacttcagttcaacagtgtagaacttggtaaatttgagaacaggcctctgtttcccttaagtgataggaactttctgttctctttctctaacttctgtaataacgtggagctgttgttcttttcgtatggtttattctgcaatcctagaaacctttttaaaaacaattctattctgttagaagtcaagagcatagttacccttgggggtgggaggttgtgactgggagagggtagcagaggagtttcagggttcagtagtgttcagcttcttgatgtgggtgctgatatatagttgagttcactttgaaaatttattgagcttgtaggacttaaggtcttctctgtgtatatattatacatattccaataaaatatcccaaaatattgacctcaccttggcattatcctcaacaagtcctccttcagttggaaggtttgttttcttctctgtacttacagtttgaattaatctgctatatattttgttttaattaagtaaacttaggaaaaacctgggtctgctatgttttaaaatgcttatagaaaagaacctgaaaggaagaagggcaaaatcacttattctaagtggtatgattattttgattttttctttatacttgcctatgcttttcaaaatttctgttatgcgtttattacttttgtagtctatgagaaaaatctgtactgtcgtgaaagaagaaataaactgtataaacttggggcttttcataataggatatgaaaatatatttagaaaacatcattataggataacagtttttttcacatttgtactttgttacagatatgctagtctgtatttttgctgtgctattgaggatcaggacaatgaactaattaccctggaaataattcatcgttatgtggaattacttgacaagtatttcggcagtgtgagtagtattttattttaggaaattgaatgccatagtatattttggaaccttttctctaacaagtttattttttggttgtcttggggattctaaccgcgggagagggtgggaatgactatttattagtagaaattattaagttgtccatattgggaacatgcagagcccagtcttatttagcttgtaggaatatgttttcaagtacttgagatttggaaattaagcttacttaaaccagtgatacttagtcatttttagaaagagttaagattgattcactctagttcgattttattcactacctgatagtgaataagcatcttctgcttctgcaagttttaacaattttttcttttcttttttcttttttttttccttttcaggtctgtgaactagatatcatctttaattttgagaaggcttattttattttggatgagtttcttttgggaggggaagttcaggaaacatccaagaaaaatgtccttaaagcaattgagcaggctgatctactgcaggaggtaagctacttattctcttcactaggcactagcatgttttgctcttgctggggaagtctcattcatcattcttacagtttcagaaagtactctgaagcatgcttgtcatgtagtgtccatccatgtgcagtttattgactggaatatgtgtcagtcacgtcaactcagttatctatggatggatggttcagtttggagatggtctatcggtcaggcctcttcccaatggccctttttggaccctaaaacactggagtctaaacctttagaggacagactatttgaagaagggaaaagattggctgaaagtagcagtaagttgagaactctccatctattgcttcaaattgtttaagataaccccctttttcattagtgtagataatcaggagttgactatgagattatgacattttaattccaaattggctcatatttttacctcatgtccattaaatgcaaaagtagccaagcaaatgatagtgttttctaattatactttttgtagaaacttccaggttttttttgttagcaaaactaaacagtatttgcatttctctttgctcttcttaaataacaaaccatgttctgtcaaactgcattcttgtcttacctccatatccccagatgtgtaactcccttttctttctaattaccatagtcatcttgggttaattgtgcagttgatgctgatgtaccttctatttctgaagcttaacatttcatagataaggctacctttttccaaaaacttaatgataccttaattcagataccaaattgaattatgctttagagctaattgtgatttttatcatatggaaagcttacagcatgagaagtgattagtaaatattgaaaaatgaaatgtgttttcactaaagtagttgttaagtgtgtgtttgcatgtatgtaaaagtcttgaatatttttggctcactggttcattttccagaagcattgaaaatatgattttgtatttccagtttattttagtcccttctttgttacatacatgtttatcagtttgttcttgtctttttttagtcaccaaaggtgactttcagtcccattttttagccttggaggcattcagttttaagggagtgaaataaggggagaagagtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaattttaatatttttcctggagagtaattttttgtttgtttgtttgagatggagtttcgctcttgttgcccaggctggagtgcaatgacacgatcttggctcactgcaacctctgcctcccgggctcaagcgattctcctgcctcagcctcccgagtagctgggattacaggcttgcactaccatgcctggctagttttgtacttttagtagagacagggtttcaccatgttggtcaggctggtctcgaactcctgacctcaaatgatccgtcccccttggcctcccaaagtgctgggattaaaggtgtaagccactgcacccagctgtgcctggatttttaaatgctactgggaaattgctatgggccttagaatatgacagcaatgttaagtttaccttagagcatatattcagtatttaatgtactaggggataagaacattattgcagatccacatttatttgtgtgtgtatatgtacatatgtatatatattcccctatgggagtattttaatagttaatattgtccttctgtttgaagtactatttttatgtctttttttttttttttttgagatggagtttcgcttatcacccaggctggagtgcagtggtgcaatttcggctctctgcaacctccgcttcctgtgttcaagcaatcctcctgcctcagcctcccaagtagctgggactacaggtgcacaccaccatgcccagctaatttttgtatttttagtaaagacaggctttcaccatgttggccaggatggtctcaaactcctgacaggtgatccacccacctcggcctcccaaagtgctgggattacaggcgtaagccaccgcatccagcctatttttatgtctttaattggggaaagtaagtgcaaagagaaaagcataggatgagtatggttggtcccatgtaaaattttccttacccccttgtaacctttgtttaaaataaagaaatgagtactgttaattacagttccttgtctttagaagaaagctgtggtcctgtttctcttctatgactacttttacattgctttgtacacaaacgaaactgagtaccacattgagacattgtctatttagcagtctgagtgaaccatttttcttagccatgtaggtcttggggaagcagtaggtggtggtccattctgaatttagagtgagaatacatcgtaggttaaggccattatgaagccaagctcaagtctgtgtggagcagtaaggcttcaggttattctgttctcttcatcaacatactctgagaagaaatgcaggaatggcaagatgcatgtttcctaaaaatagattcatttatatttttgatgcatgatacaagtttacatctgtgggagagtatttgaatattatgttcataaaatagcaagtggaataagagaaaaagcactccacaaactgctggaaaactttttgttttggataccatgacaacaaaaataattatgatggtaactaacgcttgagtgcttgtatgtgaggccctgggctcagcagtttgctttaagcatcctgtgctaatcctcaagacaccctgtgaaaggttagaggtagcctaatgagaaagtggaatctcagtgaggttccatgactggtctgaggccacctggttagcaactggcaaaaccaggattctaaacccagatctactaggcttcacagctgtgtaaaatcttaaccactgtgcacttcccctaaccccagttatgtattgtcttggtatatatattttaaacgttctgttttagatatgaacttctttgtttctcagtcatatagtgagaaattcataattctcccagaggtttttctgtgtggaaaagagtagatttcctaagacagtgccatctttgacttcttagactgcaaatttttattgtccagattatcagcagttggaattttttattggatatgtagatataaataatatttttcaacctatttcttgttggattgatcaaaatgcctggatttataataacttttttggtcttatagtttggggtatagcattcacttaatcaatttcatgaaatgattttgcttccaaaattgtaaatatagctgtgaagatctaaattcagacttacatttgtagtagaagtcctaattggtcaattttaatctactttttcatgtgtcattatttttctgtttagtgtcaggtcttttacttgaattgattatttctaagcaccaaagatgactttgaacttatcatgtacttatctgttggcttaaaggtgtatacacatctcaatgattttgatttttttttaatttgtgaaatatacatttctatccttaagaatgcttattttcttcagaaaaattaaaaaaaaatttctcttacccaatttgtataaacacatagtttaaggtagtccttcattttatagccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaattggcccgttatccattttttaatgtttggctgtcttaacatgccactggtactaaagatgattcttaaattattaaagtacaacatgctgaaattgctaaattgatattctttgcaatacttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatgataaagagcagtctaaggctttagtccctttgatccccaacttatttattggtaactactaaatttaccatttttgtggcatggataaaatggagtgctatgcaaatactgttgcacgtgagatgatttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgttggtattttttctcactaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtgatttcttttaaaaaatgaagcttttgtaacttaaaattattttaataagtactttttgaagtattgaataacatatcttttaatatgaagttttggactttttaaaggtcagctcttgatataattaagaatatttgggctgagcacggtggcccaagcttgtaatcccagcactttgggaggccggggcagttggattgcttgagcccagaagttcgagaccagcctgggcaatgtggtgaaaccccatccttacaaaaagtgaaaaaaaaaaagactagctgggcatggtggtgtgtgtctgtagtccaagctaattgggaggctgaggtgagaggattgattgagccctggaggtccaggctatagtgagccatgatcatgctactatataccagcctgggtggccacagaacgaaactttgccgaaaggaaggaaggaaggagggagggagggagggaaaacagaaaaaagaaagaatatttgggcatgctagtccaacttgagaatatcttaaattgttttaaaaaaagagatgcttccaaatatgtacaagaatgtcatttaacagcaaaaagcattttgatataaatcctcttagatttgcttaaataagacaaactcgtgtaactcctttgtaattactactgttcatgttaaaaccttcaagcctcttttaaagttaacaagactatagtcttttattgccagcgtactttagtttttttataggtaaacttaatcagggtttattataacaaattctggacaaatgaagtttgattacattaatgcttgaaatggaagtgcttgaaaggaagggcagaaagcaggacaaatgttgcctttcattttacatttaataagaaacaatttggccaggcatggtggctcacgcctgtaatcccagcactttggaaggctgaggcaagcggatcacttgaggccaggagttcaagaccaacctggccaacatggtaaaaccccatctctacaaaaaatacaaaaattagctgggcgtggtggtgcacacctgtagtcccagatacctggggggctgaggcacaagaatggcttgaacccaggaagcggaggctgcagtgatccgaaatcaggccactgcactccagcctgggcgacagagtgagactctgtctcaaaaataaataaataaataaaataataatttggccagtgtccttactctctggttctcaggttgtagtcattttgctttatgtgtttttgagccttttttcttttcatacttttcaaaattttgaggattttccgcttgctatttctattctattcttttcttaaatgctgatcctgacctagtaatttgatttcatgagccctagggttggaacctgcacagggacctgcaaagggaatagtctgtggtgtcggtggtgattttttttttaattaaaaaatactttctgaaaaatgtcacgtttgagtccttttttcacctactgacattttcttttgtttcctctgagggcctttttttaaaaataaaaattcccattctggaaaaattagcaaatacaggcaaacacactagaatataatcttacccaccaactagagccaattagattaactcagtggttcccatggagtgggagtggtgcagttgtgcccctctaggggacattgggtaatgtttggacacatttttggttgtcacaattgggggtgcagtgctaccggcatccagtaggtgaagaccaaggatgctgctgagaattctgcagtgcacaggacagcccccttagaacgcggaattatctggcctcaaatgtcagttgtgcccaggttaagaagccttggtttaatttaacactatggagtaaagattccatttacatttatagactgctatatcttttcaatattatatgtagaccacagtataaataagtggctaaaaattaatcaaaaatgcaaaaaatcaagaaaggataaatgtgcttaagaacatacaaatagctataaaaatcattcctaggccaggcgcggtggctcacgcctgtaatcccagcactttgggaggccgaggtgggtggatcacaaggtcaggagatcgagaccaacctggacaacatggtgaaaccctgtctctactaaaaatacaaaaattagctgggcgtggtggtgcgtgcctgtaatcccagctacttgggaggctgaggcaggagaatcgcttgaaccagggagtcggaggttgcagtgaagcgagataacgccactgcactctagcctggcgacagagtaagactccgtctcaaaaaaaaaaaaaaaaaaaagtcatctctatgattcaccaaaattacctctacataatgaccagttactggggagataatctatggttgactttagaatccaccctacagcaaggcttgtaggatgtcactctataatttaatttcctcaacaacagccaaatctgttaacttctattaaggtaattgagtttttatgtggaaactgaattgagtataccctgcagacagaacacctttgaattttctgccaatctccccagccactttagggatttgttaatttcttaaaggaggaatagttcaaatgaccagaatttacatatatagacttttgttgcatatatagactttttgttgttgttgttctctggcatcctgttagccttaaaggttttacttagtgaagatatttagtagcatttgagtatttgaaattctgtgattccaagaaatcttttacctttgaaaaaccctaatttagggtattccaaggcaaatacaatacagcatgtcctaaaacatgcttaaaatatttctttgcagtctaaaattatatttgctagctgggcacagtggcacacttccataatcccggctacttggaaggctgaagtggaaggatcccttgagctcagaagtttgagaccagcctgggcaacatagtgagacccctcactcttaaacaaattatatttgctaagttaattattctgcttttttttgtttgtatatttgttttgagacagggtctcactctgtcaccaaggctggaatgcagtggcaccaccatggctcacttgcagccttgaactcctgggctcaagtgatcctcccacctcagcctcccgagtagctgggattacaggtgcacaccaccatgcccagctaattttttaaaaattttcagtagaaatggggtctcgccatgttgtcagggctggtcttgaactccgaggctcatgcagtcctcccaccttggcctcccaaagtgctgggattacaggcgtgagccactgcacctggcctctgcttttttattttaaaagcacaactaactggtagataaagtgatttgtctttagtatttgataactaatgggttttagagtgttatttataagatgtagtaaattatcctcatcattatttttaagacaaatttataagacaagtgtaatagaaatagatcaacagcacaatagaaaaagatggcagaaaacatgaatatgtaattcacagatgaaagcaaaacaaatggtccttttattaagggaatgcaaagttaaaaatcaactagacccttttttgtttgtttcttcttggattggcaaagaggagcacttaaaagctgtattttgttttggaggattagtttggttatgtctactaatgactaaatgtgtacatacattttgacccattagttacacttcaaagaattttatccaacaaaaatgtactgagacacattgcttagtataataagccattgaagcttacccaaatattcatcaatgagaaataggttaagaaaattatagtacaaccatacatgaaactgatgtagctgtaaaagaaatgagatcgatttttttttgtaatgatatggaaggatactcaaagtatatcaagtgagaaaagatctaggaacaggatattattattattattattttattttttgtagggacagggtctcaccatgttgcccaggcttaggagcaggatattagctaactcgtgttacttctgaaaatctttgaagctccccctgctcttttttccagaagtgtaaaaacaagcatgtatttagtattacacatttttaaaaaatgaaaaaatgctgctgtgtgaatgaaagagtatacatcgtgttgctccagatggtaaaactagagtagaatttactaaaataaagtttcagcacgtaaagtaaagcacttctctgctcttggccattttagacactaaccatctggagcaaccatgtaactcttgccactcatagctaacttaatgtaaaaaaaaaaaatcgcttgactttcttagcacttcacaaatgcttgtaagactgacaccaggagccctgtcatctaaaaggcactttatagagtgctttcaattcttctgttttttcattcattgctcaaaatagatcgtagtgagataagatagtctctggccttcttggtctttggcacaaggaagagggttccagagttgagagtaaggactttgcatcctttgccatagaatttgattaggggccataaaaaggaccattgtgttctagaatgtgaaggactaagcataccactttatagtgcaaggaataagtgaagaagtccttttataagaaaaactgcagtagagcaataacttgaaattacacttatttatatttacttttcattaaatgtaaattattttcttttaccacattgtactactagaaagagaatcaggagtttaggcattcagtcatagatattcgataccattgatttacttaagcacttctcatgtcaacaagacttaagcctgcagataattcctattttatcagtgttcgttatagcttccctgttggttttacttgtgagtcataagcctagtatggtgaatatctaggaaatttcacggtaacagggcttgtcttaggttttgagaacaggtgtaacttgacttctctctgctgtttgtcatcctacacttcccactacatctggtcctttttgtagggtgttgagaacaacatttttcttcatgcaggggaaagtggaagtgcatgttttctaagaaggacaaataggaatagaataaaagaaaaagtatattggggctgggcatagtggttcactatgtaatcccagcactttgggaggctgaggcgggtggatcatgaggtcaggagttcgagaccagcctggccaagatggtgaaaccccatctctactaaaaaaaaaaaaaaaatacaaaaattagccgggcacagtggtgggtgcctgtaatcccagctactcaggaagctgaggcaggagaatcgcttgaacccgtgaggtggagattgcagtgagctgagatcaagccactgccttctagcctgggcgacagagcaagactctgtctcaaaaaaaaaaaattatatatatatatatatatatatatatatatatatatatattttggaagggagaatgggagtggaatcaaaaacattggtctcggatgagaagagtctttctcattggttatgtggtgataatggggtaaagctgtagactttttttttctttaattcatgagtaagatgagcaaaattgaggaagtgtcattttcttggccttgagaaatgacatcatctaaaggagaatcgttgggactggggagaaggggaggggtgtatagcttgaggacagtgtgaggagttggcagtagacttggtggggagcaaattagtgaggagcaaaaaagatttcctgggattgaaagcccgtttcaggttgaaataatacattgtcatccttattcaaagaataggtctccagagaacctgtactaaggacaatacatggtttatagttgtacaatacaactggattaaaaaattttttctcactgttttcattctgacctttattcccacttaattgaaatcactggggttttagtgttttaagaaacggatagtttgctgagtattatatgtgactatttcctacgggtgcccaggggaagaacaagatagtaggcctaggcctgcacagggtcccttgtgtgctatgacagactttactctcaccctccctaattcctaattgatataatttttatgtgactcacaagaggtactggtggtaagaggtataaactggaatttataattgaatctactttctttgtatctgaaagaaaaatattttggttaattatgggcatataatttagctaaaaaattaccttaaatgttaagtggtccttaaggcatttataacagaactttttcagaccctagaagtctaaactgggaaattatttaaaacgttattaaagcaatttaaaatggtaaaaataatacatttatttttgtgcattttagagtttcttttcttcttgaaggatgtttttccagtgaagaggggtttctccctatgaagagtattctcacatttaatagatggtaatttcttacttaagtacagtaatatggatcaatggctataaagaatagtttggcttatcatcaacccttttctttcctaaaagcagtaaaaggtgtgtcagggtataagtggtggaaatgcctgggtggtcacattgagaattgttcctgtagaattgctggtgtagttcatagtaagtctcctggggaggaatggttgcatactccgccctgtttgggaaaccacctcttctcttttaatgagcgtaagctctcgatggttggtttttacatggtatgatagaaaattaagagagaaaagaaaaagatgataaactataatataaaggctcaaagaactggtattatttaggcaaaaggttatttgacagattggtattatttaggcaaaaggttatttgacagacttaaacttttcttgttctctctccagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagtttggtcttcaaatatggaggttaaaaaaagaaactattttgtgtgattatcttacaatctgtatgagctaatgtgttctaatgtatcacataaaagtatatgtgaaaatattacaagaaactaaaattaatttgtaccattatataatatttaaggttaaaacattcagtattaagaaattttgtagtgccacatttattgaatcacatttgtgctatataataatatcaaacaatccctttaagaacttattagagagctatgtctgaagtctgttctgcaatatctgttgctgaataataactctttcaaagcattaatgctgagtttatatagttcaaaaattctaatattcattcagttttaatacctaaatacttatattttactagtgatggcattctaatatattaagtcctcatttaaatacttgatactttgttaactgtggcattatatttctgaattttaaaacctttaatattggtaactattgcatattcttttaataaaacatgcagcatatttttttataaaaggaaaagaattcattgtttatatctagagagcataaagcctaagttaagtaagttattaaacaataacttcacaagatgttcaaatcgatttatcactgaaagaagatctatgaaaatgtgttttgaccaaacttagtattaggcaggtacacagataagattttccattcttaacattctcactgtaatgcacgacatttgaagcacctggatgtgctatcaatcaggtgggaaatttagcattatatattggaagcattgagaaacattggtctttcatttctatttttttttcccctcctttcctcctcctgccccacaatatattattcatctggttttaatgctacataaatatgcattgtctcatgcctgtttgtgttggatgccttgtgctaagctgtaacaaaatgttgcttcttttgctgtctgtatacagctgcttgctttaaattagtagattctgaaatagctttccttgcatgtctaaaataaaagtattgcatgtacttcgtctcatgtgaatgactttttcttttccatccctcataaaataacgttttatattttcatttttctaggcaaattttttaaattgtggttaaaaacacataacacagaattcaccatcttacgcagttttaagtgtacagttcagttgtgttagttaagtttattcacattgttgtgcagcagatctgcaggactttttcatctggcagaactgaaactctatacccattaatcaacaattccccatttctccctgtcccccagcccctggcaaccaccattcgactttctgtttctataaattttactactttagatagataatagtttttctgggtagttttgagctacaatttcagtgtgaacatgtgtaagttccattttatattatcaccacaatttattttaaaactctacctgtgcaagtctcacaagaataaaatgtgtaaataattctttgaaactaggccttttagaaaggacacatattttcaataatgcatatttgataagcagtatgattctctacaggaaatgctatataagattgcaggcagtgagcacatggggaaaagtctgaccagctccacggagtagctgtggggcatttttacatggagaagctgagaatgtaaactgtagaattcaatggaggcattatttaattgatacattcaaggctacatgaacctttaaactacttaacattacatggaaataattattttaaatttttcttgaatatttatgagatttagatgtcattctcagtgtatttaatgcttaaggctaaatataaatgaaagggattggcttacatcactcttgggtgttacatcatttccagtggactttcttaaaaaactttatcatgaaaacttcaagactcacgagtataggaaatagtataaagaaccctcgtgtacacatcactgagcttcaagaaccatcaacttaatactgtttccccaaccactccccgcatttttgcctcagtatcttagagcaagccctagacatcttgtcagtttgtctttaatacttcagtatgtgtccctaacagataaagtaccatgccccacaaaattaacaggaattaataattactatcttatgcctggctcaatttttcctaattgtctgaaaaatgcctttttatatttggtttgttagaatcagattccaaccaagactctcacattgtatctgattgatgtgcgttttaagtctcttttaatctttaacaaatcgtctgctttttcccgccttgccattttttttttttaaaacgaggtcatttatgctgcaggatgtcctaccttatggatttggccatcatactcatatggcaatgtttagctgttcttatatccctcatttctatttagatctgtaacctgactagattgaggttcaatttgagggggcaagaatacttcataggttagactctttttaaaaaaataccttttttcgctaaagctgatttttacccatttttattactatgcagacatactaaaaggtcatcatatgagctttataagtagaattggtgtatagtacttgcgtttaataataaatgctaaatcatttcgatttcaattgtgtaactatatcacctaacatttttgaagcactttctataaattaggcagagccttaattcacttaatctcaacatatgaaggtaagtactattatccatgttttccaaataaggaaacagaccatagagtttaagtaatttacttaagattacaccatgaagtgctttacatgcaattaatattctaaagatttatggtttaatataatttctcttctccttgctttgtgctgtaccatgattaggatgcgaaagtaagtttattactggatgccaaaaatttatattattttccatcattaaaatatagtgttgccttttaattacaaaattcgttgctagtaatacctgaaagttggcctccttggtcctttattttgtgatttgcaaaatcagccactttggaaaattattaaataattttttcctggatatgcttactttgttttgacctcctttgacacttaaaaaccagtgctggttgctacatagaataaaaatgcctttggcccatggcattctttgcatatgtggcctctagtgatgccattggttgcactggggaggtctgggaagatagctgtttctgaagacttgccgctgtggacacagttaactaaaaactccaagaggaagacatttctataaatgcatgtgacaaaaagcatggaacacaacagtaggcgaagaactgtgggaactcggagggaagaggttttgaattttaccactaagataacttatctttcatatatataattgagtagcagtgatttcataaattgccagcaggtttgcactgggcttgactgctttttgcatgacagcaacggcatctagcacattggtaggtaattagcaggtacttaatgaatgctgaaaacgtccttttgtggtctccaattttgagggcacaaaaccctaaataaccaatggctgtcaactagaatgctactgtgacacgaaattgctttcttgattctctaaaacaagcatgttcttccatgtcaatgtttcacattctcaagactccctggatctgcttaccagagtctcacattttccctccacaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaa
